US010221454B2

(12) United States Patent
Scherer

(10) Patent No.: US 10,221,454 B2
(45) Date of Patent: Mar. 5, 2019

(54) METHODS AND COMPOSITIONS FOR SCREENING AND TREATING DEVELOPMENTAL DISORDERS

(71) Applicant: The Hospital For Sick Children, Toronto, Ontario (CA)

(72) Inventor: Stephen Scherer, Toronto (CA)

(73) Assignee: THE HOSPITAL FOR SICK CHILDREN, Toronto (CA)

( * ) Notice: Subject to any disclaimer, the term of this patent is extended or adjusted under 35 U.S.C. 154(b) by 88 days.

(21) Appl. No.: 13/648,874

(22) Filed: Oct. 10, 2012

(65) Prior Publication Data

US 2013/0316911 A1    Nov. 28, 2013

Related U.S. Application Data

(60) Provisional application No. 61/545,515, filed on Oct. 10, 2011.

(51) Int. Cl.
| | | |
|---|---|---|
| *C12Q 1/68* | (2018.01) | |
| *C12P 19/34* | (2006.01) | |
| *C12Q 1/6883* | (2018.01) | |
| *G01N 33/68* | (2006.01) | |
| *C07K 14/705* | (2006.01) | |
| *C07K 14/47* | (2006.01) | |
| *C12N 9/20* | (2006.01) | |
| *C12N 9/00* | (2006.01) | |

(52) U.S. Cl.
CPC ............ *C12Q 1/6883* (2013.01); *C07K 14/47* (2013.01); *C07K 14/4728* (2013.01); *C07K 14/705* (2013.01); *C12N 9/20* (2013.01); *C12N 9/93* (2013.01); *G01N 33/6896* (2013.01); *C12Q 2600/156* (2013.01); *G01N 2500/04* (2013.01); *G01N 2800/2814* (2013.01)

(58) Field of Classification Search
CPC ............ C12Q 1/6883; C12Q 2600/156; G01N 33/6896
See application file for complete search history.

(56) References Cited

U.S. PATENT DOCUMENTS

| | | |
|---|---|---|
| 6,146,834 A | 11/2000 | Schaad et al. |
| 6,251,607 B1 | 6/2001 | Tsen et al. |
| 6,423,499 B1 | 7/2002 | Song et al. |
| 6,892,141 B1 | 5/2005 | Nakae et al. |
| 7,998,744 B2 | 8/2011 | Stevenson et al. |
| 8,367,417 B2 | 2/2013 | Stevenson et al. |
| 8,655,599 B2 | 2/2014 | Chinitz et al. |
| 8,862,410 B2 | 10/2014 | Hatchwell et al. |
| 2002/0012921 A1 | 1/2002 | Vincent, Jr. |
| 2003/0023070 A1 | 1/2003 | Ni et al. |
| 2004/0157243 A1 | 8/2004 | Huang et al. |
| 2005/0037414 A1 | 2/2005 | Lee et al. |
| 2005/0282196 A1 | 12/2005 | Costa |
| 2007/0141577 A1 | 6/2007 | Moore |
| 2008/0131887 A1 | 6/2008 | Stephan et al. |
| 2009/0098547 A1 | 4/2009 | Ghosh |
| 2010/0003685 A1 | 1/2010 | Aasly et al. |
| 2010/0028931 A1 | 2/2010 | Eggan et al. |
| 2010/0120046 A1 | 5/2010 | Brennan et al. |
| 2010/0227768 A1 | 9/2010 | Wigler et al. |
| 2011/0111014 A1 | 5/2011 | Langston |
| 2011/0130337 A1 | 6/2011 | Eriksson et al. |
| 2011/0311512 A1 | 12/2011 | Hakonarson et al. |
| 2012/0100995 A1 | 4/2012 | Scherer et al. |
| 2014/0088882 A1 | 3/2014 | Chinitz et al. |
| 2014/0155271 A1 | 6/2014 | Hatchwell et al. |
| 2014/0161721 A1 | 6/2014 | Hatchwell et al. |
| 2014/0162894 A1 | 6/2014 | Hatchwell et al. |
| 2014/0162933 A1 | 6/2014 | Hatchwell et al. |
| 2015/0051086 A1 | 2/2015 | Hatchwell et al. |
| 2016/0019336 A1 | 1/2016 | Chinitz et al. |

FOREIGN PATENT DOCUMENTS

| | | |
|---|---|---|
| CN | 1733937 A | 2/2006 |
| CN | 101148684 A | 3/2008 |
| CN | 101403008 A | 4/2009 |
| KR | 2009-0080105 A | 7/2009 |
| KR | 2011-0114664 A | 10/2011 |
| WO | WO 02/099129 A2 | 12/2002 |
| WO | WO 03/048318 A2 | 6/2003 |
| WO | WO 2004/018633 A2 | 3/2004 |
| WO | WO 2004/075010 A2 | 9/2004 |
| WO | WO 2005/042763 A2 | 5/2005 |
| WO | WO 2005/068664 A2 | 7/2005 |
| WO | WO 2005/108997 A1 | 11/2005 |
| WO | WO 2006/050475 A2 | 5/2006 |
| WO | WO 2009/043178 A1 | 4/2009 |
| WO | WO 2009/073764 A1 | 6/2009 |

(Continued)

OTHER PUBLICATIONS

GPHN Gene—GeneCards output pp. 1-14 printed on Jul. 2, 2015 from www.genecards.org.*
Hegele R.A. Arterioscler Thromb Vasc Biol. 2002;22:1058-1061.*
Ching H. C. et al. International Journal of Oncology 39: 621-633, 2011.*
Pinto, D. et al. Nature. Jul. 15, 2010;466(7304):368-72. with supplementary information. (Year: 2010).*
CNV: 14q23.3 summary output from https://gene.sfari.org/database/cnv/14q23.3 Nov. 30, 2017, pp. 1-3. (Year: 2017).*
Kaminsky E.B. et al. Genet Med. Sep. 2011;13(9):777-84 (Year: 2011).*

(Continued)

*Primary Examiner* — Stephen T Kapushoc
(74) *Attorney, Agent, or Firm* — Wilson Sonsini Goodrich & Rosati

(57) ABSTRACT

This document provides methods and materials related to genetic variations of developmental disorders. For example, this document provides methods for using such genetic variations to assess susceptibility of developing Autism Spectrum Disorder.

16 Claims, 9 Drawing Sheets
Specification includes a Sequence Listing.

(56) References Cited

FOREIGN PATENT DOCUMENTS

| WO | WO 2010/036353 A2 | 4/2010 |
|---|---|---|
| WO | WO 2010/056897 A1 | 5/2010 |
| WO | WO 2011/012672 A1 | 2/2011 |
| WO | WO 2011/035012 A2 | 3/2011 |
| WO | WO 2011/112961 A1 | 9/2011 |
| WO | WO 2012/023519 A2 | 3/2012 |
| WO | WO 2012/027491 A1 | 3/2012 |
| WO | WO 2012/047234 A1 | 4/2012 |
| WO | WO 2013/071119 A2 | 5/2013 |
| WO | WO-2013067451 A2 | 5/2013 |
| WO | WO 2014/043519 A1 | 3/2014 |

OTHER PUBLICATIONS

Sanders S.J. et al. Neuron. Jun. 9, 2011;70(5):863-85 (Year: 2011).*
Bremer, et al. Copy number variation characteristics in subpopulations of patients with autism spectrum disorders. Am J Med Genet B Neuropsychiatr Genet. Mar. 2011;156(2):115-24. doi: 10.1002/ajmg.b.31142. Epub Dec. 8, 2010.
European search report and opinion dated Feb. 11, 2015 for EP Application No. 12839712.2.
Griswold, et al. A de novo 1.5 Mb microdeletion on chromosome 14q23.2-23.3 in a patient with autism and spherocytosis. Autism Res. Jun. 2011;4(3):221-7. doi: 10.1002/aur.186. Epub Feb. 28, 2011.
Marshall, et al. Structural variation of chromosomes in autism spectrum disorder. Am J Hum Genet. Feb. 2008;82(2):477-88. doi: 10.1016/j.ajhg.2007.12.009. Epub Jan. 17, 2008.
Pinto, et al. Comprehensive assessment of array-based platforms and calling algorithms for detection of copy number variants. Nat Biotechnol. May 8, 2011;29(6):512-20. doi: 10.1038/nbt.1852.
Sudhof. Neuroligins and neurexins link synaptic function to cognitive disease. Nature. Oct. 16, 2008;455(7215):903-11. doi: 10.1038/nature07456.
U.S. Appl. No. 13/763,550, filed Feb. 8, 2013, Hatchwell et al.
Nielsen, et al. Sequence-selective recognition of DNA by strand displacement with a thymine-substituted polyamide. Science. Dec. 6, 1991;254(5037):1497-500.
Office action dated Apr. 3, 2013 for U.S. Appl. No. 13/095,722.
Daruwala, et al. A versatile statistical analysis algorithm to detect genome copy number variation. Proc Natl Acad Sci U S A. Nov. 16, 2004;101(46):16292-7. Epub Nov. 8, 2004.
European search report and opinion dated Feb. 27, 2015 for EP Application No. 11814903.8.
European search report and opinion dated Jun. 9, 2015 for EP Application No. 12846660.4.
GeneCards output for ATXN2 gene, from www.genecards.ord, pritned on May 20, 2015, pp. 1-13.
Human Genome CGH Microarrays—Details & Specifications, six printed pages from www.agilent.com, printed on May 20, 2015.
Juppner. Functional properties of the PTH/PTHrP receptor. Bone. Aug. 1995; 17(2):Supplement 39S-42S.
Lucentini. Gene association typically wrong reproducible gene-disease associations are few and far between. The Scientist, Dec. 20, 2004, p. 20.
McInnes, et al. A large-scale survey of the novel 15q24 microdeletion syndrome in autism spectrum disorders identifies an atypical deletion that narrows the critical region. Mol Autism. Mar. 19, 2010;1(1):5. doi: 10.1186/2040-2392-1-5.
Pennisi. A closer look at SNPs suggests difficulties. Science. Sep. 18, 1998; 281(5384): 1787-1789.
Bult, et al. The Mouse genome Database (MGD): mouse biology and model systems. Nucleic Acids Research. 2008; 36 Database Issue: D724-D728. doi:10.1093/nar/gkm961.
Gatto, et al. Genetic controls balancing excitatory and inhibitory synaptogenesis in neurodevelopmental disorder models. Frontiers in Synaptic Neuroscience. Jun. 2010; 2(4):1-19.
International search report and written opinion dated Jun. 21, 2013 for PCT/IB2012/002498.
International search report and written opinion dated Jul. 3, 2013 for PCT/IB2012/002498.
Office action dated Jul. 17, 2013 for U.S. Appl. No. 12/449,566.
Rees, et al. Isoform heterogeneity of the human gephyrin gene (GPHN), binding domains to the glycine receptor, and mutation analysis in hyperekplexia. J Biol Chem. Jul. 4, 2003;278(27):24688-96. Epub Apr. 8, 2003.
Risch, et al. A genomic screen of autism: evidence for a multilocus etiology. Am J Hum Genet. Aug. 1999;65(2):493-507.
Veensra-Vanderweele, et al. Networking in autism: leveraging genetic, biomarker and model system findings in the search for new treatments. Neuropsychopharmacology. Jan. 2012;37(1):196-212. doi: 10.1038/npp.2011.185. Epub Sep. 21, 2011.
U.S. Appl. No. 14/449,217, filed Aug. 1, 2014, Hatchwell et al.
Notice of allowance dated Jul. 25, 2014 for U.S. Appl. No. 13/196,882.
Office action dated May 28, 2014 for U.S. Appl. No. 12/449,566.
U.S. Appl. No. 14/039,770, filed Sep. 27, 2013, Hatchwell et al.
Office action dated Nov. 18, 2013 for U.S. Appl. No. 13/196,882.
U.S. Appl. No. 14/090,932, filed Nov. 26, 2013, Chinitz et al.
De Krom, et al. A common variant in DRD3 receptor is associated with autism spectrum disorder. Biol Psychiatry. Apr. 1, 2009;65(7):625-30. doi: 10.1016/j.biopsych.2008.09.035. Epub Dec. 5, 2008.
International search report and written opinion dated Jan. 15, 2014 for PCT/US2013/062346.
Knight, et al. A cytogenetic abnormality and rare coding variants identify ABCA13 as a candidate gene in schizophrenia, bipolar disorder, and depression. Am J Hum Genet. Dec. 2009;85(6):833-46. doi: 10.1016/j.ajhg.2009.11.003.
NCBI GenBank accession No. NG_12385.1. Mar. 27, 2012.
Betancur, et al. The emerging role of synaptic cell-adhesion pathways in the pathogenesis of autism spectrum disorders. Trends Neurosci. Jul. 2009;32(7):402-12. doi: 10.1016/j.tins.2009.04.003. Epub Jun. 21, 2009.
Office action dated Dec. 16, 2014 for U.S. Appl. No. 12/449,566.
European search report dated Oct. 14, 2015 for EP Application No. 13746934.2.
U.S. Appl. No. 14/806,131, filed Jul. 22, 2015, Chinitz et al.
Abravaya, et al. Detection of point mutations with a modified ligase chain reaction (Gap-LCR). Nucleic Acids Research. 1995;23(4):675-682.
Bernard, et al. Sequence of the murine and human cellular myc oncogenes and two modes of myc transcription resulting from chromosome translocation in B lymphoid tumours. EMBO J. 1983;2(12):2375-83.
Dijkhuizen, et al. FISH and array-CGH analysis of a complex chromosome 3 aberration suggests that loss of CNTN4 and CRBN contributes to mental retardation in 3pter deletions. Am J Med Genet A. Nov. 15, 2006;140(22):2482-7.
Fernandez, et al. Gene Discovery in Developmental Neuropsychiatric Disorders: Clues from Chromosomal Rearrangements. Yale Journal of Biology and Medicine, vol. 78 (2005), pp. 95-130. on p. 103. Abstract.
Gelmann, et al. Identification of reciprocal translocation sites within the c-myc oncogene and immunoglobulin mu locus in a Burkitt lymphoma. Nature. Dec. 22, 1983-Jan. 4, 1984;306(5945):799-803.
Guatelli, et al. Isothermal, in vitro amplification of nucleic acids by a multienzyme reaction modeled after retroviral replication. Proc Natl Acad Sci U S A. Mar. 1990;87(5):1874-8.
Kwoh, et al. Transcription-based amplification system and detection of amplified human immunodeficiency virus type 1 with a bead-based sandwich hybridization format. Proc Natl Acad Sci U S A. Feb. 1989;86(4):1173-7.
Landegren, et al. A ligase-mediated gene detection technique. Science. Aug. 26, 1988;241(4869):1077-80.
Lizardi, et al. Exponential amplification of recombinant-RNA hybridization probes. Nature Biotechnology 6.10 (1988): 1197-1202.
Mohapatra, et al. Analyses of brain tumor cell lines confirm a simple model of relationships among fluorescence in situ hybridization, DNA index, and comparative genomic hybridization. Genes Chromosomes Cancer. Dec. 1997;20(4):311-9.
Nakazawa, et al. UV and skin cancer: specific p53 gene mutation in normal skin as a biologically relevant exposure measurement. Proc Natl Acad Sci U S A. Jan. 4, 1994;91(1):360-4.

(56) References Cited

OTHER PUBLICATIONS

Office action dated Sep. 2, 2015 for U.S. Appl. No. 12/449,566.
Petrini, et al. The immunoglobulin heavy chain switch: structural features of gamma 1 recombinant switch regions. J Immunol Mar. 15, 1987;138(6):1940-6.
Saiki, et al. Primer-directed enzymatic amplification of DNA with a thermostable DNA polymerase. Science. Jan. 29, 1988;239(4839):487-91.
Calvo, et al. High-throughput, pooled sequencing identifies mutations in NUBPL and FOXRED1 in human complex I deficiency. Nat Genet. Oct. 2010;42(10):851-8. Epub Sep. 5, 2010.
Gagneux, et al. Genetic differences between humans and great apes. Mol Phylogenet Evol. Jan. 2001;18(1):2-13.
GeneCards output for DIAPH2 gene, from www.genecards.ord, printed on Jun. 11, 2015, pp. 1-11.
Hattersley, et al. What makes a good genetic association study? Lancet. Oct. 8, 2005;366(9493):1315-23.
Hirschhorn, et al. A comprehensive review of genetic association studies. Genet Med. Mar.-Apr. 2002;4(2):45-61.
International search report and written opinion dated Jan. 20, 2014 for PCT/US2013/059739.
International search report and written opinion dated Apr. 22, 2013 for PCT/US2012/063451.
Mummidi, et al. Evolution of human and non-human primate CC chemokine receptor 5 gene and mRNA. Potential roles for haplotype and mRNA diversity, differential haplotype-specific transcriptional activity, and altered transcription factor binding to polymorphic nucleotides in the pathogenesis of HIV-1 and simian immunodeficiency virus. J Biol Chem. Jun. 23, 2000;275(25):18946-61.
Nalls, et al. Extended tracts of homozygosity identify novel candidate genes associated with late-onset Alzheimer's disease. Neurogenetics. Jul. 2009;10(3):183-90. doi: 10.1007/s10048-009-0182-4. Epub Mar. 7, 2009.
Nalls, et al. Imputation of sequence variants for identification of genetic risks for Parkinson's disease: a meta-analysis of genome-wide association studies. Lancet. Feb. 19, 2011;377(9766):641-9. doi: 10.1016/S0140-6736(10)62345-8. Epub Feb. 1, 2011.
NCBI GenBank accession No. NM_207303.1. Apr. 20, 2004.
NCBI. GenBank accession No. AL390798.3. Human chromosome 14 DNA sequence BAC R-21O19 of library RPCI-11 from chromosome 14 of *Homo sapiens* (Human), complete sequence. Apr. 28, 2011.
Office action dated Jun. 23, 2015 for U.S. Appl. No. 13/763,550.
Office action dated Jun. 29, 2015 for U.S. Appl. No. 14/026,642.
Office action dated Aug. 4, 2015 for U.S. Appl. No. 13/668,049.
Office action dated Oct. 3, 2014 for U.S. Appl. No. 13/668,049.
Schapira, et al. Mitochondrial complex I deficiency in Parkinson's disease. Lancet. Jun. 3, 1989;1(8649):1269.
Schapira. Causes of neuronal death in Parkinson's disease. Adv Neurol. 2001;86:155-62.
Schapira. Mitochondrial complex I deficiency in Parkinson's disease. Adv Neurol. 1993;60:288-91.
Simon-Sanchez, et al. Genome-wide association study reveals genetic risk underlying Parkinson's disease. Nat Genet. Dec. 2009;41(12):1308-12. doi: 10.1038/ng.487. Epub Nov. 15, 2009. with supplemental information.
Stark, et al. De novo 325 kb microdeletion in chromosome band 10q25.3 including ATRNL1 in a boy with cognitive impairment, autism and dysmorphic features. Eur J Med Genet. Sep.-Oct. 2010;53(5):337-9. doi: 10.1016/j.ejmg.2010.07.009. Epub Jul. 27, 2010.
Thorpe, et al. Improved antitumor effects of immunotoxins prepared with deglycosylated ricin A-chain and hindered disulfide linkages. Cancer Res. Nov. 15, 1988;48(22):6396-403.
Vaughan, et al. Genetics of Parkinsonism: a review. Ann Hum Genet. Mar. 2001;65(Pt 2):111-26.
Walker, et al. Genetic analysis of attractin homologs. Genesis. 2007; 45(12):744-756.

Alexander Zimprich, et al., A mutation in, encoding a subunit of the retromer complex, causes late-onset parkinson disease, American journal of human genetics, American society of human genetics. Jun. 2011; 89(1):168-175.
Carles Vilario-Guell, et al., Mutations in Parkinson disease, American journal of human genetics, american society of human genetics. Jun. 2011; 89(1):162-167.
Co-pending U.S. Appl. No. 15/279,012, filed Sep. 28, 2016.
Corti, et al. What Genetics tells us about the causes and mechanisms of parkinson's disease. Physiological reviews.Oct. 2011; 91(4): 1161-1218.
European Search Report dated Sep. 2, 2016 for European Application No. 13836501.0.
"Introducing Genome-Wide SNP Array 6.0 Pure performance & Genetic Power." May 21, 2008. Available at http://www.genehk.com/news/doc/Genomics_genome-wide Human SNP Array 6.0.pdf. Accessed on Dec. 22, 2016.
Kumar Kishore, et al., Genetics of parkinson disease and other movement disorders, Current opinion in neurology, Aug. 2012; 25(4):466-474.
Latchman, et al. Viral vectors for gene therapy in Parkinson's disease. Rev Neurosci. 2001 ;12(1):69-78.
Lucentini, et al. Gene association studies typically wrong. Reproducible gene-disease associations are few and far between. The Scientist. 2004; 18(24):20.
Office Action dated Feb. 24, 2016 for U.S. Appl. No. 14/039,770.
Office Action dated May 27, 2015 for U.S. Appl. No. 14/039,770.
UK Parkinson's Disease Consortium et al., Dissection of the genetics of parkinson's disease identifies an additional association 5' of SNCA and multiple associated haplotypes at 17q21. Human Molecular genetics. Jan. 15, 2011; 20(2): 345-353.
Office Action dated Sep. 15, 2016 for U.S. Appl. No. 13/763,550.
Office Action dated Oct. 19, 2016 for European Application No. 12846660.4.
Office Action dated Dec. 6, 2016 for U.S. Appl. No. 14/026,642.
Office action dated Feb. 9, 2011 for UK Application No. GB0822081.6.
Paisan-Ruiz Coro, et al., Parkingson's disease and low frequency alleles foung together throughout LRRK2, Annals of human genetics. Jul. 2009. 73(4). 391-403.
Crespi, et al. Association testing of copy number variants in schizophrenia and autism spectrum disorders. J Neurodev Disord. May 30, 2012;4(1):15. doi: 10.1186/1866-1955-4-15.
European search report dated Apr. 11, 2016 for EP Application No. 13840476.9.
Guilmatre, et al. Recurrent rearrangements in synaptic and neurodevelopmental genes and shared biologic pathways in schizophrenia, autism, and mental retardation. Arch Gen Psychiatry. Sep. 2009;66(9):947-56. doi: 10.1001/archgenpsychiatry.2009.80.
He, et al. Analysis of de novo copy number variations in a family affected with autism spectrum disorders using high-resolution array-based comparative genomic hybridization. Zhonghua Yi Xue Yi Chuan Xue Za Zhi. Jun. 2012;29(3):266-9. doi: 10.3760/cma.j.issn. 1003-9406.2012.03.004. English abstract only.
Office action dated Feb. 29, 2016 for U.S. Appl. No. 14/026,642.
Office action dated Mar. 1, 2016 for U.S. Appl. No. 13/763,550.
Office action dated May 17, 2016 for U.S. Appl. No. 14/090,932.
Office action dated Jun. 28, 2016 for U.S. Appl. No. 12/449,566.
O'Keefe, et al. High-resolution genomic arrays facilitate detection of novel cryptic chromosomal lesions in myelodysplastic syndromes. Exp Hematol. Feb. 2007;35(2):240-51.
Prasad, et al. A discovery resource of rare copy number variations in individuals with autism spectrum disorder. G3 (Bethesda). Dec. 2012;2(12):1665-85. doi: 10.1534/g3.112.004689. Epub Dec. 1, 2012.
Tam, et al. The role of DNA copy number variation in schizophrenia. Biol Psychiatry Dec. 1, 2009;66(11):1005-12. doi: 10.1016/j.biopsych.2009.07.027. Epub Sep. 12, 2009.
Ziats, et al. Expression profiling of autism candidate genes during human brain development implicates central immune signaling pathways. PLoS One. 2011;6(9):e24691. doi: 10.1371/journal.pone. 0024691. Epub Sep. 15, 2011.

(56) References Cited

OTHER PUBLICATIONS

Liu, Qing-Rong, et al. "Addiction molecular genetics: 639,401 SNP whole genome association identifies many "cell adhesion" genes. "American Journal of Medical Genetics Part B: Neuropsychiatric Genetics val. 141 (2006): pp. 918-925.
Office Action dated Apr. 13, 2017 for U.S. Appl. No. 14/039,770.
Office Action dated May 25, 2017 for U.S. Appl. No. 13/668,049.
Office Action dated May 25, 2017 for U.S. Appl. No. 13/763,550.
Office Action dated Aug. 11, 2017 for U.S. Appl. No. 14/026,642.
Purcell et al. "Postmortem brain abnormalities of the glutamate neurotransmitter system in autism" (Neurology, vol. 57 (2001) pp. 1618-1628).
Zeng, Li, et al. "A novel splice variant of the cell adhesion molecule contactin 4 (CNTN4) is mainly expressed in human brain." Journal of human genetics val. 47 (2002): pp. 497-499.
Langston, et al., Multisystem Lewy body disease and the other parkinsonian disorders. Nature Genetics. Dec. 2015; 47(12):1378-1385.
Poewe, et al., Parkinson disease. Nature Review:Disease Primers. Mar. 23, 2017.vol. 3, Article 17013: 1-21.
NCBI SNP Database rs201412882, ss491686165, Mar. 6, 2012 (National Library of Medicine, NIH, Bethesda, MD, USA).
Notice of Allowance dated Jan. 11, 2018 for U.S. Appl. No. 14/026,642.
Copy Number Variants summary for 12q23.3-q24.13 from gene. sfari.org/database/cnv/, two pages printed on Dec. 2, 2017. (Year:2017).
Office Action dated Oct. 10, 2017 for U.S. Appl. No. 14/449,217.
Office Action dated Oct. 13, 2017 for U.S. Appl. No. 14/806,131.
Office Action dated Dec. 11, 2017 for U.S. Appl. No. 13/763,550.
Office Action dated Dec. 29, 2017 for U.S. Appl. No. 13/668,049.
Office Action dated Dec. 7, 2017 for U.S. Appl. No. 14/039,770.

\* cited by examiner

METHODS AND COMPOSITIONS FOR SCREENING AND TREATING DEVELOPMENTAL DISORDERS

CROSS-REFERENCE

This application claims the benefit of U.S. Provisional Application No. 61/545,515, filed Oct. 10, 2011, which application is incorporated herein by reference in its entirety.

REFERENCE TO A SEQUENCE LISTING

The instant application contains a Sequence Listing which has been submitted in ASCII format via EFS-Web and is hereby incorporated by reference in its entirety. Said ASCII copy, created on Oct. 9, 2012, is named 121009_ASD_SK.txt and is 73,619,309 bytes in size. The aforementioned file was created on Oct. 9, 2012, and is hereby incorporated by reference in their entirety.

BACKGROUND OF THE INVENTION

Genetic risk can be conferred by subtle differences in individual genomes within a population. Genes can differ between individuals due to genomic variability, the most frequent of which are due to single nucleotide polymorphisms (SNPs). SNPs can be located, on average, every 500-1000 base pairs in the human genome. Additional genetic polymorphisms in a human genome can be caused by duplication, insertion, deletion, translocation and/or inversion, of short and/or long stretches of DNA. Thus, in general, genetic variability among individuals occurs on many scales, ranging from single nucleotide changes, to gross changes in chromosome structure and function. Recently, many copy number variations (CNVs) of DNA segments, including deletions, insertions, duplications, amplifications and complex multi-site variants, ranging in length from kilobases to megabases in size, have been discovered (Redon, R. et al. Nature 444:444-54 (2006) and Estivill, X. & Armengol, L. PLoS Genetics 3:e190 (2007)). To date, known CNVs account for over 15% of the assembled human genome (Estivill, X. Armengol, L. PLoS Genetics 3:e190 (2007)). However, a majority of these variants are extremely rare and cover a small percentage of a human genome of any particular individual.

Today, it is estimated that one in every 110 children is diagnosed with Autism Spectrum Disorder (ASD), making it more common than childhood cancer, juvenile diabetes and pediatric AIDS combined. An estimated 1.5 million individuals in the U.S. and tens of millions worldwide are affected by autism. Government statistics suggest the prevalence rate of autism is increasing 10-17 percent annually. There is no established explanation for this increase, although improved screening and environmental influences are two reasons often considered. Studies suggest boys are more likely than girls to develop autism and receive the screening three to four times more frequently. Current estimates are that in the United States alone, one out of 70 boys is diagnosed with autism. ASD can be characterized by problems and symptoms in the following areas: communication, both verbal and non-verbal, such as pointing, eye contact, and smiling; social, such as sharing emotions, understanding how others think and feel, and holding a conversation; and routines or repetitive behaviors (also called stereotyped behaviors), such as repeating words or actions, obsessively following routines or schedules, and playing in repetitive ways. As genetic variations conferring risk to developmental disorders, including ASD, are uncovered, genetic testing can play a role for clinical therapeutics.

Despite these advances towards an understanding of the etiology of developmental disorders, a large fraction of the genetic contribution to these disorders remains undetermined Identification of underlying genetic variants that can contribute to developmental disorder pathogenesis can aid in the screening and identification of individuals at risk of developing these disorders and can be useful for disease management. There is a need to identify new treatments for developmental disorders, specifically ASD, and the identification of novel genetic risk factors can assist in the development of potential therapeutics and agents. There is also a need for improved assays for predicting and determining potential treatments and their effectiveness.

SUMMARY OF THE INVENTION

An aspect of the invention includes a method of screening one or more subjects for at least one genetic variation that disrupts or modulates one or more genes in Table 2, comprising: assaying at least one genetic sample obtained from each of the one or more subjects for the at least one genetic variation in one or more genes in Table 2.

In some embodiments, at least one genetic variation is associated with a Pervasive Developmental Disorders (PDD) or a Pervasive Developmental Disorder—Not Otherwise Specified (PDD-NOS). In some embodiments, the at least one genetic variation is one encoded by SEQ ID NOs 1 to 76. In some embodiments, the at least one genetic variation comprises one or more point mutations, polymorphisms, translocations, insertions, deletions, amplifications, inversions, microsatellites, interstitial deletions, copy number variations (CNVs), or any combination thereof. In some embodiments, the at least one genetic variation comprises a loss of heterozygosity. In some embodiments, the at least one genetic variation disrupts or modulates one or more genomic sequences of SEQ ID NOs 77 to 209. In some embodiments, the at least one genetic variation disrupts or modulates the expression or function of one or more RNA transcripts, one or more polypeptides, or a combination thereof, expressed from the one or more genomic sequences of SEQ ID NOs 77 to 209.

In some embodiments, the assaying comprises detecting nucleic acid information from the at least one genetic sample. In some embodiments, the nucleic acid information is detected by one or more methods selected from the group comprising PCR, sequencing, Northern blots, or any combination thereof. In some embodiments, the sequencing comprises one or more high-throughput sequencing methods. In some embodiments, the one or more high throughput sequencing methods comprise Massively Parallel Signature Sequencing (MPSS), polony sequencing, 454 pyrosequencing, Illumina sequencing, SOLiD sequencing, ion semiconductor sequencing, DNA nanoball sequencing, heliscope single molecule sequencing, single molecule real time (SMRT) sequencing, RNAP sequencing, Nanopore DNA sequencing, sequencing by hybridization, or microfluidic Sanger sequencing. In some embodiments, the at least one genetic sample is collected from blood, saliva, urine, serum, tears, skin, tissue, or hair from the one or more subjects. In some embodiments, the assaying the at least one genetic sample of the one or more subjects comprises purifying nucleic acids from the at least one genetic sample. In some embodiments, the assaying the at least one genetic sample of the one or more subjects comprises amplifying at least one nucleotide sequence in the at least one genetic sample. In some embodiments, the assaying the at least one genetic sample for at least one genetic variation comprises a microarray analysis of the at least one genetic sample. In some embodiments, the microarray analysis comprises a CGH array analysis. In some embodiments, the CGH array detects the presence or absence of the at least one genetic variations.

In some embodiments, the method further comprises determining whether the one or more subjects has a Pervasive Developmental Disorders (PDD) or a Pervasive Developmental Disorder—Not Otherwise Specified (PDD-NOS), or an altered susceptibility to a PDD or PDD-NOS. In some embodiments, the one or more subjects were previously diagnosed or are suspected as having the PDD or PDD-NOS based on an evaluation by a psychologist, a neurologist, a psychiatrist, a speech therapist, or other professionals who screen subjects for a PDD or a PDD-NOS. In some embodiments, the determining comprises an evaluation of the one or more subject's communication, socialization, cognitive abilities, body movements, or a combination thereof. In some embodiments, the evaluation comprises observation, a questionnaire, a checklist, a test, or a combination thereof. In some embodiments, the evaluation comprises a Checklist of Autism in Toddlers (CHAT), a modified Checklist for Autism in Toddlers (M-CHAT), a Screening Tool for Autism in Two-Year-Olds (STAT), a Social Communication Questionnaire (SCQ) for children 4 years of age and older, an Autism Diagnosis Interview-Revised (ADI-R), an Autism Diagnostic Observation Schedule (ADOS), a Childhood Autism Rating Scale (CARS), an Autism Spectrum Screening Questionnaire (ASSQ), an Australian Scale for Asperger's Syndrome, a Childhood Asperger Syndrome Test (CAST), or a combination thereof. In some embodiments, the screening the one or more subjects further comprises selecting one or more therapies based on the presence or absence of the one or more genetic variations. In some embodiments, the assaying at least one genetic sample obtained from each of the one or more subjects comprises analyzing the whole genome or whole exome from the one or more subjects. In some embodiments, the nucleic acid information has already been obtained for the whole genome or whole exome from the one or more individuals and the nucleic acid information is obtained from in silico analysis.

In some embodiments, the PDD is Autism Spectrum Disorder (ASD). In some embodiments, the PDD-NOS is Asperger Syndrome, Rett Syndrome or Childhood Disintegrative Disorder. In some embodiments, the one or more subjects has at least one symptom of a PDD. In some embodiments, the PDD is ASD. In some embodiments, the at least one symptom comprises difficulty with verbal communication, difficulty using language, difficulty understanding language, difficulty with non-verbal communication, difficulty with social interaction, unusual ways of playing with toys and other objects, difficulty adjusting to changes in routine or familiar surroundings, repetitive body movements or patterns of behavior, changing response to sound, temper tantrums, difficulty sleeping, aggressive behavior, fearfulness or anxiety, or a combination thereof. In some embodiments, the at least one symptom comprises not babbling, pointing, or making meaningful gestures by 1 year of age, not speaking one word by 16 months of age, not combining two words by 2 years of age, not responding to their name, losing language, losingsocial skills, qualitative impairment in social interaction, impairments in the use of multiple nonverbal behaviors to regulate social interaction, failure to develop peer relationships appropriate to developmental level, not spontaneously seeking to share enjoyment or interests or achievements with other people, lacking social or emotional reciprocity, qualitative impairments in verbal communication, repetitive and stereotyped patterns of behavior and interests and activities, encompassing preoccupation with one or more stereotyped and restricted patterns of interest that is abnormal either in intensity or focus, apparently inflexible adherence to specific and nonfunctional routines or rituals, stereotyped and repetitive motor mannerisms, persistent preoccupation with parts of objects, abnormal functioning in symbolic or imaginative play, or a combination thereof. In some embodiments, the one or more subjects has at least one symptom of a PDD-NOS. In some embodiments, the at least one symptom of a PDD-NOS comprises qualitative impairment in social interaction, marked impairments in the use of multiple nonverbal behaviors to regulate social interaction, failure to develop peer relationships appropriate to developmental level, a lack of spontaneous seeking to share enjoyment or interest or achievements with other people lack of social or emotional reciprocity, restricted repetitive and stereotyped patterns of behavior or interests and activities, encompassing preoccupation with one or more stereotyped and restricted patterns of interest, nonfunctional routines or rituals, stereotyped and repetitive motor mannerisms, persistent preoccupation with parts of objects, clinically significant impairments in social or occupational or other important areas of functioning, deceleration of head growth between ages 5 and 48 months, loss of previously acquired purposeful hand skills between ages 5 and 30 months with the subsequent development of stereotyped hand movements, loss of social engagement early in the, appearance of poorly coordinated gait or trunk movements, severely impaired expressive and receptive language development with severe psychomotor retardation, clinically significant loss of previously acquired skills before age 10 years, impairment in nonverbal behaviors, failure to develop peer relationships, lack of social or emotional reciprocity, qualitative impairments in communication restricted or repetitive or and stereotyped patterns of behavior or interests and activities, or a combination thereof.

In some embodiments, the one or more subjects is human. In some embodiments, the one or more subjects is less than 12 years old, less than 8 years old, less than 6 years old, or less than 3 years.

An aspect of the invention includes a method of diagnosing one or more subjects for a PDD or a PDD-NOS, comprising: assaying at least one genetic sample of each of the one or more subjects for the presence or absence of at least one genetic variation in one or more genes in Table 2.

In some embodiments, the at least one genetic variation is one encoded by SEQ ID NOs 1-76. In some embodiments, the one or ore subjects is diagnosed with the PDD or PDD-NOS if the at least one genetic variation is present. In some embodiments, the one or more subjects is not diagnosed with PDD or PDD-NOS if the at least one genetic variation is absent.

In some embodiments, the assaying comprises detecting nucleic acid information from the at least one genetic sample. In some embodiments, the nucleic acid information is detected by one or more methods selected from the group comprising PCR, sequencing, Northern blots, or any combination thereof. In some embodiments, the sequencing comprises one or more high-throughput sequencing methods. In some embodiments, the one or more high throughput sequencing methods comprise Massively Parallel Signature Sequencing (MPSS), polony sequencing, 454 pyrosequencing, Illumina sequencing, SOLiD sequencing, ion semiconductor sequencing, DNA nanoball sequencing, heliscope single molecule sequencing, single molecule real time (SMRT) sequencing, RNAP sequencing, Nanopore DNA sequencing, sequencing by hybridization, or microfluidic Sanger sequencing. In some embodiments, the ethod further comprises determining whether the one or more subjects has a PDD or PDD-NOS or an altered susceptibility to a PDD or PDD-NOS. In some embodiments, the one or more subjects were previously diagnosed or are suspected as having the PDD or PDD-NOS based on an evaluation by a psychologist, a neurologist, a psychiatrist, a speech therapist, or other professionals who screen subjects for a PDD or a PDD-NOS.

In some embodiments, the determining comprises an evaluation of the one or more subject's communication, socialization, cognitive abilities, body movements, or a combination thereof. In some embodiments, the evaluation comprises an evaluation of the one or more subject's communication, socialization, cognitive abilities, body movements, or a combination thereof. In some embodiments, the evaluation comprises observation, a questionnaire, a checklist, a test, or a combination thereof. In some embodiments, the evaluation comprises a Checklist of Autism in Toddlers (CHAT), a modified Checklist for Autism in Toddlers (M-CHAT), a Screening Tool for Autism in Two-Year-Olds (STAT), a Social Communication Questionnaire (SCQ) for children 4 years of age and older, an Autism Diagnosis Interview-Revised (ADI-R), an Autism Diagnostic Observation Schedule (ADOS), a Childhood Autism Rating Scale (CARS), an Autism Spectrum Screening Questionnaire (ASSQ), an Australian Scale for Asperger's Syndrome, a Childhood Asperger Syndrome Test (CAST), or a combination thereof. In some embodiments, the determining comprises comparing the nucleic acid information to those of one or more other subjects.

In some embodiments, the one more subjects comprise one or more subjects not suspected of having the PDD or the PDD-NOS. In some embodiments, the one or more other subjects comprise one or more subjects suspected of having the PDD or the PDD-NOS. In some embodiments, one or more subjects comprise one or more subjects with the PDD or the PDD-NOS. In some embodiments, the one or more other subjects comprise one or more subjects without the PDD or the PDD-NOS. In some embodiments, the one or more subjects comprise one or more subjects who are symptomatic for the PDD or the PDD-NOS. In some embodiments, the one or more other subjects comprise one or more subjects who are asymptomatic for the PDD or the PDD-NOS. In some embodiments, the one or more subjects comprise one or more subjects that have an increased susceptibility to the PDD or the PDD-NOS. In some embodiments, the one or more subjects comprise one or more subjects that have a decreased susceptibility to the PDD or the PDD-NOS. In some embodiments, the one or more subjects comprise one or more subjects receiving a treatment, therapeutic regimen, or any combination thereof for a PDD or PDD-NOS.

In some embodiments, determining whether the one or more subjects have the PDD or the PDD-NOS or an altered susceptibility to the PDD or the PDD-NOS comprises analyzing at least one behavioral analysis of the one or more subjects and the nucleic acid sequence information of the one or more subjects, or a combination thereof.

In some embodiments, the at least one genetic sample is collected from blood, saliva, urine, serum, tears, skin, tissue, or hair from the one or more subjects. In some embodiments, the assaying the at least one genetic sample of the one or more subjects comprises purifying nucleic acids from the at least one genetic sample. In some embodiments, the assaying the at least one genetic sample of the one or more subjects comprises amplifying at least one nucleotide sequence in the at least one genetic sample. In some embodiments, the assaying the at least one genetic sample for at least one genetic variation comprises a microarray analysis of the at least one genetic sample. In some embodiments, the microarray analysis comprises a CGH array analysis. In some embodiments, the CGH array detects the presence or absence of the at least one genetic variations. In some embodiments, the at least one genetic variation comprises one or more point mutations, polymorphisms, translocations, insertions, deletions, amplifications, inversions, microsatellites, interstitial deletions, copy number variations (CNVs), or any combination thereof. In some embodiments, the at least one genetic variation comprises a loss of heterozygosity. In some embodiments, the at least one genetic variation disrupts or modulates one or more genomic sequences of SEQ ID NOs 77 to 209. In some embodiments, the at least one genetic variation disrupts or modulates the expression or function of one or more RNA transcripts from the one or more genomic sequences of SEQ ID NOs 77 to 209.

In some embodiments, the assaying at least one genetic sample obtained from each of the one or more subjects comprises analyzing the whole genome or whole exome from the one or more subjects. In some embodiments, the nucleic acid information has already been obtained for the whole genome or whole exome from the one or more individuals and the nucleic acid information is obtained from in silico analysis. In some embodiments, the method further comprises selecting one or more therapies based on the presence or absence of the one or more genetic variations.

In some embodiments, the PDD is ASD. In some embodiments, the PDD-NOS is Asperger Syndrome, Rett Syndrome or Childhood Disintegrative Disorder. In some embodiments, the one or more subjects has at least one symptom of a PDD. In some embodiments, the PDD is ASD. In some embodiments, the at least one symptom comprises difficulty with verbal communication, difficulty using language, difficulty understanding language, difficulty with non-verbal communication, difficulty with social interaction, unusual ways of playing with toys and other objects, difficulty adjusting to changes in routine or familiar surroundings, repetitive body movements or patterns of behavior, changing response to sound, temper tantrums, difficulty sleeping, aggressive behavior, fearfulness or anxiety, or a combination thereof. In some embodiments, the at least one symptom comprises not babbling, pointing, or making meaningful gestures by 1 year of age, not speaking one word by 16 months of age, not combining two words by 2 years of age, not responding to their name, losing language, losingsocial skills, qualitative impairment in social interaction, impairments in the use of multiple nonverbal behaviors to regulate social interaction, failure to develop peer relationships appropriate to developmental level, not spontaneously seeking to share enjoyment or interests or achievements with other people, lacking social or emotional reciprocity, qualitative impairments in verbal communication, repetitive and stereotyped patterns of behavior and interests and activities, encompassing preoccupation with one or more stereotyped and restricted patterns of interest that is abnormal either in intensity or focus, apparently inflexible adherence to specific and nonfunctional routines or rituals, stereotyped and repetitive motor mannerisms, persistent preoccupation with parts of objects, abnormal functioning in symbolic or imaginative play, or a combination thereof. In some embodiments, the one or more subjects has at least one symptom of a PDD-NOS. In some embodiments, the at least one symptom of a PDD-NOS comprises qualitative impairment in social interaction, marked impairments in the use of multiple nonverbal behaviors to regulate social interaction, failure to develop peer relationships appropriate to developmental level, a lack of spontaneous seeking to share enjoyment or interest or achievements with other people lack of social or emotional reciprocity, restricted repetitive and stereotyped patterns of behavior or interests and activities, encompassing preoccupation with one or more stereotyped and restricted patterns of interest, nonfunctional routines or rituals, stereotyped and repetitive motor mannerisms, persistent preoccupation with parts of objects, clinically significant impairments in social or occupational or other important areas of functioning, deceleration of head growth between ages 5 and 48 months, loss of previously acquired purposeful hand skills between ages 5 and 30 months with the subsequent development of stereotyped hand movements, loss of social engagement early in the, appearance of poorly coordinated gait or trunk movements, severely impaired expressive and receptive language development with severe psychomotor retardation, clinically significant loss of previously acquired skills before age 10 years, impairment in nonverbal behaviors, failure to develop peer relationships, lack of social or emotional reciprocity, qualitative impairments in communication restricted or repetitive or and stereotyped patterns of behavior or interests and activities, or a combination thereof.

In some embodiments, the one or more subjects is human. In some embodiments, the one or more subjects is less than 12 years old, less than 8 years old, less than 6 years old, or less than 3 years.

One aspect of the invention includes a method of screening for a therapeutic agent for treatment of a PDD or a PDD-NOS, comprising identifying an agent that disrupts or modulates one or more genomic sequences of SEQ ID NOs 77 to 209 or one or more expression products thereof.

In some embodiments, the one or more expression products comprise one or more RNA transcripts. In some embodiments, the one or more RNA transcripts comprise one or more RNA transcripts of Table 2. In some embodiments, the one or more expression products comprise one or more polypeptides. In some embodiments, the one or more polypeptides are translated from one or more RNA transcripts of Table 2. In some embodiments, disrupting or modulating the one or more genomic sequences of SEQ ID NOs 77 to 209 or expression products thereof, comprises an increase in expression of the one or more expression products. In some embodiments, disrupting or modulating the one or more genomic sequences of SEQ ID NOs 77 to 209 or expression products thereof, comprises a decrease in expression of the one or more expression products.

An aspect of the invention includes a method of treating a subject for a PDD or a PDD-NOS, comprising administering one or more agents to disrupt or modulate one or more genomic sequences of SEQ ID NOs 77 to 209 or one or more expression products thereof, thereby treating the PDD or the PDD-NOS.

In some embodiments, the one or more expression products comprise one or more RNA transcripts. In some embodiments, the one or more RNA transcripts comprise one or more RNA transcripts of Table 2. In some embodiments, the one or more expression products comprise one or more polypeptides. In some embodiments, the one or more polypeptides are translated from one or more RNA transcripts of Table 2. In some embodiments, the one or more agents are selected from the group comprising: an antibody, a drug, a combination of drugs, a compound, a combination of compounds, radiation, a genetic sequence, a combination of genetic sequences, heat, cryogenics, and a combination of two or more of any combination thereof.

In some embodiments, the PDD is ASD. In some embodiments, the PDD-NOS is Asperger Syndrome, Rett Syndrome or Childhood Disintegrative Disorder. In some embodiments, the one or more subjects has at least one symptom of a PDD. In some embodiments, the PDD is ASD. In some embodiments, the at least one symptom comprises difficulty with verbal communication, difficulty using language, difficulty understanding language, difficulty with non-verbal communication, difficulty with social interaction, unusual ways of playing with toys and other objects, difficulty adjusting to changes in routine or familiar surroundings, repetitive body movements or patterns of behavior, changing response to sound, temper tantrums, difficulty sleeping, aggressive behavior, fearfulness or anxiety, or a combination thereof. In some embodiments, the at least one symptom comprises not babbling, pointing, or making meaningful gestures by 1 year of age, not speaking one word by 16 months of age, not combining two words by 2 years of age, not responding to their name, losing language, losing social skills, qualitative impairment in social interaction, impairments in the use of multiple nonverbal behaviors to regulate social interaction, failure to develop peer relationships appropriate to developmental level, not spontaneously seeking to share enjoyment or interests or achievements with other people, lacking social or emotional reciprocity, qualitative impairments in verbal communication, repetitive and stereotyped patterns of behavior and interests and activities, encompassing preoccupation with one or more stereotyped and restricted patterns of interest that is abnormal either in intensity or focus, apparently inflexible adherence to specific and nonfunctional routines or rituals, stereotyped and repetitive motor mannerisms, persistent preoccupation with parts of objects, abnormal functioning in symbolic or imaginative play, or a combination thereof. In some embodiments, the one or more subjects has at least one symptom of a PDD-NOS. In some embodiments, the at least one symptom of a PDD-NOS comprises qualitative impairment in social interaction, marked impairments in the use of multiple nonverbal behaviors to regulate social interaction, failure to develop peer relationships appropriate to developmental level, a lack of spontaneous seeking to share enjoyment or interest or achievements with other people lack of social or emotional reciprocity, restricted repetitive and stereotyped patterns of behavior or interests and activities, encompassing preoccupation with one or more stereotyped and restricted patterns of interest, nonfunctional routines or rituals, stereotyped and repetitive motor mannerisms, persistent preoccupation with parts of objects, clinically significant impairments in social or occupational or other important areas of functioning, deceleration of head growth between ages 5 and 48 months, loss of previously acquired purposeful hand skills between ages 5 and 30 months with the subsequent development of stereotyped hand movements, loss of social engagement early in the, appearance of poorly coordinated gait or trunk movements, severely impaired expressive and receptive language development with severe psychomotor retardation, clinically significant loss of previously acquired skills before age 10 years, impairment in nonverbal behaviors, failure to develop peer relationships, lack of social or emotional reciprocity, qualitative impairments in communication restricted or repetitive or and stereotyped patterns of behavior or interests and activities, or a combination thereof.

In some embodiments, the one or more subjects is human. In some embodiments, the one or more subjects is less than 12 years old, less than 8 years old, less than 6 years old, or less than 3 years.

An aspect of the invention includes a kit for screening for a PDD or PDD-NOS in one or more subjects, the kit comprising reagents for assaying a genetic sample from the one or more subjects for the presence of at least one genetic variation encoded by SEQ ID NOs 1-76.

In some embodiments, the at least one genetic variation disrupts or modulates one or more genomic sequences of SEQ ID NOs 77 to 209, or one or more expression products thereof. In some embodiments, the one or more expression products comprise one or more RNA transcripts. In some embodiments, the one or more RNA transcripts comprise one or more RNA transcripts of Table 2. In some embodiments, the one or more expression products comprise one or more polypeptides. In some embodiments, the one or more polypeptides are translated from one or more RNA transcripts of Table 2.

In some embodiments, the reagents comprise nucleic acid probes. In some embodiments, the reagents comprise oligonucleotides. In some embodiments, the reagents comprise primers.

In some embodiments, the PDD is ASD. In some embodiments, the PDD-NOS is Asperger Syndrome, Rett Syndrome or Childhood Disintegrative Disorder. In some embodiments, the one or more subjects has at least one symptom of a PDD. In some embodiments, the PDD is ASD. In some embodiments, the one or more subjects has at least one symptom of a PDD-NOS.

In some embodiments, the one or more subjects is human. In some embodiments, the one or more subjects is less than 12 years old, less than 8 years old, less than 6 years old, or less than 3 years.

An aspect of the invention includes an isolated polynucleotide sequence or fragment thereof, comprising at least 60% identity to any of polynucleotide sequence of SEQ ID NOs 1 to 209.

In some embodiments, the isolated polynucleotide sequence comprises at least 70% identity to any of polynucleotide sequence of SEQ ID NOs 1 to 209. In some embodiments, the isolated polynucleotide sequence comprises at least 80% identity to any of polynucleotide sequence of SEQ ID NOs 1 to 209. In some embodiments, the isolated polynucleotide sequence comprises at least 90% identity to any of polynucleotide sequence of SEQ ID NOs 1 to 209.

An aspect of the invention includes an isolated polynucleotide sequence comprising at least 60% identity to a compliment of any of polynucleotide sequence of SEQ ID NOs 1 to 209.

In some embodiments, the isolated polynucleotide sequence comprises at least 70% identity to a compliment of any of polynucleotide sequence of SEQ ID NOs 1 to 209. In some embodiments, the isolated polynucleotide sequence comprises at least 80% identity to a compliment of any of polynucleotide sequence of SEQ ID NOs 1 to 209. In some embodiments, the isolated polynucleotide sequence comprises at least 90% identity to a compliment of any of polynucleotide sequence of SEQ ID NOs 1 to 209. In some embodiments, the isolated polynucleotide sequence comprises the polynucleotide sequence comprises any of a CNV of SEQ ID NOs 1-76. In some embodiments, the isolated polynucleotide sequence comprises comprises any of a genomic sequence of SEQ ID NOs 77 to 209. In some embodiments, the isolated polynucleotide sequence comprises an RNA sequence transcribed from a genomic sequence of SEQ ID NOs 77 to 209. In some embodiments, the isolated polynucleotide sequence comprises any of a genetic variation not present in the human genome.

An aspect of the invention includes an isolated polypeptide encoded by an RNA sequence transcribed from any of genomic sequence of SEQ ID NOs 77 to 209.

An aspect of the invention includes a host cell comprising an expression control sequence operably linked to a polynucleotide selected from the group consisting of any of polynucleotide sequence of SEQ ID Nos 77 to 209, or a fragment thereof.

In some embodiments, the expression control sequence is non-native to the host cell. In some embodiments, the expression control sequence is native to the host cell.

An aspect of the invention includes a method for identifying an agent having a therapeutic benefit for treatment of a PDD or a PDD-NOS, comprising: a) providing cells comprising at least one genetic variation of SEQ ID NOs 1 to 76; b) contacting the cells of step a) with a test agent and c) analyzing whether the agent has a therapeutic benefit for treatment of the PDD or the PDD-NOS of step a), thereby identifying agents which have a therapeutic benefit for treatment of the PDD or the PDD-NOS.

In some embodiments, the method further comprises: d) providing cells which do not comprise at least one genetic variation of SEQ ID NOs 1-76; e) contacting the cells of steps a) and d) with a test agent; and f) analyzing whether the agent has a therapeutic benefit for treatment of the PDD or the PDD-NOS of step a) relative to those of step b), thereby identifying agents which have a therapeutic benefit for treatment of the PDD or the PDD-NOS. In some embodiments, the therapeutic agent has efficacy for the treatment of a PDD or a PDD-NOS.

An aspect of the invention includes a therapeutic agent identified by any of the methods described herein.

An aspect of the invention includes a panel of biomarkers for a PDD or a PDD-NOS comprising one or more genes contained in the one or more polynucleotide sequences selected from SEQ ID NOs 77 to 209.

In some embodiments, the panel comprises two or more genes contained in the one or more polynucleotide sequences selected from SEQ ID NOs 77 to 209. In some embodiments, the panel comprises at least 5, 10, 25, 50, 100 or 200 genes contained in the one or more polynucleotide sequences selected from SEQ ID NOs 77-209. In some embodiments, at least one of the polynucleotide sequences is a fragment of the one-more polynucleotide sequences selected from SEQ ID NOs 77-209. In some embodiments, at least one of the polynucleotide sequences is a variant of the one-more polynucleotide sequences selected from SEQ ID NOs 77-209. In some embodiments, the panel is selected for analysis of polynucleotide expression levels for a PDD-a PDD-NOS. In some embodiments, the polynucleotide expression levels are mRNA expression levels. In some embodiments, the panel is used in the management of patient care for a PDD or a PDD-NOS, wherein the management of patient care includes one or more of risk assessment, early diagnosis, prognosis establishment, patient treatment monitoring, and treatment efficacy detection. In some embodiments, the panel is used in discovery of therapeutic intervention of a PDD or a PDD-NOS.

An aspect of the invention includes a method for measuring expression levels of polynucleotide sequences from biomarkers for a PDD or a PDD-NOS in a subject, comprising: a) selecting a panel of biomarkers comprising two or more genes contained in one or more polynucleotide sequences selected from SEQ ID Nos 77 to 209; b) isolating cellular RNA from a sample obtained from the subject; c) synthesizing cDNA from the cellular RNA for each biomarker in the panel using suitable primers; d) optionally amplifying the cDNA; and e) quantifying levels of the cDNA from the sample.

In some embodiments, the step of selecting a panel of biomarkers comprises at least 5, 10, 25, 50, 100 or 200 genes contained in one or more polynucleotide sequences selected from SEQ ID NOs 77 to 209. In some embodiments, the step of quantifying the levels of cDNA further comprises labeling cDNA. In some embodiments, labeling cDNA comprises labeling with at least one chromophore. In some embodiments, the cDNA levels for the sample are compared to a control cDNA level. In some embodiments, the comparison is used in the management of patient care in PDD or PDD-NOS. In some embodiments, the management of patient care includes one or more of risk assessment, early diagnosis, establishing prognosis, monitoring patient treatment, and detecting treatment efficacy. In some embodiments, the comparison is used in discovery of therapeutic intervention of PDD or PDD-NOS.

An aspect of the invention includes a method for measuring expression levels of polypeptides comprising: a) selecting a panel of biomarkers comprising at least two polypeptides encoded by an RNA sequence transcribed from a genomic sequence of SEQ ID Nos 77 to 209; b) obtaining a biological sample; c) creating an antibody panel for each biomarker in the panel; d) using the antibody panel to bind the polypeptides from the sample; and e) quantifying levels of the polypeptides bound from the sample to the antibody panel.

In some embodiments, the polypeptide levels of the biological sample are increased or decreased compared to the polypeptide levels of a control biological sample. In some embodiments, the subject is treated for a PDD or PDD-NOS patient based on the quantified levels of the polypeptides bound from the sample to the antibody panel. In some embodiments, the treatment of a subject includes one or more of risk assessment, early diagnosis, establishing prognosis, monitoring patient treatment, and detecting treatment efficacy. In some embodiments, the comparison is used in discovery of a therapeutic intervention of a PDD or PDD-NOS.

An aspect of the invention includes a kit for the determination of PDD or PDD-NOS comprising: at least one reagent that is used in analysis of one or more polynucleotide expression levels for a panel of biomarkers for PDD or PDD-NOS, wherein the panel comprises two or more genes contained in one or more polynucleotide sequences selected from SEQ ID NOs 77 to 209, and instructions for using the kit for analyzing the expression levels.

In some embodiments, the one or more polynucleotide expression levels comprise one or more RNA transcript expression levels. In some embodiments, the one or more RNA transcript expression levels correspond to one or more RNA transcripts of Table 2. In some embodiments, the at least one reagent comprises at least two sets of suitable primers. In some embodiments, the at least one reagent comprises a reagent for the preparation of cDNA. In some embodiments, the at least one reagent comprises a reagent that is used for detection and quantization of polynucleotides. In some embodiments, the at least one reagent comprises at least one chromophore.

An aspect of the invention includes a kit for the determination of PDD or PDD-NOS comprising: at least one reagent that is used in analysis of polypeptide expression levels for a panel of biomarkers for PDD or PDD-NOS, wherein the panel comprises at least two polypeptides expressed from two or more genes contained in one or more polynucleotide sequences selected from SEQ ID NOs 77 to 209; and instructions for using the kit for analyzing the expression levels.

In some embodiments, the reagent is an antibody reagent that binds a polypeptide selected in the panel. In some embodiments, the kit further comprises a reagent that is used for detection of a bound polypeptide. In some embodiments, the reagent includes a second antibody.

An aspect of the invention includes a method of screening a subject for a PDD or PDD-NOS, the method comprising: a) assaying a nucleic acid sample obtained from the subject by PCR, array Comparative Polynucleotide Hybridization, sequencing, SNP genotyping, or Fluorescence in Situ Hybridization to detect sequence information for more than one genetic loci; b) comparing the sequence information to a panel of nucleic acid biomarkers, wherein the panel comprises at least one nucleic acid biomarker for each of the more than one genetic loci; and wherein the panel comprises at least 2 low frequency nucleic acid biomarkers, wherein the low frequency nucleic acid biomarkers occur at a frequency of 0.1% or less in a population of subjects without a diagnosis of the PDD or PDD-NOS; and c) screening the subject for the presence or absence of the PDD or the PDD-NOS if one or more of the low frequency biomarkers in the panel are present in the sequence information.

In some embodiments, the panel comprises at least 5, 10, 25, 50, 100 or 200 low frequency nucleic acid biomarkers. In some embodiments, the presence or absence of the PDD or the PDD-NOS in the subject is determined with at least 50% confidence. In some embodiments, the low frequency biomarkers occur at a frequency of 0.01% or less, 0.001% or less, or 0.0001% or less in a population of subjects without a diagnosis of the PDD or the PDD-NOS. In some embodiments, the panel of nucleic acid biomarkers comprises at least two genes contained in the one or more polynucleotide sequences selected from SEQ ID NOs 77 to 209. In some embodiments, the PDD is ASD.

In some embodiments, the PDD-NOS is Asperger Syndrome, Rett Syndrome or Childhood Disintegrative Disorder. In some embodiments, the method further comprises identifying a therapeutic agent useful for treating the PDD or the PDD-NOS. In some embodiments, the method further comprises administering one or more of the therapeutic agents to the subject if one or more of the low frequency biomarkers in the panel are present in the sequence information.

An aspect of the invention includes a kit for screening a subject for a PDD or a PDD-NOS, the kit comprising at least one reagent for assaying a nucleic acid sample from the subject for information on a panel of nucleic acid biomarkers, wherein the panel comprises at least 2 low frequency biomarkers, and wherein the low frequency biomarkers occur at a frequency of 0.1% or less in a population of subjects without a diagnosis of the PDD or the PDD-NOS.

In some embodiments, a presence or absence of the PDD or the PDD-NOS in the subject is determined with a 50% confidence. In some embodiments, the panel comprises at least 5, 10, 25, 50, 100 or 200 low frequency nucleic acid biomarkers. In some embodiments, the low frequency biomarkers occur at a frequency of 0.01% or less, 0.001% or less, or 0.0001% or less in a population of subjects without a diagnosis of the PDD or PDD-NOS. In some embodiments, the panel of nucleic acid biomarkers comprises at least two genes contained in the one or more polynucleotide sequences selected from SEQ ID NOs 77 to 209. In some embodiments, the at least one reagent comprises at least two sets of suitable primers. In some embodiments, the at least one reagent comprises a reagent for the preparation of cDNA. In some embodiments, the at least one reagent comprises a reagent that is used for detection and quantization of polynucleotides. In some embodiments, the at least one reagent comprises at least one chromophore.

An aspect of the invention includes a method of generating a panel of nucleic acid biomarkers comprising: a) assaying a nucleic acid sample from a first population of subjects by PCR, array Comparative Polynucleotide Hybridization, sequencing, SNP genotyping, or Fluorescence in Situ Hybridization for nucleic acid sequence information, wherein the subjects of the first population have a diagnosis of a PDD or a PDD-NOS. b) assaying a nucleic acid sample from a second population of subjects by PCR, array Comparative Polynucleotide Hybridization, sequencing, SNP genotyping, or Fluorescence in Situ Hybridization for nucleic acid sequence information, wherein the subjects of the second population are without a diagnosis of a PDD or a PDD-NOS; c) comparing the nucleic acid sequence information from step (a) to that of step (b); d) determining the frequency of one or more biomarkers from the comparing step; and e) generating the panel of a nucleic acid biomarkers, wherein the panel comprises at least 2 low frequency biomarkers, and wherein the low frequency biomarkers occur at a frequency of 0.1% or less in a population of subjects without a diagnosis of a PDD or a PDD-NOS.

In some embodiments, the subjects in the second population of subjects without a diagnosis of a PDD or a PDD-NOS comprise one or more subjects not suspected of having the PDD or the PDD-NOS. In some embodiments, the subjects in the second population of subjects without a diagnosis of a PDD or a PDD-NOS comprise one or more subjects without the PDD or the PDD-NOS. In some embodiments, the subjects in the second population of subjects without a diagnosis of a PDD or a PDD-NOS comprise one or more subjects who are asymptomatic for the PDD or the PDD-NOS. In some embodiments, the subjects in the second population of subjects without a diagnosis of a PDD or a PDD-NOS comprise one or more subjects who have decreased susceptibility to the PDD or the PDD—In some embodiments, the subjects in the second population of subjects without a diagnosis of a PDD or a PDD-NOS comprise one or more subjects who are unassociated with a treatment, therapeutic regimen, or any combination thereof. In some embodiments, the panel comprises at least 5, 10, 25, 50, 100 or 200 low frequency nucleic acid biomarkers. In some embodiments, the low frequency biomarkers occur at a frequency of 0.01% or less, 0.001% or less, or 0.0001% or less in the second population of subjects without a diagnosis of a PDD or a PDD-NOS. In some embodiments, the panel of nucleic acid biomarkers comprises at least two genes contained in the one or more polynucleotide sequences selected from SEQ ID NOs 77 to 209.

An aspect of the invention includes an array comprising a plurality of nucleic acid probes, wherein each probe comprises a sequence complimentary to a target sequence of one of the polynucleotide sequences selected from SEQ ID NOs 77 to 209, or a fragment thereof.

In some embodiments, the plurality of nucleic acid probes comprises at least 5, 10, 25, 50, 100 or 200 of the nucleic acid probes. In some embodiments, the array further comprises a second plurality of nucleic acid probes, wherein each probe in the second plurality of nucleic acid probes comprises a sequence complimentary to a complimentary target sequence of one of the polynucleotide sequences selected from SEQ ID NOs 1-76, or a fragment thereof. In some embodiments, second plurality of nucleic acid probes comprises at least 5, 10, 25, 50, 100 or 200 nucleic acid probes. In some embodiments, each different nucleic acid probe is attached to a bead. In some embodiments, each different nucleic acid probe is labeled with a detectable label. In some embodiments, each different nucleic acid probe is attached to a solid support in a determinable location of the array. In some embodiments, the solid support comprises plastics, glass, beads, microparticles, microtitre dishes, or gels. In some embodiments, the array further comprises control probes.

INCORPORATION BY REFERENCE

All publications, patents, and patent applications mentioned in this specification are herein incorporated by reference to the same extent as if each individual publication, patent, or patent application was specifically and individually indicated to be incorporated by reference. In the event of a conflict between a term herein and a term incorporated by reference, the term herein controls.

BRIEF DESCRIPTION OF THE DRAWINGS

The novel features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings.

DETAILED DESCRIPTION OF THE INVENTION

Figure 1:
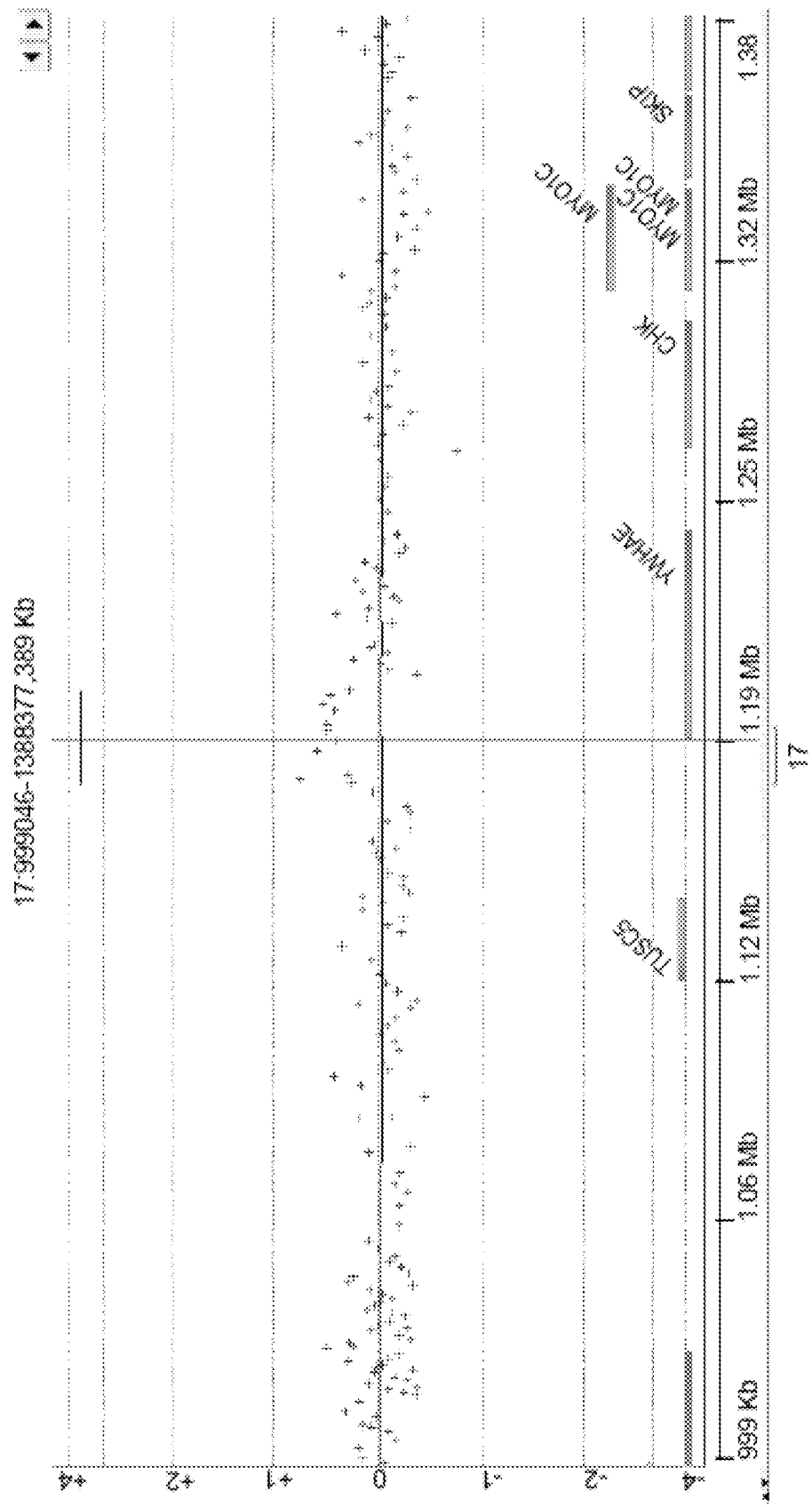
FIG. 1 is an example of a log2ratio plot using an algorithm (DNA Analytics) to call and classify CNVs.

The details of one or more inventive embodiments are set forth in the accompanying drawings, the claims, and in the description herein. Other features, objects, and advantages of inventive embodiments disclosed and contemplated herein will be apparent from the description and drawings, and from the claims. As used herein, unless otherwise indicated, the article "a" means one or more unless explicitly otherwise provided for. As used herein, unless otherwise indicated, terms such as "contain," "containing," "include," "including," and the like mean "comprising." As used herein, unless otherwise indicated, the term "or" can be conjunctive or disjunctive. As used herein, unless otherwise indicated, any embodiment can be combined with any other embodiment. As used herein, unless otherwise indicated, some inventive embodiments herein contemplate numerical ranges. When ranges are present, the ranges include the range endpoints. Additionally, every subrange and value within the range is present as if explicitly written out.

Described herein are methods of identifying variations in nucleic acids and genes associated with one or more developmental conditions. Described herein are methods of screening for determining a subject's susceptibility to developing or having, one or more developmental disorders, for example, ASD, based on identification and detection of genetic nucleic acid variations. Also described herein, are methods and compositions for treating and/or preventing one or more developmental conditions using a therapeutic modality. The present disclosure encompasses methods of assessing an individual for probability of response to a therapeutic agent for a developmental disorder, methods for predicting the effectiveness of a therapeutic agent for a developmental disorder, nucleic acids, polypeptides and antibodies and computer-implemented functions. Kits for screening a sample from a subject to detect or determine susceptibility to a developmental disorder are also encompassed by the disclosure.

Genetic Variations Associated with Developmental Disorders

Genomic sequences within populations exhibit variability between individuals at many locations in the genome. For example, the human genome exhibits sequence variations that occur on average every 500 base pairs. Such genetic variations in nucleic acid sequences are commonly referred to as polymorphisms or polymorphic sites. In some embodiments, these genetic variations can be found to be associated with one or more disorders and/or diseases using the methods disclosed herein. In some embodiments the one or more disorders and/or diseases comprise one or more developmental disorders. In some embodiments the one or more developmental disorders comprise one or more Pervasive Developmental Disorders (PDD). In some embodiments, the one or more PDDs comprise ASD. ASD can refer to autism. In another embodiment, the one or more developmental disorders comprise Pervasive Developmental Disorder—Not Otherwise Specified (PDD-NOS). In some embodiments, PDD-NOS can comprise Asperger Syndrome, Rett Syndrome, fragile X syndrome and/or Childhood Disintegrative Disorder. In some embodiments genetic variations can be associated with one or more PDDs. In some embodiments genetic variations can be associated with one or more PDD-NOSs.

Scientific evidence suggests there is a potential for various combinations of factors causing ASD, such as multiple genetic variations that may cause autism on their own or when combined with exposure to as yet undetermined environmental factors Timing of exposure during the child's development, such as before, during, or after birth, may also play a role in the development or final presentation of the disorder. A small number of cases can be linked to genetic disorders such as Fragile X, Tuberous Sclerosis, and Angelman's Syndrome, as well as exposure to environmental agents such as infectious ones (maternal rubella or cytomegalovirus) or chemical ones (thalidomide or valproate) during pregnancy.

In some embodiments, these genetic variations comprise point mutations, polymorphisms, translocations, insertions, deletions, amplifications, inversions, interstitial deletions, copy number variations (CNVs), loss of heterozygosity, or any combination thereof. In some embodiments polymorphisms (e.g. polymorphic markers), can comprise any nucleotide position at which two or more sequences are possible in a subject population. In some embodiments, each version of a nucleotide sequence with respect to the polymorphism can represent a specific allele, of the polymorphism. In some embodiments, genomic DNA from a subject can contain two alleles for any given polymorphic marker, representative of each copy of the marker on each chromosome. In some embodiments, an allele can be a nucleotide sequence of a given location on a chromosome. Polymorphisms can comprise any number of specific alleles. In some embodiments of the disclosure, a polymorphism can be characterized by the presence of two or more alleles in a population. In some embodiments, the polymorphism can be characterized by the presence of three or more alleles. In some embodiments, the polymorphism can be characterized by four or more alleles, five or more alleles, six or more alleles, seven or more alleles, nine or more alleles, or ten or more alleles. In some embodiments an allele can be associated with one or more diseases or disorders, for example, a developmental disorder risk allele can be an allele that is associated with increased or decreased risk of developing a developmental disorder. In some embodiments, genetic variations and alleles can be used to associate an inherited phenotype, for example, a developmental disorder, with a responsible genotype. In some embodiments, a developmental disorder risk allele can be a variant allele that is statistically associated with a screening of one or more developmental disorders. In some embodiments, genetic variations can be of any measurable frequency in the population, for example, a frequency higher than 10%, a frequency between 5-10%, a frequency between 1-5%, or frequency below 1%. As used herein, variant alleles can be alleles that differ from a reference allele. As used herein, a variant can be a segment of DNA that differs from the reference DNA, such as a genetic variation. In some embodiments, genetic variations can be used to track the inheritance of a gene that has not yet been identified, but whose approximate location is known.

As used herein, a haplotype can be information regarding the presence or absence of one or more genetic markers in a given chromosomal region in a subject. In some embodiments, a haplotype can be a segment of DNA characterized by one or more alleles arranged along the segment, for example, a haplotype can comprise one member of the pair of alleles for each genetic variation or locus. In some embodiments, the haplotype can comprise two or more alleles, three or more alleles, four or more alleles, five or more alleles, or any combination thereof, wherein, each allele can comprise one or more genetic variations along the segment.

In some embodiments, a genetic variation can be a functional aberration that can alter gene function, gene expression, protein expression, protein function, or any combination thereof. In some embodiments, a genetic variation can be a loss-of-function mutation, gain-of-function mutation, dominant negative mutation, or reversion. In some embodiments, a genetic variation can be part of a gene's coding region or regulatory region. Regulatory regions can control gene expression and thus protein expression. In some embodiments, a regulatory region can be a segment of DNA wherein regulatory proteins, for example, transcription factors, can bind. In some embodiments a regulatory region can be positioned near the gene being regulated, for example, positions upstream of the gene being regulated.

In some embodiments, variants can include changes that affect a polypeptide, such as a change in expression level, sequence, function, localization, binding partners, or any combination thereof. In some embodiments, a genetic variation can be a frameshift mutation, nonsense mutation, missense mutation, neutral mutation, or silent mutation. For example, sequence differences, when compared to a reference nucleotide sequence, can include the insertion or deletion of a single nucleotide, or of more than one nucleotide, resulting in a frame shift; the change of at least one nucleotide, resulting in a change in the encoded amino acid; the change of at least one nucleotide, resulting in the generation of a premature stop codon; the deletion of several nucleotides, resulting in a deletion of one or more amino acids encoded by the nucleotides; the insertion of one or several nucleotides, such as by unequal recombination or gene conversion, resulting in an interruption of the coding sequence of a reading frame; duplication of all or a part of a sequence; transposition; or a rearrangement of a nucleotide sequence. Such sequence changes can alter the polypeptide encoded by the nucleic acid, for example, if the change in the nucleic acid sequence causes a frame shift, the frame shift can result in a change in the encoded amino acids, and/or can result in the generation of a premature stop codon, causing generation of a truncated polypeptide. In some embodiments, a genetic variation associated with a developmental disorder can be a synonymous change in one or more nucleotides, for example, a change that does not result in a change in the amino acid sequence. Such a polymorphism can, for example, alter splice sites, affect the stability or transport of mRNA, or otherwise affect the transcription or translation of an encoded polypeptide. In some embodiments, a synonymous mutation can result in the protein product having an altered structure due to rare codon usage that impacts protein folding during translation, which in some cases may alter its function and/or drug binding properties if it is a drug target. In some embodiments, the changes that can alter DNA to increase the possibility that structural changes, such as amplifications or deletions, occur at the somatic level. A polypeptide encoded by the reference nucleotide sequence can be a reference polypeptide with a particular reference amino acid sequence, and polypeptides encoded by variant nucleotide sequences can be variant polypeptides with variant amino acid sequences.

In some embodiments, one or more variant polypeptides or proteins can be associated with one or more diseases or disorders, such as ASD. In some embodiments, variant polypeptides and changes in expression, localization, and interaction partners thereof, can be used to associate an inherited phenotype, for example, a developmental disorder, with a responsible genotype. In some embodiments, a developmental disorder associated variant polypeptide can be statistically associated with a diagnosis, prognosis, or theranosis of one or more developmental disorders.

The most common sequence variants comprise base variations at a single base position in the genome, and such sequence variants, or polymorphisms, are commonly called single nucleotide polymorphisms (SNPs) or single nucleotide variants (SNVs). In some embodiments, a SNP represents a genetic variant present at greater than or equal to 1% occurrence in a population and in some embodiments a SNP can represent a genetic variant present at any frequency level in a population. A SNP can be a nucleotide sequence variation occurring when a single nucleotide at a location in the genome differs between members of a species or between paired chromosomes in a subject. SNPs can include variants of a single nucleotide, for example, at a given nucleotide position, some subjects can have a 'G', while others can have a 'C'. SNPs can occur in a single mutational event, and therefore there can be two possible alleles possible at each SNP site; the original allele and the mutated allele. SNPs that are found to have two different bases in a single nucleotide position are referred to as biallelic SNPs, those with three are referred to as triallelic, and those with all four bases represented in the population are quadallelic. In some embodiments, SNPs can be considered neutral. In some embodiments SNPs can affect susceptibility to developmental disorders. SNP polymorphisms can have two alleles, for example, a subject can be homozygous for one allele of the polymorphism wherein both chromosomal copies of the individual have the same nucleotide at the SNP location, or a subject can be heterozygous wherein the two sister chromosomes of the subject contain different nucleotides. The SNP nomenclature as reported herein is the official Reference SNP (rs) ID identification tag as assigned to each unique SNP by the National Center for Biotechnological Information (NCBI).

Another genetic variation of the disclosure can be copy number variations (CNVs). CNVs can be alterations of the DNA of a genome that results an abnormal number of copies of one or more sections of DNA. CNVs can be inherited or caused by de novo mutation and can be responsible for a substantial amount of human phenotypic variability, behavioral traits, and disease susceptibility. In a preferred embodiment, CNVs of the current disclosure can be associated with susceptibility to one or more developmental disorders, for example, ASD. In some embodiments, CNVs can be a single gene or include a contiguous set of genes. In some embodiments, CNVs can be caused by structural rearrangements of the genome, for example, translocations, insertions, deletions, amplifications, inversions and interstitial deletions. In some embodiments, these structural rearrangements occur on one or more chromosomes. Low copy repeats (LCRs), which are region-specific repeat sequences, can be susceptible to these structural rearrangements, resulting in CNVs. Factors such as size, orientation, percentage similarity and the distance between the copies can influence the susceptibility of LCRs to genomic rearrangement. In some embodiments, CNVs are referred to as structural variants. In some embodiments, structural variants can be a broader class of variant that can also includes copy number neutral alterations such as inversions and balanced translocations.

CNVs can account for genetic variation affecting a substantial proportion of the human genome, for example, known CNVs can cover over 15% of the human genome sequence (Estivill, X Armengol; L., PLoS Genetics 3: 1787-99 (2007)). CNVs can affect gene expression, phenotypic variation and adaptation by disrupting gene dosage, and can cause disease, for example, microdeletion and microduplication disorders, and can confer susceptibility to diseases and disorders. Updated information about the location, type, and size of known CNVs can be found in one or more databases, for example, the Database of Genomic Variants (http://projects.tcag.ca/variation/), which currently contains data for over 66,000 CNVs (as of Nov. 2, 2010).

Other types of sequence variants can be found in the human genome and can be associated with a disease or disorder, including but not limited to, microsatellites. Microsatellite markers are stable, polymorphic, easily analyzed, and can occur regularly throughout the genome, making them especially suitable for genetic analysis. A polymorphic microsatellite can comprise multiple small repeats of bases, for example, CA repeats, at a particular site wherein the number of repeat lengths varies in a population. In some embodiments, microsatellites, for example, variable number of tandem repeats (VNTRs), can be short segments of DNA that have one or more repeated sequences, for example, about 2 to 5 nucleotides long, that can occur in non-coding DNA. In some embodiments, changes in microsatellites can occur during genetic recombination of sexual reproduction, increasing or decreasing the number of repeats found at an allele, or changing allele length.

Developmental Disorders

Developmental disorders are disorders that occur at some stage in a child's development, often retarding the development, including psychological or physical disorders. In some embodiments, they can be distinguished into specific developmental disorders including Pervasive Developmental Disorders (PDDs) and Pervasive Developmental Disorder—Not Otherwise Specified (PDD-NOS). A PDD can comprise ASD. Generally, symptoms that may be present to some degree in a subject of the present disclosure with a PDD can include difficulty with verbal communication, including problems using and understanding language, difficulty with non-verbal communication, such as gestures and facial expressions such as smiling, difficulty with social interaction, including relating to people and to his or her surroundings, unusual ways of playing with toys and other objects, difficulty adjusting to changes in routine or familiar surroundings, repetitive body movements or patterns of behavior, such as hand flapping, spinning, and head banging, changing response to sound, temper tantrums, difficulty sleeping, aggressive behavior, and/or fearfulness or anxiety. ASD can be defined by a certain set of behaviors that can range from the very mild to the severe. Possible indicators of ASDs include a subject whom does not babble, point, or make meaningful gestures by 1 year of age; does not speak one word by 16 months, does not combine two words by 2 years, does not respond to their name, and/or loses language or social skills. Other symptoms include qualitative impairment in social interaction, as manifested by marked impairments in the use of multiple nonverbal behaviors such as eye-to-eye gaze, facial expression, body posture, and gestures to regulate social interaction, failure to develop peer relationships appropriate to developmental level, a lack of spontaneous seeking to share enjoyment, interests, or achievements with other people, (e.g., by a lack of showing, bringing, or pointing out objects of interest to other people), or lack of social or emotional reciprocity (note: in the description, it gives the following as examples: not actively participating in simple social play or games, preferring solitary activities, or involving others in activities only as tools or "mechanical" aids). Symptoms of Autism can also include qualitative impairments in communication as manifested by delay in, or total lack of, the development of spoken language (not accompanied by an attempt to compensate through alternative modes of communication such as gesture or mime), in individuals with adequate speech, marked impairment in the ability to initiate or sustain a conversation with others, stereotyped and repetitive use of language or idiosyncratic language, or lack of varied, spontaneous make-believe play or social imitative play appropriate to developmental level. Other symptoms of Autism include restricted repetitive and stereotyped patterns of behavior, interests and activities, as manifested by encompassing preoccupation with one or more stereotyped and restricted patterns of interest that is abnormal either in intensity or focus, apparently inflexible adherence to specific, nonfunctional routines or rituals, stereotyped and repetitive motor mannerisms (e.g hand or finger flapping or twisting, or complex whole-body movements), or persistent preoccupation with parts of objects. Other symptoms of Autism include delays or abnormal functioning in at areas, with onset prior to age 3 years including social interaction, language as used in social communication and symbolic or imaginative play As described herein, Pervasive Developmental Disorders—Not Otherwise Specified (PDD-NOS) can comprise Asperger Syndrome, Rett Syndrome, fragile X syndrome, and/or Childhood Disintegrative Disorder. In some embodiments a screening of PDD-NOS can be a screening of being on the autism spectrum, but not falling within any of the existing specific categories of autism. PDD-NOS is a pervasive developmental disorder (PDD)/autism spectrum disorder (ASD) and is often referred to as atypical autism.

Symptoms of Asperger Sydrome can include qualitative impairment in social interaction, marked impairments in the use of multiple nonverbal behaviors such as eye-to-eye gaze, facial expression, body posture, and gestures to regulate social interaction, failure to develop peer relationships appropriate to developmental level a lack of spontaneous seeking to share enjoyment, interest or achievements with other people, (e.g. by a lack of showing, bringing, or pointing out objects of interest to other people) and lack of social or emotional reciprocity. Other symptoms can include restricted repetitive & stereotyped patterns of behavior, interests and activities, encompassing preoccupation with one or more stereotyped and restricted patterns of interest that is abnormal either in intensity or focus apparently inflexible adherence to specific, nonfunctional routines or rituals stereotyped and repetitive motor mannerisms (e.g. hand or finger flapping or twisting, or complex whole-body movements) and persistent preoccupation with parts of objects and clinically significant impairments in social, occupational, or other important areas of functioning. There may be no clinically significant general delay in language (for example, single words used by age 2 years, communicative phrases used by age 3 years). There may be no clinically significant delay in cognitive development or in the development of age-appropriate self help skills, adaptive behavior (other than in social interaction) and curiosity about the environment in childhood.

Although apparently normal prenatal and perinatal development, apparently normal psychomotor development through the first 5 months after birth, normal head circumference at birth are observed, symptoms of Rett Syndrome begin after the period of normal development and include deceleration of head growth between ages 5 and 48 months, loss of previously acquired purposeful hand skills between ages 5 and 30 months with the subsequent development of stereotyped hand movements (i.e., hand-wringing or hand washing), loss of social engagement early in the course (although often social interaction develops later), appearance of poorly coordinated gait or trunk movements, and severely impaired expressive and receptive language development with severe psychomotor retardation.

Although apparently normal development occurs for at least the first 2 years after birth, Childhood Disintegrative Disorder symptoms manifest by the presence of age-appropriate verbal and nonverbal communication, social relationships, play, and adaptive behavior. Symptoms include clinically significant loss of previously acquired skills (before age 10 years) including expressive or receptive language, social skills or adaptive behavior, bowel or bladder control, play, and motor skills. Oher symtoms include abnormalities of functioning in areas including qualitative impairment in social interaction (e.g., impairment in nonverbal behaviors, failure to develop peer relationships, lack of social or emotional reciprocity), qualitative impairments in communication (e.g., delay or lack of spoken language, inability to initiate or sustain a conversation, stereotyped and repetitive use of language, lack of varied make-believe play), and restricted, repetitive, and stereotyped patterns of behavior, interests, and activities, including motor stereotypies and mannerisms.

Subjects

A subject, as used herein, can be an individual of any age or sex from whom a sample containing nucleotides is obtained for analysis by one or more methods described herein so as to obtain genetic data, for example, a male or female adult, child, newborn, or fetus. In some embodiments, a subject can be any target of therapeutic administration. In some embodiments, a subject can be a test subject or a reference subject. In some embodiments, a subject can be associated with a condition or disease or disorder, asymptomatic or symptomatic, have increased or decreased susceptibility to a disease or disorder, be associated or unassociated with a treatment or treatment regimen, or any combination thereof. As used in the present disclosure a cohort can represent an ethnic group, a patient group, a particular age group, a group not associated with a particular disease or disorder, a group associated with a particular disease or disorder, a group of asymptomatic subjects, a group of symptomatic subjects, or a group or subgroup of subjects associated with a particular response to a treatment regimen or clinical trial. In some embodiments, a patient can be a subject afflicted with a disease or disorder. In some embodiments, a patient can be a subject not afflicted with a disease or disorder. In some embodiments, a subject can be a test subject, a patient or a candidate for a therapeutic, wherein genomic DNA from said subject, patient, or candidate is obtained for analysis by one or more methods of the present disclosure herein, so as to obtain genetic variation information of said subject, patient or candidate.

In some embodiments, the sample can be obtained prenatally from a fetus or embryo or from the mother, for example, from fetal or embryonic cells in the maternal circulation. In some embodiments, the sample can be obtained with the assistance of a health care provider, for example, to draw blood. In some embodiments, the sample can be obtained without the assistance of a health care provider, for example, where the sample is obtained non-invasively, such as a sample comprising buccal cells that is obtained using a buccal swab or brush, or a mouthwash sample.

The present disclosure also provides methods for assessing genetic variations in subjects who are members of a target population. Such a target population is in some embodiments a population or group of subjects at risk of developing the disease, based on, for example, other genetic factors, biomarkers, biophysical parameters, family history of a developmental disorder, previous screening or medical history, or any combination thereof.

Although ASD is known to affect children to a higher extent than adults, subjects of all ages are contemplated in the present disclosure. In some embodiments subjects can be from specific age subgroups, such as those over the age of 1, over the age of 2, over the age of 3, over the age of 4, over the age of 5, over the age of 6, over the age of 7, over the age of 8, over the age of 9, over the age of 10, over the age of 15, over the age of 20, over the age of 25, over the age of 30, over the age of 35, over the age of 40, over the age of 45, over the age of 50, over the age of 55, over the age of 60, over the age of 65, over the age of 70, over the age of 75, over the age of 80, or over the age of 85. Other embodiments of the disclosure pertain to other age groups, such as subjects aged less than 85, such as less than age 80, less than age 75, less than age 70, less than age 65, less than age 60, less than age 55, less than age 50, less than age 45, less than age 40, less than age 35, less than age 30, less than age 25, less than age 20, less than age 15, less than age 10, less than age 9, less than age 8, less than age 6, less than age 5, less than age 4, less than age 3, less than age 2, or less than age 1. Other embodiments relate to subjects with age at onset of the disease in any of particular age or age ranges defined by the numerical values described in the above or other numerical values bridging these numbers. It is also contemplated that a range of ages can be relevant in certain embodiments, such as age at onset at more than age 15 but less than age 20. Other age ranges are however also contemplated, including all age ranges bracketed by the age values listed in the above.

The genetic variations of the present disclosure found to be associated with a developmental disorder can show similar association in other human populations. Particular embodiments comprising subject human populations are thus also contemplated and within the scope of the disclosure. Such embodiments relate to human subjects that are from one or more human populations including, but not limited to, Caucasian, European, American, Eurasian, Asian, Central/South Asian, East Asian, Middle Eastern, African, Hispanic, and Oceanic populations. European populations include, but are not limited to, Swedish, Norwegian, Finnish, Russian, Danish, Icelandic, Irish, Kelt, English, Scottish, Dutch, Belgian, French, German, Spanish, Portuguese, Italian, Polish, Bulgarian, Slavic, Serbian, Bosnian, Czech, Greek and Turkish populations. The racial contribution in subject subjects can also be determined by genetic analysis, for example, genetic analysis of ancestry can be carried out using unlinked microsatellite markers such as those set out in Smith et al. (Am J Hum Genet. 74, 1001-13 (2004))

It is also well known to the person skilled in the art that certain genetic variations have different population frequencies in different populations, or are polymorphic in one population but not in another. A person skilled in the art can however apply the methods available and as thought herein to practice the present disclosure in any given human population. This can include assessment of genetic variations of the present disclosure, so as to identify those markers that give strongest association within the specific population. Thus, the at-risk variants of the present disclosure can reside on different haplotype background and in different frequencies in various human populations.

Samples

Samples that are suitable for use in the methods described herein can be from a subject and can contain genetic or proteinaceous material, for example, genomic DNA (gDNA). Genetic material can be extracted from one or more biological samples including but not limited to, blood, saliva, urine, mucosal scrapings of the lining of the mouth, expectorant, serum, tears, skin, tissue, or hair.

In some embodiments, the sample can comprise cells or tissue, for example, cell lines. Exemplary cell types from which genetic material can be obtained using the methods described herein and include but are not limited to, a blood cell; such as a B lymphocyte, T lymphocyte, leukocyte, erythrocyte, macrophage, or neutrophil; a muscle cell such as a skeletal cell, smooth muscle cell or cardiac muscle cell; a germ cell, such as a sperm or egg; an epithelial cell; a connective tissue cell, such as an adipocyte, chondrocyte; fibroblast or osteoblast; a neuron; an astrocyte; a stromal cell; an organ specific cell, such as a kidney cell, pancreatic cell, liver cell, or a keratinocyte; a stem cell; or any cell that develops there from. A cell from which gDNA is obtained can be at a particular developmental level including, for example, a hematopoietic stem cell or a cell that arises from a hematopoietic stem cell such as a red blood cell, B lymphocyte, T lymphocyte, natural killer cell, neutrophil, basophil, eosinophil, monocyte, macrophage, or platelet. Generally any type of stem cell can be used including, without limitation, an embryonic stem cell, adult stem cell, or pluripotent stem cell.

In some embodiments, a sample can be processed for DNA isolation, for example, DNA in a cell or tissue sample can be separated from other components of the sample. Cells can be harvested from a biological sample using standard techniques known in the art, for example, by centrifuging a cell sample and resuspending the pelleted cells, for example, in a buffered solution, for example, phosphate-buffered saline (PBS). In some embodiments, after centrifuging the cell suspension to obtain a cell pellet, the cells can be lysed to extract DNA. In some embodiments, the sample can be concentrated and/or purified to isolate DNA. All samples obtained from a subject, including those subjected to any sort of further processing, are considered to be obtained from the subject. In some embodiments, standard techniques and kits known in the art can be used to extract genomic DNA from a biological sample, including, for example, phenol extraction, a QIAamp® Tissue Kit (Qiagen, Chatsworth, Calif.), a Wizard® Genomic DNA purification kit (Promega), or a Qiagen Autopure method using Puregene chemistry, which can enable purification of highly stable DNA well-suited for archiving.

In some embodiments, determining the identity of an allele or determining copy number can, but need not, include obtaining a sample comprising DNA from a subject, and/or assessing the identity, copy number, presence or absence of one or more genetic variations and their chromosomal locations in the sample. The individual or organization that performs the determination need not actually carry out the physical analysis of a sample from a subject. In some embodiments, the methods can include using information obtained by analysis of the sample by a third party. In some embodiments, the methods can include steps that occur at more than one site. For example, a sample can be obtained from a subject at a first site, such as at a health care provider or at the subject's home in the case of a self-testing kit. The sample can be analyzed at the same or a second site, for example, at a laboratory or other testing facility.

Methods of Screening

As used herein, screening a subject comprises diagnosing or determining, theranosing, or determining the susceptibility to developing (prognosing) a developmental disorder, for example, ASD. In particular embodiments, the disclosure is a method of determining a presence of, or a susceptibility to, a developmental disorder, by detecting at least one genetic variation in a sample from a subject as described herein. In some embodiments, detection of particular alleles, markers, variations, or haplotypes is indicative of a presence or susceptibility to a developmental disorder. Although there can be many concerns about screening a subject with an ASD, the earlier the screening of ASD is made, the earlier needed interventions can begin. Evidence over the last 15 years indicates that intensive early intervention in optimal educational settings for at least 2 years during the preschool years results in improved outcomes in most young children with ASD. In evaluating a child, clinicians rely on behavioral characteristics to make a diagnosis, prognosis, or theranosis. Some of the characteristic behaviors of ASD may be apparent in the first few months of a child's life, or they may appear at any time during the early years. For the screening problems in at least one of the areas of communication, socialization, or restricted behavior must be present before the age of 3. The screening requires a two-stage process. The first stage involves developmental screening during "well-child" check-ups; the second stage entails a comprehensive evaluation by a multidisciplinary team. A "well child" check-up should include a developmental screening test. Several screening instruments have been developed to quickly gather information about a child's social and communicative development within medical settings. Among them are the Checklist of Autism in Toddlers (CHAT), the modified Checklist for Autism in Toddlers (M-CHAT), the Screening Tool for Autism in Two-Year-Olds (STAT), and the Social Communication Questionnaire (SCQ) for children 4 years of age and older. Some screening instruments rely solely on parent responses to a questionnaire, and some rely on a combination of parent report and observation. Key items on these instruments that appear to differentiate children with autism from other groups before the age of 2 include pointing and pretend play. Screening instruments do not provide individual diagnosis, prognosis, or theranosis, but serve to assess the need for referral for possible screening of ASD. These screening methods may not identify children with mild ASD, such as those with high-functioning autism or Asperger syndrome. The second stage of screening must be comprehensive in order to accurately rule in or rule out an ASD or other developmental problem. This evaluation may be done by a multidisciplinary team that includes a psychologist, a neurologist, a psychiatrist, a speech therapist, or other professionals who screen children with ASD. Because ASDs are complex disorders and may involve other developmental or genetic problems, a comprehensive evaluation should entail developmental and genetic assessment, along with in-depth cognitive and language testing. In addition, measures developed specifically for screening autism are often used. These include the Autism Diagnosis Interview-Revised (ADI-R) and the Autism Diagnostic Observation Schedule (ADOS-G). The ADI-R is a structured interview that contains over 100 items and is conducted with a caregiver. It consists of four main factors including the child's communication, social interaction, repetitive behaviors, and age-of-onset symptoms. The ADOS-G is an observational measure used to "press" for socio-communicative behaviors that are often delayed, abnormal, or absent in children with ASD. Still another instrument often used by professionals is the Childhood Autism Rating Scale (CARS). It can aid in evaluating the child's body movements, adaptation to change, listening response, verbal communication, and relationship to people. It is suitable for use with children over 2 years of age. The examiner observes the child and also obtains relevant information from the parents. The child's behavior is rated on a scale based on deviation from the typical behavior of children of the same age. Two other tests that can be used to assess any child with a developmental delay are a formal audiologic hearing evaluation and a lead screening. Although some hearing loss can co-occur with ASD, some children with ASD may be incorrectly thought to have such a loss. In addition, if the child has suffered from an ear infection, transient hearing loss can occur. Lead screening is essential for children who remain for a long period of time in the oral-motor stage in which they put any and everything into their mouths. Children with an autistic disorder usually have elevated blood lead levels. Customarily, an expert screening team has the responsibility of thoroughly evaluating the child, assessing the child's unique strengths and weaknesses, and determining a formal screen. The team will then meet with the parents to explain the results of the evaluation.

PDD-NOS is typically screened by psychologists and Pediatric Neurologists. No singular specific test can be administered to determine whether or not a child is on the spectrum. Screening can be made through observations, questionnaires, and tests. A parent will usually initiate the quest into the screening with questions for their child's pediatrician about their child's development after noticing abnormalities. From there, doctors will ask questions to gauge the child's development in comparison to age-appropriate milestones. One test that measures this is the Modified Checklist of Autism in Toddlers (MCHAT). This is a list of questions whose answers will determine whether or not the child should be referred to a specialist such as a developmental pediatrician, a neurologist, a psychiatrist, or a psychologist. Another checklist, the DSM-IV is a series of characteristics and criteria to qualify for an autism diagnosis. Because PDD-NOS is a spectrum disorder, not every child shows the same signs. The two main characteristics of the disorder are difficulties with social interaction skills and communication. Signs are often visible in babies but a diagnosis is usually not made until around age 4. Even though PDD-NOS is considered milder than typical autism, this is not always true. While some characteristics may be milder, others may be more severe. Once a child with PDD-NOS enters school, he or she will often be very eager to interact with classmates, but may act socially different to peers and be unable to make genuine connections. As they age, the closest connections they make are typically with their parents. Children with PDD-NOS have difficulty reading facial expressions and relating to feelings of others. They may not know how to respond when someone is laughing or crying. Literal thinking is also characteristic of PDD-NOS. They will most likely have difficulty understanding figurative speech and sarcasm. Inhibited communication skills are a sign of PDD-NOS that begins immediately after birth. As an infant, they will not babble, and as they age, they do not speak when age appropriate. Once verbal communication begins, their vocabulary is often limited. Some characteristics of language-based patterns are: repetitive or rigid language, narrow interests, uneven language development, and poor nonverbal communication. A very common characteristic of PDD-NOS is severe difficulty grasping the difference between pronouns, particularly between "you" and "me" when conversing. During the last few years, screening instruments have been devised to screen for Asperger syndrome and higher functioning autism. The Autism Spectrum Screening Questionnaire (ASSQ), the Australian Scale for Asperger's Syndrome, and the most recent, the Childhood Asperger Syndrome Test (CAST), are some of the instruments that are reliable for identification of school-age children with Asperger syndrome or higher functioning autism. These tools concentrate on social and behavioral impairments in children without significant language delay. If, following the screening process or during a routine "well child" check-up, a subject's doctor sees any of the possible indicators of ASD, further evaluation is indicated.

While means for screening ASDs exist, many times symptoms go unnoticed until late in childhood or symptoms are so minor they are left unnoticed. Thus there exists a need for an improved ASD screening test. Described herein are methods of screening an individual for one or more developmental disorders, including but not limited to, determining the identity and location of genetic variations, such as variations in nucleotide sequence and copy number, and the presence or absence of alleles or genotypes in one or more samples from one or more subjects using any of the methods described herein. In some embodiments, determining an association to having or developing a developmental disorder can be performed by detecting particular variations that appear more frequently in test subjects compared to reference subjects and analyzing the molecular and physiological pathways these variations can affect.

Within any given population, there can be an absolute susceptibility of developing a disease or trait, defined as the chance of a person developing the specific disease or trait over a specified time-period. Susceptibility (e.g. being at-risk) is typically measured by looking at very large numbers of people, rather than at a particular individual. As described herein, certain copy number variations (genetic variations) are found to be useful for susceptibility assessment of a developmental disorder. Susceptibility assessment can involve detecting particular genetic variations in the genome of individuals undergoing assessment. Particular genetic variations are found more frequently in individuals with a developmental disorder, than in individuals without screening of a developmental disorder. Therefore, these genetic variations have predictive value for detecting a developmental disorder, or a susceptibility to a developmental disorder, in an individual. Without intending to be limited by theory, it is believed that the genetic variations described herein to be associated with susceptibility of a developmental disorder represent functional variants predisposing to the disease. In some embodiments, a genetic variation can confer a susceptibility of the condition, for example, carriers of the genetic variation are at a different risk of the condition than non-carriers. In a preferred embodiment, the presence of a genetic variation is indicative of increased susceptibility to a developmental disorder, such as ASD.

In some embodiments, screening can be performed using any of the methods disclosed, alone or in combination. In some embodiments, screening can be performed using Polymerase Chain Reaction (PCR). In a preferred embodiment screening can be performed using Array Comparative Genomic Hybridization (aCGH). In some embodiments, the genetic variation information as it relates to the current disclosure can be used in conjunction with any of the above mentioned symptomatic screening tests to screen a subject for ASD, for example, using a combination of aCGH and a childhood screening test, such as the Checklist of Autism in Toddlers (CHAT).

In some embodiments, information from any of the above screening methods (e.g. specific symptoms, scoring matrix, or genetic variation data) can be used to define a subject as a test subject or reference subject. In some embodiments, information from any of the above screening methods can be used to associate a subject with a test or reference population, for example, a subject in a population. In the present study, for example, all the probands in Table 1 met the criteria for autism on one or both of the screening measures including the Autism Diagnostic Interview-Revised (ADI-R) training and the Autism Diagnostic Observation Schedule (ADOS) training.

In one embodiment, an association with a developmental disorder can be determined by the statistical likelihood of the presence of a genetic variation in a subject with a developmental disorder, for example, an unrelated individual or a first or second-degree relation of the subject. In some embodiments, an association with a developmental disorder can be determined by determining the statistical likelihood of the absence of a genetic variation in an unaffected reference subject, for example, an unrelated individual or a first or second-degree relation of the subject. The methods described herein can include obtaining and analyzing a sample from one or more suitable reference subjects.

In the present context, the term screening comprises diagnosis, prognosis, and theranosis. Screening can refer to any available screening method, including those mentioned herein. As used herein, susceptibility can be proneness of a subject towards the development of a developmental condition, or towards being less able to resist a particular developmental condition than one or more control subjects. In some embodiments, susceptibility can encompass increased susceptibility. For example, particular nucleic acid variations of the disclosure as described herein can be characteristic of increased susceptibility to development of a developmental disorder. In some embodiments, susceptibility can encompass decreased susceptibility, for example, particular nucleic variations of the disclosure as described herein can be characteristic of decreased susceptibility to development of a developmental disorder.

As described herein, a genetic variation predictive of susceptibility to or presence of a developmental disorder can be one where the particular genetic variation is more frequently present in a subject with the condition (affected), compared to the frequency of its presence in a reference group (control), such that the presence of the genetic variation is indicative of susceptibility to or presence of the developmental disorder. In some embodiments, the reference group can be a population sample, for example, a random sample from the general population or a mixture of two or more samples from a population. In some embodiments, disease-free controls can be characterized by the absence of one or more specific disease-associated symptoms, for example, individuals who have not experienced symptoms associated with a developmental disorder. In another embodiment, the disease-free control group is characterized by the absence of one or more disease-specific risk factors, for example, at least one genetic and/or environmental risk factor. In some embodiments, a reference sequence can be referred to for a particular site of genetic variation. In some embodiments, a reference allele can be a wild-type allele and can be chosen as either the first sequenced allele or as the allele from a control individual. In some embodiments, one or more reference subjects can be characteristically matched with one or more affected subjects, for example, with matched aged, gender or ethnicity.

A person skilled in the art will appreciate that for genetic variations with two alleles present in the population being studied, and wherein one allele can found in increased frequency in a group of individuals with a developmental disorder in the population, compared with controls, the other allele of the marker can be found in decreased frequency in the group of individuals with the trait or disease, compared with controls. In such a case, one allele of the marker, for example, the allele found in increased frequency in individuals with a developmental disorder, can be the at-risk allele, while the other allele can be a neutral or protective allele.

A genetic variant associated with a developmental disorder can be used to predict the susceptibility of the disease for a given genotype. For any genetic variation, there can be one or more possible genotypes, for example, homozygote for the at-risk variant (e.g., in autosomal recessive disorders), heterozygote, and non-carrier of the at-risk variant. In some embodiments, susceptibility associated with variants at multiple loci can be used to estimate overall susceptibility. For multiple genetic variants, there can be k (k=3^n*2^P) possible genotypes; wherein n can be the number of autosomal loci and p can be the number of gonosomal (sex chromosomal) loci. Overall susceptibility assessment calculations can assume that the relative susceptibilities of different genetic variants multiply, for example, the overall susceptibility associated with a particular genotype combination can be the product of the susceptibility values for the genotype at each locus. If the susceptibility presented is the relative susceptibility for a person, or a specific genotype for a person, compared to a reference population, then the combined susceptibility can be the product of the locus specific susceptibility values and can correspond to an overall susceptibility estimate compared with a population. If the susceptibility for a person is based on a comparison to non-carriers of the at-risk allele, then the combined susceptibility can correspond to an estimate that compares the person with a given combination of genotypes at all loci to a group of individuals who do not carry at-risk variants at any of those loci. The group of non-carriers of any at-risk variant can have the lowest estimated susceptibility and can have a combined susceptibility, compared with itself, for example, non-carriers, of 1.0, but can have an overall susceptibility, compared with the population, of less than 1.0.

Overall risk for multiple risk variants can be performed using standard methodology. Genetic variations described herein can form the basis of risk analysis that combines other genetic variations known to increase risk of a developmental disorder, or other genetic risk variants for a developmental disorder. In certain embodiments of the disclosure, a plurality of variants (genetic variations, variant alleles, and/or haplotypes) can be used for overall risk assessment. These variants are in some embodiments selected from the genetic variations as disclosed herein. Other embodiments include the use of the variants of the present disclosure in combination with other variants known to be useful for screening a susceptibility to a developmental disorder. In such embodiments, the genotype status of a plurality of genetic variations, markers and/or haplotypes is determined in an individual, and the status of the individual compared with the population frequency of the associated variants, or the frequency of the variants in clinically healthy subjects, such as age-matched and sex-matched subjects.

Methods known in the art, such as the use of available algorithms and software can be used to identify, or call, significant genetic variations, including but not limited to, algorithms of DNA Analytics or DNAcopy, iPattern and/or QuantiSNP. For example, an Aberration Detection Module 2 (ADM2) algorithm, such as that of DNA Analytics 4.0.85 can be used to identify, or call, significant genetic variations. In some embodiments, two or more algorithms can be used to identify, or call, significant genetic variations. For example, 2, 3, 4, 5, 6, 7, 8, 9, or 10 or more algorithms can be used to identify, or call, significant genetic variations. In some embodiments, significant genetic variations can be CNVs.

CNVs detected by 2 or more algorithms can be defined as stringent and can be utilized for further analyses. In some embodiments, the information and calls from two or more of the methods described herein can be compared to each other to identify significant genetic variations more or less stringently. For example, CNV calls generated by both Aberration Detection Module 2 (ADM2) algorithms and DNAcopy algorithms can be defined as stringent CNVs. In some embodiments, significant or stringent genetic variations can be tagged as identified or called if it can be found to have a minimal reciprocal overlap to a genetic variation detected by one or more platforms and/or methods described herein. For example, significant or stringent genetic variations can be tagged as identified or called if it can be found to have a reciprocal overlap of more than about 50%, 55% 60%, 65%, 70%, 75%, 80%, 85%, 90%, or 95%, 99%, or equal to 100%, to a genetic variation detected by one or more platforms and/or methods described herein. For example, significant or stringent genetic variations can be tagged as identified or called if it can be found to have a reciprocal overlap of more than about 50% reciprocal overlap to a genetic variation detected by one or more platforms and/or methods described herein.

In some embodiments, a threshold log ratio value can be used to determine losses and gains. A log ratio value can be any log ratio value; for example, a log ratio value can be a log2 ratio or a log10 ratio. In some embodiments, a CNV segment whose median log2 ratio is less than or equal to a log2 ratio threshold value can be classified as a loss. For example, any segment whose median log2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, can be classified as a loss.

In some embodiments, one algorithm can be used to call or identify significant genetic variations, wherein any segment whose median log2 ratio was less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, can be classified as a loss. For example, any CNV segment whose median log2 ratio is less than −0.35 as determined by DNAcopy can be classified as a loss. For example, losses can be determined according to a threshold log2 ratio, which can be set at −0.35.

In some embodiments, two algorithms can be used to call or identify significant genetic variations, wherein any segment whose median log2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, as determined by one algorithm, and wherein any segment whose median log2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20, or less, as determined by the other algorithm can be classified as a loss. For example, CNV calling can comprise using the Aberration Detection Module 2 (ADM2) algorithm and the DNAcopy algorithm, wherein losses can be determined according to a two threshold log2 ratios, wherein the Aberration Detection Module 2 (ADM2) algorithm log2 ratio can be −0.25 and the DNAcopy algorithm log2 ratio can be −0.41.

In some embodiments, the use of two algorithms to call or identify significant genetic variations can be a stringent method. In some embodiments, the use of two algorithms to call or identify significant genetic variations can be a more stringent method compared to the use of one algorithm to call or identify significant genetic variations.

In some embodiments, any CNV segment whose median log2 ratio is greater than a log2 ratio threshold value can be classified as a gain. For example, any segment whose median log2 ratio is greater than 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more can be classified as a gain.

In some embodiments, one algorithm can be used to call or identify significant genetic variations, wherein any segment whose median log2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more can be classified as a gain. For example, any CNV segment whose median log2 ratio is greater than 0.35 as determined by DNAcopy can be classified as a gain. For example, gains can be determined according to a threshold log2 ratio, which can be set at 0.35.

In some embodiments, two algorithms can be used to call or identify significant genetic variations, wherein any segment whose median log2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, or 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3 or more, as determined by one algorithm, and wherein any segment whose median log2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, or 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more, as determined by the other algorithm the can be classified as a gain. For example, CNV calling can comprise using the Aberration Detection Module 2 (ADM2) algorithm and the DNAcopy algorithm, wherein gains can be determined according to a two threshold log2 ratios, wherein the Aberration Detection Module 2 (ADM2) algorithm log2 ratio can be 0.25 and the DNAcopy algorithm log2 ratio can be 0.32.

Any CNV segment whose absolute (median log-ratio/mad) value is less than 2 can be excluded (not identified as a significant genetic variation). For example, any CNV segment whose absolute (median log-ratio/mad) value is less than 2, 1.9, 1.8, 1.7, 1.6, 1.5, 1.4, 1.3, 1.2, 1.1, 1, 0.9, 0.8, 0.7, 0.6, or 0.5 or less can be excluded.

In some embodiments, multivariate analyses or joint risk analyses, including the use of multiplicative model for overall risk assessment, and can subsequently be used to determine the overall risk conferred based on the genotype status at the multiple loci. Use of a multiplicative model, for example, assuming that the risk of individual risk variants multiply to establish the overall effect, allows for a straightforward calculation of the overall risk for multiple markers. The multiplicative model is a parsimonious model that usually fits the data of complex traits reasonably well. Deviations from multiplicity have been rarely described in the context of common variants for common diseases, and if reported are usually only suggestive since very large sample sizes are usually required to be able to demonstrate statistical interactions between loci. Assessment of risk based on such analysis can subsequently be used in the methods, uses and kits of the disclosure, as described herein.

In some embodiments, the significance of increased or decreased susceptibility can be measured by a percentage. In some embodiments, a significant increased susceptibility can be measured as a relative susceptibility of at least 1.2, including but not limited to: at least 1.5, at least 1.3, at least 1.4, at least 1.5, at least 1.6, at least 1.7, 1.8, at least 1.9, at least 2.0, at least 2.5, at least 3.0, at least 4.0, at least 5.0, at least 6.0, at least 7.0, at least 8.0, at least 9.0, at least 10.0, and at least 15.0. In some embodiments, a relative susceptibility of at least 2.0, at least 3.0, at least 4.0, at least 5.0, at least 6.0, or at least 10.0 is significant. Other values for significant susceptibility are also contemplated, for example, at least 2.5, 3.5, 4.5, 5.5, or any suitable other numerical values, wherein said values are also within scope of the present disclosure. In some embodiments, a significant increase in susceptibility is at least about 20%, including but not limited to about 25%, 30%, 35%, 40%, 45%, 50%, 55%, 60%, 65%, 70%, 75%, 80%, 85%, 90%, 95%, 100%, 150%, 200%, 300%, 400%, 500%, 600%, 700%, 800%, 900%, 1000%, and 1500%. In one particular embodiment, a significant increase in susceptibility is at least 100%. In other embodiments, a significant increase in susceptibility is at least 200%, at least 300%, at least 400%, at least 500%, at least 700%, at least 800%, at least 900% and at least 1000%. Other cutoffs or ranges as deemed suitable by the person skilled in the art to characterize the disclosure are also contemplated, and those are also within scope of the present disclosure. In certain embodiments, a significant increase in susceptibility is characterized by a p-value, such as a p-value of less than 0.5, less than 0.4, less than 0.3, less than 0.2, less than 0.1, less than 0.05, less than 0.01, less than 0.001, less than 0.0001, less than 0.00001, less than 0.000001, less than 0.0000001, less than 0.00000001, or less than 0.000000001.

In some embodiments, an individual who is at a decreased susceptibility for or the lack of presence of a developmental condition can be an individual in whom at least one genetic variation, conferring decreased susceptibility for or the lack of presence of the developmental disorder is identified. In some embodiments, the genetic variations conferring decreased susceptibility are also said to be protective. In one aspect, the genetic variations can confer a significant decreased susceptibility of or lack of presence of the developmental disorder.

In some embodiments, significant decreased susceptibility can be measured as a relative susceptibility of less than 0.9, including but not limited to less than 0.9, less than 0.8, less than 0.7, less than 0.6, less than 0.5, less than 0.4, less than 0.3, less than 0.2 and less than 0.1. In another embodiment, the decrease in susceptibility is at least 20%, including but not limited to at least 25%, at least 30%, at least 35%, at least 40%, at least 45%, at least 50%, at least 55%, at least 60%, at least 65%, at least 70%, at least 75%, at least 80%, at least 85%, at least 90%, at least 95% and at least 98%. Other cutoffs or ranges as deemed suitable by the person, skilled in the art to characterize the disclosure are however also contemplated, and those are also within scope of the present disclosure. In certain embodiments, a significant decrease in susceptibility is characterized by a p-value, such as a p-value of less than 0.05, less than 0.01, less than 0.001, less than 0.0001, less than 0.00001, less than 0.000001, less than 0.0000001, less than 0.00000001, or less than 0.000000001. Other tests for significance can be used, for example, a Fisher-exact test. Other statistical tests of significance known to the skilled person are also contemplated and are also within scope of the disclosure.

In some preferred embodiments, the significance of increased or decreased susceptibility can be determined according to the ratio of measurements from a test subject to a reference subject. In a preferred embodiment, losses or gains of one or more CNVs can be determined according to a threshold $\log_2$ ratio determined by these measurements. In some embodiments, a $\log_2$ ratio value greater than 0.35 is indicative of a gain of one or more CNVs. In some embodiments, a $\log_2$ ratio value less than −0.35 is indicative of a loss of one or more CNVs. In some embodiments, the ratio of measurements from a test subject to a reference subject may be inverted such that the log2 ratios of copy number gains are negative and the log2 ratios of copy number losses are positive.

In some embodiments, the combined or overall susceptibility associated with a plurality of variants associated with a developmental disorder can also be assessed; for example, the genetic variations described herein to be associated with susceptibility to a developmental disorder can be combined with other common genetic risk factors. Combined risk for such genetic variants can be estimated in an analogous fashion to the methods described herein.

Calculating risk conferred by a particular genotype for the individual can be based on comparing the genotype of the individual to previously determined risk expressed, for example, as a relative risk (RR) or an odds ratio (OR), for the genotype, for example, for a heterozygous carrier of an at-risk variant for a developmental disorder. An odds ratio can be a statistical measure used as a metric of causality. For example, in genetic disease research it can be used to convey the significance of a variant in a disease cohort relative to an unaffected/normal cohort. The calculated risk for the individual can be the relative risk for a subject, or for a specific genotype of a subject, compared to the average population. The average population risk can be expressed as a weighted average of the risks of different genotypes, using results from a reference population, and the appropriate calculations to calculate the risk of a genotype group relative to the population can then be performed. Alternatively, the risk for an individual can be based on a comparison of particular genotypes, for example, heterozygous carriers of an at-risk allele of a marker compared with non-carriers of the at-risk allele. Using the population average can, in certain embodiments, be more convenient, since it provides a measure which can be easy to interpret for the user, such as a measure that gives the risk for the individual, based on his/her genotype, compared with the average in the population.

In certain embodiments of the disclosure, a genetic variation is correlated to a developmental disorder by referencing genetic variation data to a look-up table that comprises correlations between the genetic variation and a developmental disorder. The genetic variation in certain embodiments comprises at least one indication of the genetic variation. In some embodiments, the table comprises a correlation for one genetic variation. In other embodiments, the table comprises a correlation for a plurality of genetic variations. In both scenarios, by referencing to a look-up table that gives an indication of a correlation between a genetic variation and a developmental disorder, a risk for a developmental disorder, or a susceptibility to a developmental disorder, can be identified in the individual from whom the sample is derived.

The present disclosure also pertains to methods of clinical screening, for example, diagnosis, prognosis, or theranosis of a subject performed by a medical professional using the methods disclosed herein. In other embodiments, the disclosure pertains to methods of screening performed by a layman. The layman can be a customer of a genotyping service. The layman can also be a genotype service provider, who performs genotype analysis on a DNA sample from an individual, in order to provide service related to genetic risk factors for particular traits or diseases, based on the genotype status of the subject obtained from use of the methods described herein. The resulting genotype information can be made available to the individual and can be compared to information about developmental disorder or risk of developing a developmental disorder associated with various genetic variations, including but not limited to, information from public literature and scientific publications. The screening applications of developmental disorder-associated genetic variations, as described herein, can, for example, be performed by an individual, a health professional, or a third party, for example, a service provider who interprets genotype information from the subject.

The information derived from analyzing sequence data can be communicated to any particular body, including the individual from which the sample or sequence data is derived, a guardian or representative of the individual, clinician, research professional, medical professional, service provider, and medical insurer or insurance company. Medical professionals can be, for example, doctors, nurses, medical laboratory technologists, and pharmacists. Research professionals can be, for example, principle investigators, research technicians, postdoctoral trainees, and graduate students.

In some embodiments, a professional can be assisted by determining whether specific genetic variants are present in a biological sample from a subject, and communicating information about genetic variants to a professional. After information about specific genetic variants is reported, a medical professional can take one or more actions that can affect subject care. For example, a medical professional can record information in the subject's medical record regarding the subject's risk of developing a developmental disorder. In some embodiments, a medical professional can record information regarding risk assessment, or otherwise transform the subject's medical record, to reflect the subject's current medical condition. In some embodiments, a medical professional can review and evaluate a subject's entire medical record and assess multiple treatment strategies for clinical intervention of a subject's condition.

A medical professional can initiate or modify treatment after receiving information regarding a subject's screening of a developmental disorder, for example. In some embodiments, a medical professional can recommend a change in therapy. In some embodiments, a medical professional can enroll a subject in a clinical trial for, by way of example, detecting correlations between a haplotype as described herein and any measurable or quantifiable parameter relating to the outcome of the treatment as described above.

In some embodiments, a medical professional can communicate information regarding a subject's screening of developing a developmental disorder to a subject or a subject's family. In some embodiments, a medical professional can provide a subject and/or a subject's family with information regarding a developmental disorder and risk assessment information, including treatment options, and referrals to specialists. In some embodiments, a medical professional can provide a copy of a subject's medical records to a specialist. In some embodiments, a research professional can apply information regarding a subject's risk of developing a developmental disorder to advance scientific research. In some embodiments, a research professional can obtain a subject's haplotype as described herein to evaluate a subject's enrollment, or continued participation, in a research study or clinical trial. In some embodiments, a research professional can communicate information regarding a subject's screening of a developmental disorder to a medical professional. In some embodiments, a research professional can refer a subject to a medical professional.

Any appropriate method can be used to communicate information to another person. For example, information can be given directly or indirectly to a professional and laboratory technician can input a subject's genetic variation as described herein into a computer-based record. In some embodiments, information is communicated by making a physical alteration to medical or research records. For example, a medical professional can make a permanent notation or flag a medical record for communicating the risk assessment to other medical professionals reviewing the record. In addition, any type of communication can be used to communicate the risk assessment information. For example, mail, e-mail, telephone, and face-to-face interactions can be used. The information also can be communicated to a professional by making that information electronically available to the professional. For example, the information can be communicated to a professional by placing the information on a computer database such that the professional can access the information. In addition, the information can be communicated to a hospital, clinic, or research facility serving as an agent for the professional.

Results of these tests, and optionally interpretive information, can be returned to the subject, the health care provider or to a third party. The results can be communicated to the tested subject, for example, with a prognosis and optionally interpretive materials that can help the subject understand the test results and prognosis; used by a health care provider, for example, to determine whether to administer a specific drug, or whether a subject should be assigned to a specific category, for example, a category associated with a specific disease endophenotype, or with drug response or non-response; used by a third party such as a healthcare payer, for example, an insurance company or HMO, or other agency, to determine whether or not to reimburse a health care provider for services to the subject, or whether to approve the provision of services to the subject. For example, the healthcare payer can decide to reimburse a health care provider for treatments for a developmental disorder if the subject has a developmental disorder or has an increased risk of developing a developmental disorder.

Also provided herein are databases that include a list of genetic variations as described herein, and wherein the list can be largely or entirely limited to genetic variations identified as useful for screening a developmental disorder as described herein. The list can be stored, for example, on a flat file or computer-readable medium. The databases can further include information regarding one or more subjects, for example, whether a subject is affected or unaffected, clinical information such as endophenotype, age of onset of symptoms, any treatments administered and outcomes, for example, data relevant to pharmacogenomics, diagnostics, prognostics or theranostics, and other details, for example, data about the disorder in the subject, or environmental or other genetic factors. The databases can be used to detect correlations between a particular haplotype and the information regarding the subject.

The methods described herein can also include the generation of reports for use, for example, by a subject, care giver, or researcher, that include information regarding a subject's genetic variations, and optionally further information such as treatments administered, treatment history, medical history, predicted response, and actual response. The reports can be recorded in a tangible medium, e.g., a computer-readable disk, a solid state memory device, or an optical storage device.

Methods of Screening using Variations in Polypeptides

In another embodiment of the disclosure, screening of a developmental disorder can be made by examining or comparing changes in expression, localization, binding partners, and composition of a polypeptide encoded by a nucleic acid associated with a developmental disorder, for example, in those instances where the genetic variations of the present disclosure results in a change in the composition or expression of the polypeptide. Thus, screening of a developmental disorder can be made by examining expression and/or composition of one of these polypeptides, or another polypeptide encoded by a nucleic acid associated with a developmental disorder, in those instances where the genetic variation of the present disclosure results in a change in the expression, localization, binding partners, and/or composition of the polypeptide. In some embodiments, screening can comprise diagnosing a subject. In some embodiments, screening can comprise determining a prognosis of a subject, for example, determining the susceptibility of developing a developmental disorder. In some embodiments, screening can comprise theranosing a subject.

The genetic variations described herein that show association to a developmental disorder can play a role through their effect on one or more of these nearby genes. For example, while not intending to be limited by theory, it is generally expected that a deletion of a chromosomal segment comprising a particular gene, or a fragment of a gene, can either result in an altered composition or expression, or both, of the encoded protein. Likewise, duplications, or high number copy number variations, are in general expected to result in increased expression of encoded polypeptide. Other possible mechanisms affecting genes within a genetic variation region include, for example, effects on transcription, effects on RNA splicing, alterations in relative amounts of alternative splice forms of mRNA, effects on RNA stability, effects on transport from the nucleus to cytoplasm, and effects on the efficiency and accuracy of translation. Thus, DNA variations can be detected directly, using the subjects unamplified or amplied genomic DNA, or indirectly, using RNA or DNA obtained from the subject's tissue(s) that are present in an aberrant form or expression level as a result of the genetic variations of the disclosure showing association to ASD.

In some embodiments, the genetic variations of the disclosure showing association to a developmental disorder can affect the expression of a gene within the genetic variation region. In some embodiments, a genetic variation affecting an exonic region of a gene can affect, disrupt, or modulate the expression of the gene. In some embodiments, a genetic variation affecting an intergenic region of a gene can affect, disrupt, or modulate the expression of the gene. Certain genetic variation regions can have flanking duplicated segments, and genes within such segments can have altered expression and/or composition as a result of such genomic alterations. Regulatory elements affecting gene expression can be located far away, even as far as tens or hundreds of kilobases away, from the promoter region of a gene. Thus, in some embodiments, regulatory elements for genes that are located outside the genetic variation region can be located within the genetic variation, and can be affected by the genetic variation. It is thus contemplated that the detection of the genetic variations described herein, can be used for assessing expression for one or more of associated genes not directly impacted by the genetic variations. In some embodiments, a genetic variation affecting an intergenic region of a gene can affect, disrupt, or modulate the expression of a gene located elsewhere in the genome, such as described above. For example, a genetic variation affecting an intergenic region of a gene can affect, disrupt, or modulate the expression of a transcription factor, located elsewhere in the genome, which regulates the gene.

In some embodiments, genetic variations of the disclosure showing association to ASD can affect protein expression at the translational level. It can be appreciated by those skilled in the art that this can occur by increased or decreased expression of one or more microRNAs (miRNAs) that regulates expression of a protein known to be important, or implicated, in the cause, onset, or progression of ASD. Increased or decreased expression of the one or more miRNAs can result from gain or loss of the whole miRNA gene, disruption of a portion of the gene (e.g., by an indel or CNV), or even a single base change (SNP or SNV) that produces an altered, non-functional or aberrant functioning miRNA sequence. It can also be appreciated by those skilled in the art that the expression of protein, for example, one known to cause ASD by increased or decreased expression, can result due to a genetic variation that results in alteration of an existing miRNA binding site within the protein's mRNA transcript, or even creates a new miRNA binding site that leads to aberrant protein expression.

A variety of methods can be used for detecting protein composition and/or expression levels, including but not limited to enzyme linked immunosorbent assays (ELISA), Western blots, spectroscopy, mass spectrometry, peptide arrays, colorimetry, electrophoresis, isoelectric focusing, immunoprecipitations, immunoassays, and immunofluorescence and other methods well-known in the art. A test sample from a subject can be assessed for the presence of an alteration in the expression and/or an alteration in composition of the polypeptide encoded by a nucleic acid associated with a developmental disorder. An "alteration" in the polypeptide expression or composition, as used herein, refers to an alteration in expression or composition in a test sample, as compared to the expression or composition of the polypeptide in a control sample. Such alteration can, for example, be an alteration in the quantitative polypeptide expression or can be an alteration in the qualitative polypeptide expression, for example, expression of a mutant polypeptide or of a different splicing variant, or a combination thereof. In some embodiments, screening of a developmental disorder can be made by detecting a particular splicing variant encoded by a nucleic acid associated with a developmental disorder, or a particular pattern of splicing variants.

Antibodies can be polyclonal or monoclonal and can be labeled or unlabeled. An intact antibody, or a fragment thereof can be used. The term "labeled", with regard to the probe or antibody, is intended to encompass direct labeling of the probe or antibody by coupling a detecTable substance to the probe or antibody, as well as indirect labeling of the probe or antibody by reactivity with another reagent that is directly labeled as previously described herein. Other non-limiting examples of indirect labeling include detection of a primary antibody using a labeled secondary antibody, for example, a fluorescently-labeled secondary antibody and end-labeling of a DNA probe with biotin such that it can be detected with fluorescently-labeled streptavidin.

Detecting Genetic Variations Associated with Autism Spectrum Disorder

Described herein, are methods that can be used to detect genetic variations. Detecting specific genetic variations, for example, polymorphic markers and/or haplotypes, copy number, absence or presence of an allele, or genotype associated with a developmental disorder as described herein, can be accomplished by methods known in the art for analyzing nucleic acids and/or detecting sequences at polymorphic or genetically variable sites, for example, amplification techniques, hybridization techniques, sequencing, arrays, or any combination thereof. Thus, by use of these methods disclosed herein or other methods available to the person skilled in the art, one or more alleles at polymorphic markers, including microsatellites, SNPs, CNVs, or other types of genetic variations, can be identified in a sample obtained from a subject.

Nucleic Acids

The nucleic acids and polypeptides described herein can be used in methods and kits of the present disclosure. In some embodiments, aptamers that specifically bind the nucleic acids and polypeptides described herein can be used in methods and kits of the present disclosure. As used herein, a nucleic acid can comprise a deoxyribonucleotide (DNA) or ribonucleotide (RNA), whether singular or in polymers, naturally occurring or non-naturally occurring, double-stranded or single-stranded, coding, for example, a translated gene, or non-coding, for example, a regulatory region, or any fragments, derivatives, mimetics or complements thereof. In some embodiments, nucleic acids can comprise oligonucleotides, nucleotides, polynucleotides, nucleic acid sequences, genomic sequences, antisense nucleic acids, DNA regions, probes, primers, genes, regulatory regions, introns, exons, open-reading frames, binding sites, target nucleic acids and allele-specific nucleic acids.

"Isolated" nucleic acids, as used herein, are separated from nucleic acids that normally flank the gene or nucleotide sequence (as in genomic sequences) and/or has been completely or partially purified from other transcribed sequences (e.g., as in an RNA library). For example, isolated nucleic acids of the disclosure can be substantially isolated with respect to the complex cellular milieu in which it naturally occurs, or culture medium when produced by recombinant techniques, or chemical precursors or other chemicals when chemically synthesized. In some instances, the isolated material can form part of a composition, for example, a crude extract containing other substances, buffer system or reagent mix. In some embodiments, the material can be purified to essential homogeneity using methods known in the art, for example, by polyacrylamide gel electrophoresis (PAGE) or column chromatography (e.g., HPLC). With regard to genomic DNA (gDNA), the term "isolated" also can refer to nucleic acids that are separated from the chromosome with which the genomic DNA is naturally associated. For example, the isolated nucleic acid molecule can contain less than about 250 kb, 200 kb, 150 kb, 100 kb, 75 kb, 50 kb, 25 kb, 10 kb, 5 kb, 4 kb, 3 kb, 2 kb, 1 kb, 0.5 kb or 0.1 kb of the nucleotides that flank the nucleic acid molecule in the gDNA of the cell from which the nucleic acid molecule is derived.

Nucleic acids can be fused to other coding or regulatory sequences can be considered isolated. For example, recombinant DNA contained in a vector is included in the definition of "isolated" as used herein. In some embodiments, isolated nucleic acids can include recombinant DNA molecules in heterologous host cells or heterologous organisms, as well as partially or substantially purified DNA molecules in solution. Isolated nucleic acids also encompass in vivo and in vitro RNA transcripts of the DNA molecules of the present disclosure. An isolated nucleic acid molecule or nucleotide sequence can be synthesized chemically or by recombinant means. Such isolated nucleotide sequences can be useful, for example, in the manufacture of the encoded polypeptide, as probes for isolating homologous sequences (e.g., from other mammalian species), for gene mapping (e.g., by in situ hybridization with chromosomes), or for detecting expression of the gene, in tissue (e.g., human tissue), such as by Northern blot analysis or other hybridization techniques disclosed herein. The disclosure also pertains to nucleic acid sequences that hybridize under high stringency hybridization conditions, such as for selective hybridization, to a nucleotide sequence described herein. Such nucleic acid sequences can be detected and/or isolated by allele- or sequence-specific hybridization (e.g., under high stringency conditions). Stringency conditions and methods for nucleic acid hybridizations are well known to the skilled person (see, e.g., Current Protocols in Molecular Biology, Ausubel, F. et al., John Wiley & Sons, (1998), and Kraus, M. and Aaronson, S., Methods Enzymol., 200:546-556 (1991), the entire teachings of which are incorporated by reference herein.

Calculations of "identity" or "percent identity" between two or more nucleotide or amino acid sequences can be determined by aligning the sequences for optimal comparison purposes (e.g., gaps can be introduced in the sequence of a first sequence). The nucleotides at corresponding positions are then compared, and the percent identity between the two sequences is a function of the number of identical positions shared by the sequences (i.e., % identity=# of identical positions/total # of positions×100). For example, a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which need to be introduced for optimal alignment of the two sequences. In some embodiments, the length of a sequence aligned for comparison purposes is at least 30%, at least 40%, at least 50%, at least 60%, at least 70%, at least 80%, at least 90%, or at least 95%, of the length of the reference sequence. The actual comparison of the two sequences can be accomplished by well-known methods, for example, using a mathematical algorithm. A non-limiting example of such a mathematical algorithm is described in Karlin, S, and Altschul, S., Proc. Natl. Acad. Sci. USA, 90-5873-5877 (1993). Such an algorithm is incorporated into the NBLAST and XBLAST programs (version 2.0), as described in Altschul, S. et al., Nucleic Acids Res., 25:3389-3402 (1997). When utilizing BLAST and Gapped BLAST programs, any relevant parameters of the respective programs (e.g., NBLAST) can be used. For example, parameters for sequence comparison can be set at score=100, word length=12, or can be varied (e.g., W=5 or W=20). Other examples include the algorithm of Myers and Miller, CABIOS (1989), ADVANCE, ADAM, BLAT, and FASTA. In another embodiment, the percent identity between two amino acid sequences can be accomplished using, for example, the GAP program in the GCG software package (Accelrys, Cambridge, UK).

"Probes" or "primers" can be oligonucleotides that hybridize in a base-specific manner to a complementary strand of a nucleic acid molecule. Probes can include primers, which can be a single-stranded oligonucleotide probe that can act as a point of initiation of template-directed DNA synthesis using methods including but not limited to, polymerase chain reaction (PCR) and ligase chain reaction (LCR) for amplification of a target sequence. Oligonucleotides, as described herein, can include segments or fragments of nucleic acid sequences, or their complements. In some embodiments, DNA segments can be between 5 and 10,000 contiguous bases, and can range from 5, 10, 12, 15, 20, or 25 nucleotides to 10, 15, 20, 25, 30, 40, 50, 100, 200, 500, 1000 or 10,000 nucleotides. In addition to DNA and RNA, probes and primers can include polypeptide nucleic acids (PNA), as described in Nielsen, P. et al., Science 254: 1497-1500 (1991). A probe or primer can comprise a region of nucleotide sequence that hybridizes to at least about 15, typically about 20-25, and in certain embodiments about 40, 50 or 75, consecutive nucleotides of a nucleic acid molecule.

The present disclosure also provides isolated nucleic acids, for example, probes or primers, that contain a fragment or portion that can selectively hybridize to a nucleic acid that comprises, or consists of, a nucleotide sequence, wherein the nucleotide sequence can comprise at least one polymorphism or polymorphic allele contained in the genetic variations described herein or the wild-type nucleotide that is located at the same position, or the compliments thereof. In some embodiments, the probe or primer can be at least 70% identical, at least 80% identical, at least 85% identical, at least 90% identical, or at least 95% identical, to the contiguous nucleotide sequence or to the complement of the contiguous nucleotide sequence.

In a preferred embodiment, a nucleic acid probe can be an oligonucleotide capable of hybridizing with a complementary regions of a gene associated with a developmental disorder containing a genetic variation described herein. The nucleic acid fragments of the disclosure can be used as probes or primers in assays such as those described herein.

The nucleic acids of the disclosure, such as those described above, can be identified and isolated using standard molecular biology techniques well known to the skilled person. In some embodiments, DNA can be amplified and/or can be labeled (e.g., radiolabeled, fluorescently labeled) and used as a probe for screening, for example, a cDNA library derived from an organism. cDNA can be derived from mRNA and can be contained in a suitable vector. For example, corresponding clones can be isolated, DNA obtained fallowing in vivo excision, and the cloned insert can be sequenced in either or both orientations by art-recognized methods to identify the correct reading frame encoding a polypeptide of the appropriate molecular weight. Using these or similar methods, the polypeptide and the DNA encoding the polypeptide can be isolated, sequenced and further characterized.

In some embodiments, nucleic acid can comprise one or more polymorphisms, variations, or mutations, for example, single nucleotide polymorphisms (SNPs), copy number variations (CNVs), for example, insertions, deletions, inversions, and translocations. In some embodiments, nucleic acids can comprise analogs, for example, phosphorothioates, phosphoramidates, methyl phosphonate, chiralmethyl phosphonates, 2-O-methyl ribonucleotides, or modified nucleic acids, for example, modified backbone residues or linkages, or nucleic acids combined with carbohydrates, lipids, protein or other materials, or peptide nucleic acids (PNAs), for example, chromatin, ribosomes, and transcriptosomes. In some embodiments nucleic acids can comprise nucleic acids in various structures, for example, A DNA, B DNA, Z-form DNA, siRNA, tRNA, and ribozymes. In some embodiments, the nucleic acid may be naturally or non-naturally polymorphic, for example, having one or more sequence differences, for example, additions, deletions and/or substitutions, as compared to a reference sequence. In some embodiments, a reference sequence can be based on publicly available information, for example, the U.C. Santa Cruz Human Genome Browser Gateway (genome.ucsc.edu/cgi-bin/hg-Gateway) or the NCBI website (www.ncbi.nlm nih gov). In another embodiment, a reference sequence can be determined by a practitioner of the present invention using methods well known in the art, for example, by sequencing a reference nucleic acid.

In some embodiment a probe can hybridize to an allele, SNP, or CNV as described herein. In some embodiments, the probe can bind to another marker sequence associated with a developmental disorder as described herein.

One of skill in the art would know how to design a probe so that sequence specific hybridization will occur only if a particular allele is present in a genomic sequence from a test sample. The disclosure can also be reduced to practice using any convenient genotyping method, including commercially available technologies and methods for genotyping particular genetic variations Control probes can also be used, for example, a probe that binds a less variable sequence, for example, a repetitive DNA associated with a centromere of a chromosome, can be used as a control. In some embodiments, probes can be obtained from commercial sources. In some embodiments, probes can be synthesized, for example, chemically or in vitro, or made from chromosomal or genomic DNA through standard techniques. In some embodiments sources of DNA that can be used include genomic DNA, cloned DNA sequences, somatic cell hybrids that contain one, or a part of one, human chromosome along with the normal chromosome complement of the host, and chromosomes purified by flow cytometry or microdissection. The region of interest can be isolated through cloning, or by site-specific amplification using PCR.

One or more nucleic acids for example, a probe or primer, can also be labeled, for example, by direct labeling, to comprise a detecTable label. A detecTable label can comprise any label capable of detection by a physical, chemical, or a biological process for example, a radioactive label, such as $^{32}P$ or $^{3}H$, a fluorescent label, such as FITC, a chromophore label, an affinity-ligand label, an enzyme label, such as alkaline phosphatase, horseradish peroxidase, or 12 galactosidase, an enzyme cofactor label, a hapten conjugate label, such as digoxigenin or dinitrophenyl, a Raman signal generating label, a magnetic label, a spin label, an epitope label, such as the FLAG or HA epitope, a luminescent label, a heavy atom label, a nanoparticle label, electrochemical label, a light scattering label, a spherical shell label, semiconductor nanocrystal label, such as quantum dots (described in U.S. Pat. No. 6,207,392), and probes labeled with any other signal generating label known to those of skill in the art, wherein a label can allow the probe to be visualized with or without a secondary detection molecule. A nucleotide can be directly incorporated into a probe with standard techniques, for example, nick translation, random priming, and PCR labeling.

Non-limiting examples of label moieties useful for detection in the invention include, without limitation, suitable enzymes such as horseradish peroxidase, alkaline phosphatase, beta-galactosidase, or acetylcholinesterase; members of a binding pair that are capable of forming complexes such as streptavidin/biotin, avidin/biotin or an antigen/antibody complex including, for example, rabbit IgG and anti-rabbit IgG; fluorophores such as umbelliferone, fluorescein, fluorescein isothiocyanate, rhodamine, tetramethyl rhodamine, eosin, green fluorescent protein, erythrosin, coumarin, methyl coumarin, pyrene, malachite green, stilbene, lucifer yellow, Cascade Blue, Texas Red, dichlorotriazinylamine fluorescein, dansyl chloride, phycoerythrin, fluorescent lanthanide complexes such as those including Europium and Terbium, cyanine dye family members, such as Cy3 and Cy5, molecular beacons and fluorescent derivatives thereof, as well as others known in the art as described, for example, in Principles of Fluorescence Spectroscopy, Joseph R. Lakowicz (Editor), Plenum Pub Corp, 2nd edition (July 1999) and the 6th Edition of the Molecular Probes Handbook by Richard P. Hoagland; a luminescent material such as luminol; light scattering or plasmon resonant materials such as gold or silver particles or quantum dots; or radioactive material include $^{14}C$, $^{123}I$, $^{124}I$, $^{125}I$, $Tc^{99}m$, $^{32}P$, $^{33}P$, $^{35}S$ or $^{3}H$.

Other labels can also be used in the methods of the present disclosure, for example, backbone labels. Backbone labels comprise nucleic acid stains that bind nucleic acids in a sequence independent manner Non-limiting examples include intercalating dyes such as phenanthridines and acridines (e.g., ethidium bromide, propidium iodide, hexidium iodide, dihydroethidium, ethidium homodimer-1 and -2, ethidium monoazide, and ACMA); some minor grove binders such as indoles and imidazoles (e.g., Hoechst 33258, Hoechst 33342, Hoechst 34580 and DAPI); and miscellaneous nucleic acid stains such as acridine orange (also capable of intercalating), 7-AAD, actinomycin D, LDS751, and hydroxystilbamidine. All of the aforementioned nucleic acid stains are commercially available from suppliers such as Molecular Probes, Inc. Still other examples of nucleic acid stains include the following dyes from Molecular Probes: cyanine dyes such as SYTOX Blue, SYTOX Green, SYTOX Orange, POPO-1, POPO-3, YOYO-1, YOYO-3, TOTO-1, TOTO-3, JOJO-1, LOLO-1, BOBO-1, BOBO-3, PO-PRO-1, PO-PRO-3, BO-PRO-1, BO-PRO-3, TO-PRO-1, TO-PRO-3, TO-PRO-5, JO-PRO-1, LO-PRO-1, YO-PRO-1, YO-PRO-3, PicoGreen, OliGreen, RiboGreen, SYBR Gold, SYBR Green I, SYBR Green II, SYBR DX, SYTO-40, -41, -42, -43, -44, -45 (blue), SYTO-13, -16, -24, -21, -23, -12, -11, -20, -22, -15, -14, -25 (green), SYTO-81, -80, -82, -83, -84, -85 (orange), SYTO-64, -17, -59, -61, -62, -60, -63 (red).

In some embodiments, fluorophores of different colors can be chosen, for example, 7-amino-4-methylcoumarin-3-acetic acid (AMCA), 5-(and-6)-carboxy-X-rhodamine, lissamine rhodamine B, 5-(and-6)-carboxyfluorescein, fluorescein-5-isothiocyanate (FITC), 7-diethylaminocoumarin-3-carboxylic acid, tetramethylrhodamine-5-(and-6)-isothiocyanate, 5-(and-6)-carboxytetramethylrhodamine, 7-hydroxycoumarin-3-carboxylic acid, 6-[fluorescein 5-(and-6)-carboxamido]hexanoic acid, N-(4,4-difluoro-5,7-dimethyl-4-bora-3a,4a diaza-3-indacenepropionic acid, eosin-5-isothiocyanate, erythrosin-5-isothiocyanate, TRITC, rhodamine, tetramethylrhodamine, R-phycoerythrin, Cy-3, Cy-5, Cy-7, Texas Red, Phar-Red, allophycocyanin (APC), and CASCADE™ blue acetylazide, such that each probe in or not in a set can be distinctly visualized. In some embodiments, fluorescently labeled probes can be viewed with a fluorescence microscope and an appropriate filter for each fluorophore, or by using dual or triple bandpass filter sets to observe multiple fluorophores. In some embodiments, techniques such as flow cytometry can be used to examine the hybridization pattern of the probes.

In other embodiments, the probes can be indirectly labeled, for example, with biotin or digoxygenin, or labeled with radioactive isotopes such as $^{32}P$ and/or $^{3}H$. As a non-limiting example, a probe indirectly labeled with biotin can be detected by avidin conjugated to a detecTable marker. For example, avidin can be conjugated to an enzymatic marker such as alkaline phosphatase or horseradish peroxidase. In some embodiments, enzymatic markers can be detected using colorimetric reactions using a substrate and/or a catalyst for the enzyme. In some embodiments, catalysts for alkaline phosphatase can be used, for example, 5-bromo-4-chloro-3-indolylphosphate and nitro blue tetrazolium. In some embodiments, a catalyst can be used for horseradish peroxidase, for example, diaminobenzoate.

Methods of Detecting Genetic Variations

In some embodiments, standard techniques for genotyping for the presence genetic variations, for example, amplification, can be used. Amplification of nucleic acids can be accomplished using methods known in the art. Generally, sequence information from the region of interest can be used to design oligonucleotide primers that can be identical or similar in sequence to opposite strands of a template to be amplified. In some embodiments, amplification methods can include but are not limited to, fluorescence-based techniques utilizing PCR, for example, ligase chain reaction (LCR), Nested PCR, transcription amplification, self-sustained sequence replication, and nucleic acid based sequence amplification (NASBA), and multiplex ligation-dependent probe amplification (MLPA). Guidelines for selecting primers for PCR amplification are well known in the art. In some embodiments, a computer program can be used to design primers, for example, Oligo (National Biosciences, Inc, Plymouth Minn.), MacVector (Kodak/IBI), and GCG suite of sequence analysis programs.

In some embodiments, commercial methodologies available for genotyping, for example, SNP genotyping, can be used, but are not limited to, TaqMan genotyping assays (Applied Biosystems), SNPlex platforms (Applied Biosystems), gel electrophoresis, capillary electrophoresis, size exclusion chromatography, mass spectrometry, for example, MassARRAY system (Sequenom), minisequencing methods, real-time Polymerase Chain Reaction (PCR), Bio-Plex system (BioRad), CEQ and SNPstream systems (Beckman), array hybridization technology, for example, Affymetrix GeneChip (Perlegen), BeadArray Technologies, for example, Illumina GoldenGate and Infinium assays, array tag technology, Multiplex Ligation-dependent Probe Amplification (MLPA), and endonuclease-based fluorescence hybridization technology (Invader; Third Wave). PCR can be a procedure in which target nucleic acid is amplified in a manner similar to that described in U.S. Pat. No. 4,683,195 and subsequent modifications of the procedure described therein. In some embodiments, real-time quantitative PCR can be used to determine genetic variations, wherein quantitative PCR can permit both detection and quantification of a DNA sequence in a sample, for example, as an absolute number of copies or as a relative amount when normalized to DNA input or other normalizing genes. In some embodiments, methods of quantification can include the use of fluorescent dyes that can intercalate with double-stranded DNA, and modified DNA oligonucleotide probes that can fluoresce when hybridized with a complementary DNA.

In some embodiments of the disclosure, a sample containing genomic DNA obtained from the subject can be collected and PCR can used to amplify a fragment of nucleic acid that comprises one or more genetic variations that can be indicative of a susceptibility to a developmental disorder. In another embodiment, detection of genetic variations can be accomplished by expression analysis, for example, by using quantitative PCR. In some embodiments, this technique can assess the presence of an alteration in the expression or composition of one or more polypeptides or splicing variants encoded by a nucleic acid associated with a developmental disorder.

In a preferred embodiment, the DNA template of a sample from a subject containing a SNP can be amplified by PCR prior to detection with a probe. In such an embodiment, the amplified DNA serves as the template for a detection probe and, in some embodiments, an enhancer probe. Certain embodiments of the detection probe, the enhancer probe, and/or the primers used for amplification of the template by PCR can comprise the use of modified bases, for example, modified A, T, C, G, and U, wherein the use of modified bases can be useful for adjusting the melting temperature of the nucleotide probe and/or primer to the template DNA. In a preferred embodiment, modified bases are used in the design of the detection nucleotide probe. Any modified base known to the skilled person can be selected in these methods, and the selection of suitable bases is well within the scope of the skilled person based on the teachings herein and known bases available from commercial sources as known to the skilled person.

In some embodiments, identification of genetic variations can be accomplished using hybridization methods. The presence of a specific marker allele or a particular genomic segment comprising a genetic variation, or representative of a genetic variation, can be indicated by sequence-specific hybridization of a nucleic acid probe specific for the particular allele or the genetic variation in a nucleic acid containing sample that has or has not been amplified but methods described herein. The presence of more than one specific marker allele or several genetic variations can be indicated by using two or more sequence-specific nucleic acid probes, wherein each is specific for a particular allele and/or genetic variation.

Hybridization can be performed by methods well known to the person skilled in the art, for example, hybridization techniques such as fluorescent in situ hybridization (FISH), Southern analysis, Northern analysis, or in situ hybridization. In some embodiments, hybridization refers to specific hybridization, wherein hybridization can be performed with no mismatches. Specific hybridization, if present, can be using standard methods. In some embodiments, if specific hybridization occurs between a nucleic acid probe and the nucleic acid in the sample, the sample can contain a sequence that can be complementary to a nucleotide present in the nucleic acid probe. In some embodiments, if a nucleic acid probe can contain a particular allele of a polymorphic marker, or particular alleles for a plurality of markers, specific hybridization is indicative of the nucleic acid being completely complementary to the nucleic acid probe, including the particular alleles at polymorphic markers within the probe. In some embodiments a probe can contain more than one marker alleles of a particular haplotype, for example, a probe can contain alleles complementary to 2, 3, 4, 5 or all of the markers that make up a particular haplotype. In some embodiments detection of one or more particular markers of the haplotype in the sample is indicative that the source of the sample has the particular haplotype.

In some embodiments, PCR conditions and primers can be developed that amplify a product only when the variant allele is present or only when the wild type allele is present, for example, allele-specific PCR. In some embodiments of allele-specific PCR, a method utilizing a detection oligonucleotide probe comprising a fluorescent moiety or group at its 3' terminus and a quencher at its 5' terminus, and an enhancer oligonucleotide, can be employed, as described by Kutyavin et al. (Nucleic Acid Res. 34:e128 (2006)).

An allele-specific primer/probe can be an oligonucleotide that is specific for particular a polymorphism can be prepared using standard methods. In some embodiments, allele-specific oligonucleotide probes can specifically hybridize to a nucleic acid region that contains a genetic variation. In some embodiments, hybridization conditions can be selected such that a nucleic acid probe can specifically bind to the sequence of interest, for example, the variant nucleic acid sequence.

In some embodiments, allele-specific restriction digest analysis can be used to detect the existence of a polymorphic variant of a polymorphism, if alternate polymorphic variants of the polymorphism can result in the creation or elimination of a restriction site. Allele-specific restriction digests can be performed, for example, with the particular restriction enzyme that can differentiate the alleles. In some embodiments, PCR can be used to amplify a region comprising the polymorphic site, and restriction fragment length polymorphism analysis can be conducted. In some embodiments, for sequence variants that do not alter a common restriction site, mutagenic primers can be designed that can introduce one or more restriction sites when the variant allele is present or when the wild type allele is present.

In some embodiments, fluorescence polarization template-directed dye-terminator incorporation (FP-TDI) can be used to determine which of multiple polymorphic variants of a polymorphism can be present in a subject. Unlike the use of allele-specific probes or primers, this method can employ primers that can terminate adjacent to a polymorphic site, so that extension of the primer by a single nucleotide can result in incorporation of a nucleotide complementary to the polymorphic variant at the polymorphic site.

In some embodiments, DNA containing an amplified portion can be dot-blotted, using standard methods and the blot contacted with the oligonucleotide probe. The presence of specific hybridization of the probe to the DNA can then be detected. The methods can include determining the genotype of a subject with respect to both copies of the polymorphic site present in the genome, wherein if multiple polymorphic variants exist at a site, this can be appropriately indicated by specifying which variants are present in a subject. Any of the detection means described herein can be used to determine the genotype of a subject with respect to one or both copies of the polymorphism present in the subject's genome.

In some embodiments, a peptide nucleic acid (PNA) probe can be used in addition to, or instead of, a nucleic acid probe in the methods described herein. A PNA can be a DNA mimic having a peptide-like, inorganic backbone, for example, N-(2-aminoethyl) glycine units with an organic base (A, G, C, T or U) attached to the glycine nitrogen via a methylene carbonyl linker.

Nucleic acid sequence analysis can also be used to detect genetic variations, for example, genetic variations can be detected by sequencing exons, introns, 5' untranslated sequences, or 3' untranslated sequences. One or more methods of nucleic acid analysis that are available to those skilled in the art can be used to detect genetic variations, including but not limited to, direct manual sequencing, automated fluorescent sequencing, single-stranded conformation polymorphism assays (SSCP); clamped denaturing gel electrophoresis (CDGE); denaturing gradient gel electrophoresis (DGGE), two-dimensional gel electrophoresis (2DGE or TDGE); conformational sensitive gel electrophoresis (CSGE); denaturing high performance liquid chromatography (DHPLC), infrared matrix-assisted laser desorption/ionization (IR-MALDI) mass spectrometry, mobility shift analysis, quantitative real-time PCR, restriction enzyme analysis, heteroduplex analysis; chemical mismatch cleavage (CMC), RNase protection assays, use of polypeptides that recognize nucleotide mismatches, allele-specific PCR, real-time pyrophosphate DNA sequencing, PCR amplification in combination with denaturing high performance liquid chromatography (dHPLC), and combinations of such methods.

Sequencing can be accomplished through classic Sanger sequencing methods, which are known in the art. In a preferred embodiment sequencing can be performed using high-throughput sequencing methods some of which allow detection of a sequenced nucleotide immediately after or upon its incorporation into a growing strand, for example, detection of sequence in substantially real time or real time. In some cases, high throughput sequencing generates at least 1,000, at least 5,000, at least 10,000, at least 20,000, at least 30,000, at least 40,000, at least 50,000, at least 100,000 or at least 500,000 sequence reads per hour; with each read being at least 50, at least 60, at least 70, at least 80, at least 90, at least 100, at least 120 or at least 150 bases per read (or 500-1,000 bases per read for 454).

High-throughput sequencing methods can include but are not limited to, Massively Parallel Signature Sequencing (MPSS, Lynx Therapeutics), Polony sequencing, 454 pyrosequencing, Illumina (Solexa) sequencing, SOLiD sequencing, on semiconductor sequencing, DNA nanoball sequencing, Helioscope™ single molecule sequencing, Single Molecule SMRT™ sequencing, Single Molecule real time (RNAP) sequencing, Nanopore DNA sequencing, and/or sequencing by hybridization, for example, a non-enzymatic method that uses a DNA microarray, or microfluidic Sanger sequencing.

In some embodiments, high-throughput sequencing can involve the use of technology available by Helicos BioSciences Corporation (Cambridge, Mass.) such as the Single Molecule Sequencing by Synthesis (SMSS) method. SMSS is unique because it allows for sequencing the entire human genome in up to 24 hours. This fast sequencing method also allows for detection of a SNP/nucleotide in a sequence in substantially real time or real time. Finally, SMSS is powerful because, like the MIP technology, it does not use a pre-amplification step prior to hybridization. SMSS does not use any amplification. SMSS is described in US Publication Application Nos. 20060024711; 20060024678; 20060012793; 20060012784; and 20050100932. In some embodiments, high-throughput sequencing involves the use of technology available by 454 Life Sciences, Inc. (a Roche company, Branford, Conn.) such as the PicoTiterPlate device which includes a fiber optic plate that transmits chemiluminescent signal generated by the sequencing reaction to be recorded by a CCD camera in the instrument. This use of fiber optics allows for the detection of a minimum of 20 million base pairs in 4.5 hours.

In some embodiments, PCR-amplified single-strand nucleic acid can be hybridized to a primer and incubated with a polymerase, ATP sulfurylase, luciferase, apyrase, and the substrates luciferin and adenosine 5' phosphosulfate. Next, deoxynucleotide triphosphates corresponding to the bases A, C, G, and T (U) can be added sequentially. A base incorporation can be accompanied by release of pyrophosphate, which can be converted to ATP by sulfurylase, which can drive synthesis of oxyluciferin and the release of visible light. Since pyrophosphate release can be equimolar with the number of incorporated bases, the light given off can be proportional to the number of nucleotides adding in any one step. The process can repeat until the entire sequence can be determined. In some embodiments, pyrosequencing can be utilized to analyze amplicons to determine whether breakpoints are present. In another embodiment, pyrosequencing can map surrounding sequences as an internal quality control.

Pyrosequencing analysis methods are known in the art. Sequence analysis can include a four-color sequencing by ligation scheme (degenerate ligation), which involves hybridizing an anchor primer to one of four positions. Then an enzymatic ligation reaction of the anchor primer to a population of degenerate nonamers that are labeled with fluorescent dyes can be performed. At any given cycle, the population of nonamers that is used can be structured such that the identity of one of its positions can be correlated with the identity of the fluorophore attached to that nonamer. To the extent that the ligase discriminates for complementarity at that queried position, the fluorescent signal can allow the inference of the identity of the base. After performing the ligation and four-color imaging, the anchor primer: nonamer complexes can be stripped and a new cycle begins. Methods to image sequence information after performing ligation are known in the art.

In some embodiments, analysis by restriction enzyme digestion can be used to detect a particular genetic variation if the genetic variation results in creation or elimination of one or more restriction sites relative to a reference sequence. In some embodiments, restriction fragment length polymorphism (RFLP) analysis can be conducted, wherein the digestion pattern of the relevant DNA fragment indicates the presence or absence of the particular genetic variation in the sample.

In some embodiments, arrays of oligonucleotide probes that can be complementary to target nucleic acid sequence segments from a subject can be used to identify genetic variations. In some embodiments, an array of oligonucleotide probes comprises an oligonucleotide array, for example, a microarray. In some embodiments, the present disclosure features arrays that include a substrate having a plurality of addressable areas, and methods of using them. At least one area of the plurality includes a nucleic acid probe that binds specifically to a sequence comprising a genetic variation, and can be used to detect the absence or presence of said genetic variation, for example, one or more SNPs, microsatellites, or CNVs, as described herein, to determine or identify an allele or genotype. For example, the array can include one or more nucleic acid probes that can be used to detect a genetic variation such as those listed in Table 1. In some embodiments, the array can further comprise at least one area that includes a nucleic acid probe that can be used to specifically detect another marker associated with a developmental disorder, for example, ASD, as described herein.

Microarray hybridization can be performed by hybridizing a nucleic acid of interest; for example, a nucleic acid encompassing a genetic variation, with the array and detecting hybridization using nucleic acid probes. In some embodiments, the nucleic acid of interest is amplified prior to hybridization. Hybridization and detecting can be carried out according to standard methods described in Published PCT Applications: WO 92/10092 and WO 95/11995, and U.S. Pat. No. 5,424,186. For example, an array can be scanned to determine the position on the array to which the nucleic acid hybridizes. The hybridization data obtained from the scan can be, for example, in the form of fluorescence intensities as a function of location on the array.

Arrays can be formed on substrates fabricated with materials such as paper; glass; plastic, for example, polypropylene, nylon, or polystyrene; polyacrylamide; nitrocellulose; silicon; optical fiber; or any other suitable solid or semisolid support; and can be configured in a planar, for example, glass plates or silicon chips); or three dimensional, for example, pins, fibers, beads, particles, microtiter wells, and capillaries, configuration.

Methods for generating arrays are known in the art and can include for example; photolithographic methods (U.S. Pat. Nos. 5,143,854, 5,510,270 and 5,527,681); mechanical methods, for example, directed-flow methods (U.S. Pat. No. 5,384,261); pin-based methods (U.S. Pat. No. 5,288,514); bead-based techniques (PCT US/93/04145); solid phase oligonucleotide synthesis methods; or by other methods known to a person skilled in the art (see, e.g., Bier, F. F., et al. Adv Biochem Eng Biotechnol 109:433-53 (2008); Hoheisel, J. D., Nat Rev Genet. 7: 200-10 (2006); Fan, J. B., et al. Methods Enzymol 410:57-73 (2006); Raqoussis, J. & Elvidge, G., Expert Rev Mol Design 6: 145-52 (2006); Mockler, T. C., et al. Genomics 85: 1-15 (2005), and references cited therein, the entire teachings of each of which are incorporated by reference herein). Many additional descriptions of the preparation and use of oligonucleotide arrays for detection of polymorphisms can be found, for example, in U.S. Pat. Nos. 6,858,394, 6,429,027, 5,445,934, 5,700,637, 5,744,305, 5,945,334, 6,054,270, 6,300,063, 6,733,977, 7,364,858, EP 619 321, and EP 373 203, the entire teachings of which are incorporated by reference herein. Methods for array production, hybridization, and analysis are also described in Snjders et al., Nat. Genetics 29:263-264 (2001); Klein et al., Proc. Natl. Acad. Sci. USA 96:4494-4499 (1999); Albertson et al., Breast Cancer Research and Treatment 78:289-298 (2003); and Snijders et al., "BAC microarray based comparative genomic hybridization," in: Zhao et al. (eds), Bacterial Artificial Chromosomes: Methods and Protocols, Methods in Molecular Biology, Humana Press, 2002.

In some embodiments, oligonucleotide probes forming an array can be attached to a substrate by any number of techniques, including, but not limited to, in situ synthesis, for example, high-density oligonucleotide arrays, using photolithographic techniques; spotting/printing a medium to low density on glass, nylon, or nitrocellulose; by masking; and by dot-blotting on a nylon or nitrocellulose hybridization membrane. In some embodiments, oligonucleotides can be immobilized via a linker, including but not limited to, by covalent, ionic, or physical linkage. Linkers for immobilizing nucleic acids and polypeptides, including reversible or cleavable linkers, are known in the art (U.S. Pat. No. 5,451,683 and WO98/20019). In some embodiments, oligonucleotides can be non-covalently immobilized on a substrate by hybridization to anchors, by means of magnetic beads, or in a fluid phase, for example, in wells or capillaries.

An array can comprise oligonucleotide hybridization probes capable of specifically hybridizing to different genetic variations. In some embodiments, oligonucleotide arrays can comprise a plurality of different oligonucleotide probes coupled to a surface of a substrate in different known locations. In some embodiments, oligonucleotide probes can exhibit differential or selective binding to polymorphic sites, and can be readily designed by one of ordinary skill in the art, for example, an oligonucleotide that is perfectly complementary to a sequence that encompasses a polymorphic site, for example, a sequence that includes the polymorphic site, within it, or at one end, can hybridize preferentially to a nucleic acid comprising that sequence, as opposed to a nucleic acid comprising an alternate polymorphic variant.

In some embodiments, arrays can include multiple detection blocks, for example, multiple groups of probes designed for detection of particular polymorphisms. In some embodiments, these arrays can be used to analyze multiple different polymorphisms. In some embodiments, detection blocks can be grouped within a single array or in multiple, separate arrays, wherein varying conditions, for example, conditions optimized for particular polymorphisms, can be used during hybridization. General descriptions of using oligonucleotide arrays for detection of polymorphisms can be found, for example, in U.S. Pat. Nos. 5,858,659 and 5,837,832. In addition to oligonucleotide arrays, cDNA arrays can be used similarly in certain embodiments.

The methods described herein can include but are not limited to providing an array as described herein; contacting the array with a sample, and detecting binding of a nucleic acid from the sample to the array. In some embodiments, the method can comprise amplifying nucleic acid from the sample, for example, a region associated with a developmental disorder or a region that includes another region associated with a developmental disorder. In some embodiments, the methods described herein can include using an array that can identify differential expression patterns or copy numbers of one or more genes in samples from control and affected individuals. For example, arrays of probes to a marker described herein can be used to identify genetic variations between DNA from an affected subject, and control DNA obtained from an individual that does not have a developmental disorder. Since the nucleotides on the array can contain sequence tags, their positions on the array can be accurately known relative to the genomic sequence.

In some embodiments, it can be desirable to employ methods that can detect the presence of multiple genetic variations, for example, polymorphic variants at a plurality of polymorphic sites, in parallel or substantially simultaneously. In some embodiments, these methods can comprise oligonucleotide arrays and other methods, including methods in which reactions, for example, amplification and hybridization, can be performed in individual vessels, for example, within individual wells of a multi-well plate or other vessel.

Determining the identity of a genetic variation can also include or consist of reviewing a subject's medical history, where the medical history includes information regarding the identity, copy number, presence or absence of one or more alleles or SNPs in the subject, e.g., results of a genetic test.

In some embodiments extended runs of homozygosity (ROH) may be useful to map recessive disease genes in outbred populations. Furthermore, even in complex disorders, a high number of affected individuals may have the same haplotype in the region surrounding a disease mutation. Therefore, a rare pathogenic variant and surrounding haplotype can be enriched in frequency in a group of affected individuals compared with the haplotype frequency in a cohort of unaffected controls. Homozygous haplotypes (HH) that are shared by multiple affected individuals can be important for the discovery of recessive disease genes in complex disorders such as ASD. In some embodiments, the traditional homozygosity mapping method can be extended by analysing the haplotype within shared ROH regions to identify homozygous segments of identical haplotype that are present uniquely or at a higher frequency in ASD probands compared to parental controls. Such regions are termed risk homozygous haplotypes (rHH), which may contain low-frequency recessive variants that contribute to ASD risk in a subset of ASD patients.

Genetic variations can also be identified using any of a number of methods well known in the art. For example, genetic variations available in public databases, which can be searched using methods and custom algorithms or algorithms known in the art, can be used. In some embodiments, a reference sequence can be from, for example, the human draft genome sequence, publicly available in various databases, or a sequence deposited in a database such as GenBank.

Methods of Detecting CNVs

Detection of genetic variations, specifically CNVs, can be accomplished by one or more suitable techniques described herein. Generally, techniques that can selectively determine whether a particular chromosomal segment is present or absent in an individual can be used for genotyping CNVs. Identification of novel copy number variations can be done by methods for assessing genomic copy number changes.

In some embodiments, methods include but are not limited to, methods that can quantitatively estimate the number of copies of a particular genomic segment, but can also include methods that indicate whether a particular segment is present in a sample or not. In some embodiments, the technique to be used can quantify the amount of segment present, for example, determining whether a DNA segment is deleted, duplicated, or triplicated in subject, for example, Fluorescent In Situ Hybridization (FISH) techniques, and other methods described herein. In some embodiments, methods include detection of copy number variation from array intensity and sequencing read depth using a stepwise Bayesian model (Zhang Z. D., et al. BMC Bioinformatics. 2010 Oct. 31; 11:539). In some embodiments, methods include detecting copy number variations using shotgun sequencing, CNV-seq (Xie C., et al. BMC Bioinformatics. 2009 Mar. 6; 10:80). In some embodiments, methods include analyzing next-generation sequencing (NGS) data for CNV detection using any one of several algorithms developed for each of the four broad methods for CNV detection using NGS, namely the depth of coverage (DOC), read-pair (RP), split-read (SR) and assembly-based (AS) methods. (Teo S. M., et al. Bioinformatics. 2012 Aug. 31). In some embodiments, methods include combining coverage with map information for the identification of deletions and duplications in targeted sequence data (Nord A. S., et al. BMC Genomics. 2011 Apr. 12; 12:184).

In some embodiments, other genotyping technologies can be used for detection of CNVs, including but not limited to, karyotype analysis, Molecular Inversion Probe array technology, for example, Affymetrix SNP Array 6.0, and BeadArray Technologies, for example, Illumina GoldenGate and Infinium assays, as can other platforms such as NimbleGen HD2.1 or HD4.2, High-Definition Comparative Genomic Hybridization (CGH) arrays (Agilent Technologies), tiling array technology (Affymetrix), multiplex ligation-dependent probe amplification (MLPA), Invader assay, fluorescence in situ hybridization, and, in one preferred embodiment, Array Comparative Genomic Hybridization (aCGH) methods. As described herein, karyotype analysis can be a method to determine the content and structure of chromosomes in a sample. In some embodiments, karyotyping can be used, in lieu of aCGH, to detect translocations, which can be copy number neutral, and, therefore, not detecTable by aCGH. Information about amplitude of particular probes, which can be representative of particular alleles, can provide quantitative dosage information for the particular allele, and by consequence, dosage information about the CNV in question, since the marker can be selected as a marker representative of the CNV and can be located within the CNV. In some embodiments, if the CNV is a deletion, the absence of particular marker allele is representative of the deletion. In some embodiments, if the CNV is a duplication or a higher order copy number variation, the signal intensity representative of the allele correlating with the CNV can represent the copy number. A summary of methodologies commonly used is provided in Perkel (Perkel J Nature Methods 5:447-453 (2008)).

PCR assays can be utilized to detect CNVs and can provide an alternative to array analysis. In particular, PCR assays can enable detection of precise boundaries of gene/chromosome variants, at the molecular level, and which boundaries are identical in different individuals. PCR assays can be based on the amplification of a junction fragment present only in individuals that carry a deletion. This assay can convert the detection of a loss by array CGH to one of a gain by PCR.

Examples of PCR techniques that can be used in the present invention include, but are not limited to quantitative PCR, real-time quantitative PCR (qPCR), quantitative fluorescent PCR (QF-PCR), multiplex fluorescent PCR (MF-PCR), real time PCR(RT-PCR), single cell PCR, PCR-RFLP/RT-PCR-RFLP, hot start PCR and Nested PCR. Other suitable amplification methods include the ligase chain reaction (LCR), ligation mediated PCR (LM-PCR), degenerate oligonucleotide probe PCR (DOP-PCR), transcription amplification, self-sustained sequence replication, selective amplification of target polynucleotide sequences, consensus sequence primed polymerase chain reaction (CP-PCR), arbitrarily primed polymerase chain reaction (AP-PCR) and nucleic acid based sequence amplification (NABSA).

Alternative methods for the simultaneous interrogation of multiple regions include quantitative multiplex PCR of short fluorescent fragments (QMPSF), multiplex amplifiable probe hybridization (MAPH) and multiplex ligation-dependent probe amplification (MLPA), in which copy-number differences for up to 40 regions can be scored in one experiment. Another approach can be to specifically target regions that harbor known segmental duplications, which are often sites of copy-number variation. By targeting the variable nucleotides between two copies of a segmental duplication (called paralogous sequence variants) using a SNP-genotyping method that provides independent fluorescence intensities for the two alleles, it is possible to detect an increase in intensity of one allele compared with the other.

In another embodiment, the amplified piece of DNA can be bound to beads using the sequencing element of the nucleic acid tag under conditions that favor a single amplified piece of DNA molecule to bind a different bead and amplification occurs on each bead. In some embodiments, such amplification can occur by PCR. Each bead can be placed in a separate well, which can be a picoliter-sized well. In some embodiments, each bead is captured within a droplet of a PCR-reaction-mixture-in-oil-emulsion and PCR amplification occurs within each droplet. The amplification on the bead results in each bead carrying at least one million, at least 5 million, or at least 10 million copies of the single amplified piece of DNA molecule.

In embodiments where PCR occurs in oil-emulsion mixtures, the emulsion droplets are broken, the DNA is denatured and the beads carrying single-stranded nucleic acids clones are deposited into a well, such as a picoliter-sized well, for further analysis according to the methods described herein. These amplification methods allow for the analysis of genomic DNA regions. Methods for using bead amplification followed by fiber optics detection are described in Margulies et al. 2005, Nature. 15; 437(7057):376-80, and as well as in US Publication Application Nos. 20020012930; 20030068629; 20030100102; 20030148344; 20040248161; 20050079510, 20050124022; and 20060078909.

Another variation on the array-based approach can be to use the hybridization signal intensities that are obtained from the oligonucleotides employed on Affymetrix SNP arrays or in Illumina Bead Arrays. Here hybridization intensities are compared with average values that are derived from controls, such that deviations from these averages indicate a change in copy number. As well as providing information about copy number, SNP arrays have the added advantage of providing genotype information. For example, they can reveal loss of heterozygosity, which could provide supporting evidence for the presence of a deletion, or might indicate segmental uniparental disomy (which can recapitulate the effects of structural variation in some genomic regions—Prader-Willi and Angelman syndromes, for example).

Many of the basic procedures followed in microarray-based genome profiling are similar, if not identical, to those followed in expression profiling and SNP analysis, including the use of specialized microarray equipment and data-analysis tools. Since microarray-based expression profiling has been well established in the last decade, much can be learned from the technical advances made in this area. Examples of the use of microarrays in nucleic acid analysis that can be used are described in U.S. Pat. Nos. 6,300,063, 5,837,832, 6,969,589, 6,040,138, 6,858,412, U.S. application Ser. Nos. 08/529,115, 10/272,384, 10/045,575, 10/264, 571 and 10/264,574. It should be noted that there are also distinct differences such as target and probe complexity, stability of DNA over RNA, the presence of repetitive DNA and the need to identify single copy number alterations in genome profiling.

In a preferred embodiment, the genetic variations detected comprise CNVs and can be detected using array CGH. In some embodiments, array CGH can be been implemented using a wide variety of techniques. The initial approaches used arrays produced from large-insert genomic clones such as bacterial artificial chromosomes (BACs). Producing sufficient BAC DNA of adequate purity to make arrays is arduous, so several techniques to amplify small amounts of starting material have been employed. These techniques include ligation-mediated PCR (Snijders et al, Nat. Genet. 29:263-64), degenerate primer PCR using one or several sets of primers, and rolling circle amplification. BAC arrays that provide complete genome tiling paths are also available. Arrays made from less complex nucleic acids such as cDNAs, selected PCR products, and oligonucleotides can also be used. Although most CGH procedures employ hybridization with total genomic DNA, it is possible to use reduced complexity representations of the genome produced by PCR techniques. Computational analysis of the genome sequence can be used to design array elements complementary to the sequences contained in the representation. Various SNP genotyping platforms, some of which use reduced complexity genomic representations, can be useful for their ability to determine both DNA copy number and allelic content across the genome. In some embodiments, small amounts of genomic DNA can be amplified with a variety of whole genome amplification methods prior to CGH analysis of the sample.

The different basic approaches to array CGH provide different levels of performance, so some are more suitable for particular applications than others. The factors that determine performance include the magnitudes of the copy number changes, their genomic extents, the state and composition of the specimen, how much material is available for analysis, and how the results of the analysis can be used. Many applications use reliable detection of copy number changes of much less than 50%, a more stringent requirement than for other microarray technologies. Note that technical details are extremely important and different implementations of methods using the same array CGH approach can yield different levels of performance. Various CGH methods are known in the art and are equally applicable to one or more methods of the present invention. For example, CGH methods are disclosed in U.S. Pat. Nos. 7,034,144; 7,030,231; 7,011,949; 7,014,997; 6,977,148; 6,951,761; and 6,916,621, the disclosure from each of which is incorporated by reference herein in its entirety.

The data provided by array CGH are quantitative measures of DNA sequence dosage. Array CGH provides high-resolution estimates of copy number aberrations, and can be performed efficiently on many samples. The advent of array CGH technology makes it possible to monitor DNA copy number changes on a genomic scale and many projects have been launched for studying the genome in specific diseases.

In a preferred embodiment, whole genome array-based comparative genome hybridization (array CGH) analysis, or array CGH on a subset of genomic regions, can be used to efficiently interrogate human genomes for genomic imbalances at multiple loci within a single assay. The development of comparative genomic hybridization (CGH) (Kallioniemi et al, 1992, Science 258: 818-21) provided the first efficient approach to scanning entire genomes for variations in DNA copy number. The importance of normal copy number variation involving large segments of DNA has been unappreciated. Array CGH is a breakthrough technique in human genetics, which is attracting interest from clinicians working in fields as diverse as cancer and IVF (In Vitro Fertilization). The use of CGH microarrays in the clinic holds great promise for identifying regions of genomic imbalance associated with disease. Advances from identifying chromosomal critical regions associated with specific phenotypes to identifying the specific dosage sensitive genes can lead to therapeutic opportunities of benefit to patients. Array CGH is a specific, sensitive and rapid technique that can enable the screening of the whole genome in a single test. It can facilitate and accelerate the screening process in human genetics and is expected to have a profound impact on the screening and counseling of patients with genetic disorders. It is now possible to identify the exact location on the chromosome where an aberration has occurred and it is possible to map these changes directly onto the genomic sequence.

An array CGH approach provides a robust method for carrying out a genome-wide scan to find novel copy number variants (CNVs). The array CGH methods can use labeled fragments from a genome of interest, which can be competitively hybridized with a second differentially labeled genome to arrays that are spotted with cloned DNA fragments, revealing copy-number differences between the two genomes. Genomic clones (for example, BACs), cDNAs, PCR products and oligonucleotides, can all be used as array targets. The use of array CGH with BACs was one of the earliest employed methods and is popular, owing to the extensive coverage of the genome it provides, the availability of reliable mapping data and ready access to clones. The last of these factors is important both for the array experiments themselves, and for confirmatory FISH experiments.

In a typical CGH measurement, total genomic DNA is isolated from control and reference subjects, differentially labeled, and hybridized to a representation of the genome that allows the binding of sequences at different genomic locations to be distinguished. More than two genomes can be compared simultaneously with suitable labels. Hybridization of highly repetitive sequences is typically suppressed by the inclusion of unlabeled Cot-1 DNA in the reaction. In some embodiments of array CGH, it is beneficial to mechanically shear the genomic DNA sample, for example, with sonication, prior to its labeling and hybridization step. In another embodiment, array CGH may be performed without use of Cot-1 DNA or a sonication step in the preparation of the genomic DNA sample. The relative hybridization intensity of the test and reference signals at a given location can be proportional to the relative copy number of those sequences in the test and reference genomes. If the reference genome is normal then increases and decreases in signal intensity ratios directly indicate DNA copy number variation within the genome of the test cells. Data are typically normalized so that the modal ratio for the genome is set to some standard value, typically 1.0 on a linear scale or 0.0 on a logarithmic scale. Additional measurements such as FISH or flow cytometry can be used to determine the actual copy number associated with a ratio level.

In some embodiments, an array CGH procedure can include the following steps. First, large-insert clones, for example, BACs can be obtained from a supplier of clone libraries. Then, small amounts of clone DNA can be amplified, for example, by degenerate oligonucleotide-primed (DOP) PCR or ligation-mediated PCR in order to obtain sufficient quantities needed for spotting. Next, PCR products can be spotted onto glass slides using, for example, microarray robots equipped with high-precision printing pins. Depending on the number of clones to be spotted and the space available on the microarray slide, clones can either be spotted once per array or in replicate. Repeated spotting of the same clone on an array can increase precision of the measurements if the spot intensities are averaged, and allows for a detailed statistical analysis of the quality of the experiments. Subject and control DNAs can be labeled, for example, with either Cy3 or Cy5-dUTP using random priming and can be subsequently hybridized onto the microarray in a solution containing an excess of Cot1-DNA to block repetitive sequences. Hybridizations can either be performed manually under a coverslip, in a gasket with gentle rocking or, automatically using commercially available hybridization stations. These automated hybridization stations can allow for an active hybridization process, thereby improving the reproducibility as well as reducing the actual hybridization time, which increases throughput. The hybridized DNAs can detected through the two different fluorochromes using standard microarray scanning equipment with either a scanning confocal laser or a charge coupled device (CCD) camera-based reader, followed by spot identification using commercially or freely available software packages.

The use of CGH with arrays that comprise long oligonucleotides (60-100 bp) can improve the detection resolution (in some embodiments, as small as ~3-5 kb sized CNVs on arrays designed for interrogation of human whole genomes) over that achieved using BACs (limited to 50-100 kb or larger sized CNVs due to the large size of BAC clones). In some embodiments, the resolution of oligonucleotide CGH arrays is achieved via in situ synthesis of 1-2 million unique features/probes per microarray, which can include microarrays available from Roche NimbleGen and Agilent Technologies. In addition to array CGH methods for copy number detecton, other embodiments for partial or whole genome analysis of CNVs within a genome include, but are not limited to, use of SNP genotyping microarrays and sequencing methods.

Another method for copy number detection that uses oligonucleotides can be representational oligonucleotide microarray analysis (ROMA). It is similar to that applied in the use of BAC and CGH arrays, but to increase the signal-to-noise ratio, the 'complexity' of the input DNA is reduced by a method called representation or whole-genome sampling. Here, the DNA that is to be hybridized to the array can be treated by restriction digestion and then ligated to adapters, which results in the PCR-based amplification of fragments in a specific size-range. As a result, the amplified DNA can make up a fraction of the entire genomic sequence—that is, it is a representation of the input DNA that has significantly reduced complexity, which can lead to a reduction in background noise. Other suitable methods available to the skilled person can also be used, and are within scope of the present disclosure.

A comparison of one or more genomes relative to one or more other genomes with array CGH, or a variety of other CNV detection methods, can reveal the set of CNVs between two genomes, between one genome in comparison to multiple genomes, or between one set of genomes in comparison to another set of genomes. In some embodiments, an array CGH experiment can be performed by hybridizing a single test genome against a pooled sample of two or more genomes, which can result in minimizing the detection of higher frequency variants in the experiment. In some embodiments, a test genome can be hybridized alone (i.e., one-color detetion) to a microarray, for example, using array CGH or SNP genotyping methods, and the comparison step to one or more reference genomes can be performed in silico to reveal the set of CNVs in the test genome relative to the one or more reference genomes. In one preferred embodiment, a single test genome is compared to a single reference genome in a 2-color experiment wherein both genomes are cohybridized to the microarray.

Array CGH can be used to identify genes that are causative or associated with a particular phenotype, condition, or disease by comparing the set of CNVs found in the affected cohort to the set of CNVs found in an unaffected cohort. An unaffected cohort may consist of any individual unaffected by the phenotype, condition, or disease of interest, but in one preferred embodiment is comprised of individuals or subjects that are apparently healthy (normal). Methods employed for such analyses are described in U.S. Pat. Nos. 7,702,468 and 7,957,913. In some embodiments of CNV comparison methods, candidate genes that are causative or associated (i.e., potentially serving as a biomarker) with a phenotype, condition, or disease will be identified by CNVs that occur in the affected cohort but not in the unaffected cohort. In some embodiments of CNV comparison methods, candidate genes that are causative or associated (i.e., potentially serving as a biomarker) with a phenotype, condition, or disease will be identified by CNVs that occur at a statistically significant higher frequency in the affected cohort as compared their frequency in the unaffected cohort. Thus, CNVs preferentially detected in the affected cohort as compared to the unaffected cohort can serve as beacons of genes that are causative or associated with a particular phenotype, condition, or disease. In some embodiments, CNV detection and comparison methods can result in direct identification of the gene that is causative or associated with phenotype, condition, or disease if the CNVs are found to overlap with or encompass the gene(s). In some embodiments, CNV detection and comparison methods can result in identification of regulatory regions of the genome (e.g., promoters, enhancers, transcription factor binding sites) that regulate the expression of one or more genes that are causative or associated with the phenotype, condition, or disease of interest.

Due to the large amount of genetic variation between any two genomes, or two sets (cohorts) of genomes, being compared, one preferred embodiment is to reduce the genetic variation search space by interrogating only CNVs, as opposed to the full set of genetic variants that can be identified in an individual's genome or exome. The set of CNVs that occur only, or at a statistically higher frequency, in the affected cohort as compared to the unaffected cohort can then be further investigated in targeted sequencing experiments to reveal the full set of genetic variants (of any size or type) that are causative or associated (i.e., potentially serving as a biomarker) with a phenotype, condition, or disease. It can be appreciated to those skilled in the art that the targeted sequencing experiments are performed in both the affected and unaffected cohorts in order to identify the genetic variants (e.g., SNVs and indels) that occur only, or at a statistically significant higher frequency, in the affected individual or cohort as compared to the unaffected cohort.

When investigating a particular phenotype, condition, or disease, such as ASD, it can be appreciated by those skilled in the art that the number of ASD candidate genes (or regulatory sequences) identified via CNV (or other variant types) detection methods may increase or decrease when additional ASD cohorts are analyzed. Similarly, the number of ASD candidate genes (or regulatory sequences), for example, identified via CNV (or other variant types) detection methods may increase or decrease when additional unaffected cohorts are used to interpret the affected cohort CNVs (or other variat types). For very rare CNVs (e.g., <0.1% frequency in the general population), only a single case may be observed in a given ASD cohort (e.g., 100 cases) but further statistical significance or evidence for the gene (or regulatory sequence/locus in the genome) can be established by: 1) CNV analysis of additional ASD cohorts, 2) CNV analysis of additional Normal cohorts, 3) targeted gene sequencing of both ASD and Normal cohorts, and/or 4) functional characterization of the ASD candidate gene (e.g., in silico analysis of the predicted impact of the candidate mutation on the gene product, RNAi knockdown experiments, biochemical assays on ASD patient tissue, gene expression analysis of disease-relevant tissues or of induced pluripotent stem cells (iPSCs) created from the ASD patient (s) harboring the candidate ASD-causing genetic variant).

It can be appreciated by those skilled in the art that a candidate gene may validate as causative of the phenotype, condition, or disease (e.g., ASD), which may, for example, be confirmed via mechansism of action experiments, or it may serve as a biomarker of the phenotype, condition, or disease. Thus, in the example of ASD, in some embodiments, the ASD-specific gene (or regulatory sequence/locus) may be a biomarker of age-of-onset for ASD and disease severity, and thus have diagnostic utility for monitoring patients known to be at risk for ASD or as a general screening test in the population for early diagnosis of the disease. In some embodiments, the ASD-specific gene/biomarker may be an indicator of drug response (e.g., a particular subtype of ASD may respond best to a therapeutic targeting a particular phenotype, causative gene, or other gene in the same pathway as the causative gene) and thus have utility during drug development in clinical trials. For example, clinical trials for a therapeutic that targets a ASD genetic subtype comprising only 10% of all patients exhibiting symptoms of ASD, can be designed to comprise only those 10% of patients with a specific genotype(s) in order to reduce the time and cost of such clinical trials (e.g., smaller number of patients in the clinical trial). It can be appreciated by those skilled in the art that such patient stratification methods (i.e., specific genotypes correlated with the disease or drug response) can be employed not only for targeted therapeutics, but in general for any drug that is approved or in development (i.e., the mechanism of action may or may not be known). For example, drugs in development or approved to treat, for example, cancer, may have utility in being repurposed to treat ASD. Such patient stratification methods can also be utilized to develop a companion diagnostic test (e.g., comprising the specific genes/genotypes found in patients that are indicative of drug response) for a particular drug, either concurrently during the clinical trials for the drug or after drug approval (e.g., as a new indication or for the physician to use in guiding medical decisions for the patient).

Further neurodevelopmental and/or links to ASD pathology can be established via pathway analysis of the genes, which may take into consideration binding interactions (e.g., via yeast 2-hybrid screen) and molecular events (e.g., kinase activity or other enzymatic processes) if such information is available for the gene(s) of interest (i.e., specified in the analysis). Both commercial (e.g., Ingenuity's IPA software and Thomson Reuter's GeneGo software) and open source software (e.g., String: string-db.org/) are available for such analyses. To assess connections to established ASD biology, analyses can be performed for the set of candidate ASD genes independently or against known causative ASD genes singly or as a group. In some embodiments, ASD candidate genes can be distributed into categories such as: 1) genes with neuroprotective function, 2) neuropsychiatric genes, some of which may be known drug targets 3) genes linked to a known causative ASD gene (e.g., binding partner) or a novel gene family member of a known ASD gene, 4) genes linked to neurodevelopmental regulation, neurogenesis, and G-protein signaling pathways, and 5) other (e.g., established role in other diseases with no obvious neurodevelopmental biology, such as cancer) or unknown gene function (e.g., limited or no gene information presently annotated for the ASD-specific gene).

A method of screening a subject for a disease or disorder can comprise assaying a nucleic acid sample from the subject to detect sequence information for more than one genetic locus and comparing the sequence information to a panel of nucleic acid biomarkers and screening the subject for the presence or absence of the disease or disorder if one or more of low frequency biomarkers in the panel are present in the sequence information.

The panel can comprise at least one nucleic acid biomarker for each of the more than one genetic loci. For example, the panel can comprise 2, 3, 4, 5, 6, 7, 8, 9, 10, 11, 12, 3, 14, 15, 15, 17, 18, 19, 20, 25, 30, 35, 40, 45, 50, 75, 100, 150, 200 or more nucleic acid biomarkers for each of the more than one genetic loci. In some embodiments, the panel can comprise from about 2-1000 nucleic acid biomarkers. For example, the panel can comprise from about 2-900, 2-800, 2-700, 2-600, 2-500, 2-400, 2-300, 2-200, 2-100, 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000 nucleic acid biomarkers.

The panel can comprise at least 2 low frequency biomarkers. For example, the panel can comprise at least 2, 3, 4, 5, 6, 7, 8, 9, 10, 11, 12, 3, 14, 15, 15, 17, 18, 19, 20, 25, 30, 35, 40, 45, 50, 75, 100, 150, 200, 250, 500, or 1000 or more low frequency biomarkers. In some embodiments, the panel can comprise from about 2-1000 low frequency biomarkers. For example, the panel can comprise from about 2-900, 2-800, 2-700, 2-600, 2-500, 2-400, 2-300, 2-200, 2-100, 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000 1000 low frequency biomarkers. In some embodiments, a low frequency biomarker can occur at a frequency of 0.1% or less in a population of subjects without a diagnosis of the disease or disorder. For example, a low frequency biomarker can occur at a frequency of 0.05%, 0.01%, 0.005%, 0.001%, 0.0005%, 0.0001%, 0.00005%, or 0.00001% or less in a population of subjects without a diagnosis of the disease or disorder. In some embodiments, a low frequency biomarker can occur at a frequency from about 0.00001%-0.1% in a population of subjects without a diagnosis of the disease or disorder. For example, a low frequency biomarker can occur at a frequency of from about 0.00001%-0.00005%, 0.00001%-0.0001%, 0.00001%-0.0005%, 0.00001%-0.001%, 0.00001%-0.005%, 0.00001%-0.01%, 0.00001%-0.05%, 0.00005%-0.0001%, 0.00005%-0.0005%, 0.00005%-0.001%, 0.00005%-0.005%, 0.00005%-0.01%, 0.00005%-0.05%, 0.00005%-0.1%, 0.0001%-0.0005%, 0.0001%-0.001%, 0.0001%-0.005%, 0.0001%-0.01%, 0.0001%-0.05%, 0.0001%-0.1%, 0.0005%-0.001%, 0.0005%-0.005%, 0.0005%-0.01%, 0.0005%-0.05%, 0.0005%-0.1%, 0.001%-0.005%, 0.001%-0.01%, 0.001%-0.05%, 0.001%-0.1%, 0.005%-0.01%, 0.005%-0.05%, 0.005%-0.1%, 0.01%-0.05%, 0.01%-0.1%, or 0.05%-0.1% in a population of subjects without a diagnosis of the disease or disorder In some embodiments, the presence or absence of the disease or disorder in the subject can be determined with at least 50% confidence. For example, the presence or absence of the disease or disorder in the subject can be determined with at least 50%, 55%, 60%, 65%, 70%, 75%, 80%, 85%, 90%, 95%, 98%, 99%, or 100% confidence. In some embodiments, the presence or absence of the disease or disorder in the subject can be determined with a 50%-100% confidence. For example, the presence or absence of the disease or disorder in the subject can be determined with a 60%-100%, 70%-100%, 80%-100%, 90%-100%, 50%-90%, 50%-80%, 50%-70%, 50%-60%, 60%-90%, 60%-80%, 60%-70%, 70%-90%, 70%-80%, or 80%-90%. In one embodiment, ASD candidate CNVs and genes or regulatory loci associated with these CNVs can be determined or identified by comparing genetic data from a cohort of normal individuals to that of an individual or a cohort of individuals known to have, or be susceptible to a developmental disorder such as ASD.

In some embodiments, a genomic DNA sample from one individual or genomic samples from a pool of two or more individuals without ASD can serve as as the reference genome(s) and the genomic DNA sample from an individual known to have ASD or being tested to determine if they have ASD can serve as the test DNA. In one preferred embodiment, the reference and test samples are sex-matched and co-hybridized on the CGH array. For example, reference DNA samples can be labeled with a fluorophore such as Cy5, using methods described herein, and test subject DNA samples can be labeled with a different fluorophore, such as Cy3. After labeling, samples can be combined and can be co-hybridized to a microarray and analyzed using any of the methods described herein, such as aCGH. Arrays can then be scanned and the data can be analyzed with software. Genetic alterations, such as CNVs, can be called using any of the methods described herein. A list of the genetic alterations, such as CNVs, can be generated for one or more test subjects and/or for one or more reference subjects. Such lists of CNVs can be used to generate a master list of non-redundant CNVs for each type of cohort. In one embodiment, a cohort of test samples, such as individuals known to have or suspected to have ASD, can be cohybridized with an identical sex-matched reference individual or sex-matched pool of reference individuals to generate a list of redundant or non-redundant CNVs. Such lists can be based on the presence or absence of one or more CNVs present in individuals within the cohort. In this manner, a master list can contain a number of distinct CNVs, some of which are uniquely present in a single individual and some of which are present in multiple individuals.

In some embodiments, CNVs of interest can be obtained by annotation of each CNV with relevant information, such as overlap with known genes and/or exons or intergenic regulatory regions such as transcription factor binding sites.

In some embodiments, CNVs of interest can be obtained by calculating the OR for a CNV according to the following formula: OR=(ASD/((# individuals in ASD cohort)−ASD))/(Normal/((# individuals in Normal cohort)−Normal)), where: ASD=number of ASD individuals with a CNV of interest and Normal=number of Normal individuals with the CNV of interest. If Normal=0, it can be set to 1 to avoid dealing with infinities in cases where no CNVs are seen in the Normal cohort. In some embodiments, a set of publicly available CNVs (e.g., the Database of Genomic Variants, http://projects.tcag.ca/variation/) can be used as the Normal cohort for comparison to the affected cohort CNVs. In another embodiment, the set of Normal cohort CNVs may comprise a private database generated by the same CNV detection method, such as array CGH, or by a plurality of CNV detection methods that include, but are not limited to, array CGH, SNP genotyping arrays, custom CGH arrays, custom genotyping arrays, exome sequencing, whole genome sequencing, targeted sequencing, FISH, q-PCR, or MLPA.

The number of individuals in any given cohort can be at least about 10, 50, 100, 200, 300, 400, 500, 600, 700, 800, 900, 1000, 2500, 5000, 7500, 10,000, 100,000, or more. In some embodiments, the number of individuals in any given cohort can be from 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000.

Different categories for CNVs of interest can be defined. In some embodiments, CNVs can be of interest if the CNVs are rare in the general population or in a cohort of individuals without the disease or condition of interest. In another embodiment, CNVs can be of interest if they are found only in those affected by a disease or condition and not in those without the disease or condition. In another embodiment, CNVs can be of interest if they are found at much greater frequency in those affected by the disease or condition as compared to those without the disease or condition.

The data presented in Tables 1 and 2 was generated on the basis of a comparison of copy number variants (CNVs) identified in an ASD cohort. CNV genome locations are provided using the Human March 2006 (NCBI36/hg18) assembly. It can be appreciated by those skilled in the art that a CNV found in an affected individual may have one or more CNVs that are preferentially found in the affected cohort as compared to the unaffected cohort and, similarly, other CNVs that are found at comparable frequencies, or not statistically significant different frequencies, in the affected and unaffected cohorts. In a preferred embodiment, CNV detection and analysis methods are employed that enable comparison of CNVs to facilitate identification of genes (or regulatory loci) that are causative or associated with the phenotype, condition, or disease being investigated (or detected for diagnostic purposes). In Table 1, SEQ IDs 1-76 refer to the CNV sequences (full sequence obtained for the whole CNV). In Table 2, SEQ IDs 77-209 refer to the genomic sequences over which the relevant transcripts extend (full genomic extent of the transcripts, not just the short sequence associated with the mRNA).

Table 1 shows a list of the novel, rare identified CNVs affecting genes that could play a role in neurodevelopment.

Table 1 shows a list of all CNVs of interest (76 total), obtained as described in Example 1. Column 1 refers to the SEQ ID in the sequence file 121009_ASD_SK.txt. Column 2 refers to the Hospital ID of the patient in whom the CNV was discovered. Column 3 refers to the chromosome location of the CNV. Column 4 refers to the nucleotide position in the respective chromosome (column 3) where the corresponding CNV begins and column 5 refers to the nucleotide position in the respective chromosome where the corresponding CNV ends. Column 6 refers to the length/size of the CNV in bps. Column 7 refers to the chromosomal cytoband location. The CNV classifications (column 8) of gain or loss indicate whether each CNV region found in the subjects was duplicated/amplified (gain) or deleted (loss) in the genome. Column 9 refers to whether or not the CNV has been validated by qPCR. Column 10 refers to the CNV priority number.

Nucleotide positions were determined using the database Hg18 Mar. 2006 (NCBI Build 36.1). The CNVs in Table 1 were detected using Agilent 1M array on the ASD cohort but were assessed as not being present in any normal subjects analyzed on SNP genotyping platforms or not overlapping with CNVs present in the Database of Genomic Variants (http://projects.tcag.ca/variation/). Most of these CNVs have been experimentally validated by quantitative PCR (qPCR) and their segregation in the families was tested. All of the probands met the criteria for autism on one or both screening measures-Autism Diagnostic Interview-Revised (ADI-R) training and Autism Diagnostic Observation Schedule (ADOS) training. For the control cohorts analyzed for CNVs using SNP genotyping arrays, the control population from the Study on Addiction: Genetics and Environment (SAGE) had no psychiatric history and the other two control sets from an Ottawa Heart Institute (OHI) study and a PopGen study had no information on psychiatric history. The total number of controls from these cohorts (SAGE, OHI, PopGen), which were used as one assessment to determine if a CNV found in one or more individuals with ASD is rare or not present in the general population, was 4,139 individuals.

Table 2 shows a list of the gene biomarkers associated with the respective CNVs identified in Table 1. Column 1 refers to the number of distinct genes overlapped by the CNV. Column 2 refers to the names of genes affected by, impacted by, or within the CNV. Column 3 refers to the SEQ ID of the genomic sequence, including intragenic and exonic regions, in the sequence file 121009_ASD_SK.txt. Column 4 refers to accession information for transcripts found within the CNV. Coulmn 4 refers to the version number of the accession information. Column 5 refers to the genomic start of the transcript. Column 7 refers to the genomic end of the transcript. Column 8 refers to the length of the genomic sequence over which transcript extends (from start to end). Column 9 refers to a brief description of gene function. More than one RNA product (e.g., alternatively spliced mRNA transcripts and non-coding RNAs) can be produced from a single gene. Table 2 lists presently known transcript variants (and their RNA accession numbers) but it can be appreciated by those skilled in the art that new variants may be found when further studies are completed and that generation of these additional transcript variants (and ultimately protein and/or regulatory RNA products) may also be impacted by one or more CNVs listed in Table 1. Table 2 contains 170 entries. This number exceeds that in Table 1, both because some CNVs overlap multiple genes and because, for some genes, there are multiple transcripts described. The priority number corresponds to column 10 of Table 1.

In one embodiment, the transcripts listed in Table 2 can be expression products of the same gene. In another embodiment, the gene biomarker is the DNA encoding gene, including exons, introns, and/or regulatory binding regions such as enhancers, promoters, silencers, and response elements. In one embodiment, point mutations, polymorphisms, translocations, insertions, deletions, amplifications, inversions, microsatellites, interstitial deletions, copy number variations (CNVs), loss of heterozygosity, or any other aberrations which affect the structure or function of one or more gene biomarkers and/or expression products thereof, are associated with a developmental disorder as described herein.

TABLE 1

| SEQ ID No | Hospital ID | Chr | Start | Stop | Size (bp) | Cytoband |
|---|---|---|---|---|---|---|
| SEQ ID 1 | NA0174-000 | 14 | 66,255,943 | 66,292,122 | 36,180 | 14q23.3 |
| SEQ ID 2 | SS0054 | 14 | 66,083,554 | 66,085,434 | 1,880 | 14q23.3 |
| SEQ ID 3 | SS0254 | 14 | 66,114,231 | 66,206,726 | 92,495 | 14q23.3 |
| SEQ ID 4 | SS0100 | 14 | 66,114,231 | 66,189,112 | 74,881 | 14q23.3 |
| SEQ ID 5 | SS0025 | 14 | 66,124,169 | 66,150,847 | 26,678 | 14q23.3 |
| SEQ ID 6 | SS0711 | 14 | 66,124,169 | 66,150,847 | 26,678 | 14q23.3 |
| SEQ ID 7 | SS0175 | 14 | 66,256,143 | 66,291,922 | 35,779 | 14q23.3 |
| SEQ ID 8 | MM1094-004 | 2 | 115,251,698 | 115,258,815 | 7,118 | 2q14.1 |
| SEQ ID 9 | MM1076-004 | 7 | 145,659,291 | 145,666,871 | 7,581 | 7q35 |
| SEQ ID 10 | SK0388-003 | 14 | 78,094,937 | 78,108,997 | 14,061 | 14q24.3 |
| SEQ ID 11 | MM1128-003 | 2 | 212,595,621 | 212,601,943 | 6,323 | 2q34 |
| SEQ ID 12 | MM0198-003 | 2 | 124,820,246 | 124,830,494 | 10,249 | 2q14.3 |
| SEQ ID 13 | SK0222-003 | 2 | 124,820,246 | 124,830,494 | 10,249 | 2q14.3 |
| SEQ ID 14 | MM0269-004 | 2 | 133,432,106 | 133,451,626 | 19,521 | 2q21.2 |
| SEQ ID 15 | SK0353-003 | 2 | 133,905,311 | 133,915,419 | 10,109 | 2q21.2 |
| SEQ ID 16 | MM0090-003 | 2 | 50,451,929 | 50,458,853 | 6,925 | 2p16.3 |
| SEQ ID 17 | SK0148-005 | 4 | 20,027,378 | 20,046,392 | 19,015 | 4p15.31 |
| SEQ ID 18 | SK0148-005 | 2 | 80,729,039 | 80,780,707 | 51,669 | 2p12 |
| SEQ ID 19 | NA0050-000 | 1 | 97,937,467 | 97,947,871 | 10,405 | 1p21.3 |
| SEQ ID 20 | MM0081-003 | 3 | 171,421,331 | 171,431,963 | 10,633 | 3q26.2 |
| SEQ ID 21 | SK0094-005 | 1 | 239,422,540 | 239,435,803 | 13,264 | 1q43 |
| SEQ ID 22 | SK0184-003 | 1 | 239,422,540 | 239,435,803 | 13,264 | 1q43 |
| SEQ ID 23 | SK0442-003 | 19 | 52,315,553 | 52,339,881 | 24,329 | 19q13.32 |
| SEQ ID 24 | MM0177-003 | 22 | 21,328,084 | 21,984,363 | 656,280 | 22q11.23, 22q11.22 |
| SEQ ID 25 | SK0433-003 | 4 | 94,025,204 | 94,160,887 | 135,684 | 4q22.2 |
| SEQ ID 26 | SK0451-003 | 7 | 126,121,250 | 126,155,948 | 34,699 | 7q31.33 |
| SEQ ID 27 | SK0011-004 | X | 32,574,277 | 32,580,137 | 5,861 | Xp21.1 |
| SEQ ID 28 | SK0277-003 | X | 33,069,644 | 33,076,560 | 6,917 | Xp21.1 |
| SEQ ID 29 | MM1165-003 | 20 | 15,698,778 | 15,713,061 | 14,284 | 20p12.1 |
| SEQ ID 30 | MM1334-003 | 20 | 15,698,778 | 15,713,061 | 14,284 | 20p12.1 |
| SEQ ID 31 | SK0291-003 | 6 | 161,924,151 | 161,941,862 | 17,712 | 6q26 |
| SEQ ID 32 | MM0126-004 | 16 | 3,693,293 | 3,706,628 | 13,336 | 16p13.3 |
| SEQ ID 33 | NA0002-000 | 3 | 116,104,105 | 116,114,108 | 10,004 | 3q13.31 |
| SEQ ID 34 | SK0148-005 | 16 | 82,953,024 | 82,964,975 | 11,952 | 16q24.1 |
| SEQ ID 35 | SK0076-003 | 22 | 16,366,405 | 16,373,681 | 7,277 | 22q11.21 |
| SEQ ID 36 | MM0022-003 | 8 | 42,689,776 | 42,703,550 | 13,775 | 8p11.21 |
| SEQ ID 37 | SK0256-003 | 8 | 42,691,586 | 42,703,550 | 11,965 | 8p11.21 |
| SEQ ID 38 | SK0373-003 | 15 | 76,205,943 | 76,223,581 | 17,639 | 15q25.1 |
| SEQ ID 39 | SK0009-004 | 15 | 76,205,943 | 76,226,626 | 20,684 | 15q25.1 |
| SEQ ID 40 | SK0254-003 | 7 | 8,505,020 | 8,762,802 | 257,783 | 7p21.3 |
| SEQ ID 41 | NA0066-000 | 7 | 8,748,267 | 8,761,257 | 12,991 | 7p21.3 |
| SEQ ID 42 | MM0262-003 | 15 | 73,636,914 | 73,649,849 | 12,936 | 15q24.2 |
| SEQ ID 43 | NA0061-000 | 1 | 8,415,471 | 8,424,072 | 8,602 | 1p36.23 |
| SEQ ID 44 | SK0192-003 | 1 | 8,578,840 | 8,591,521 | 12,682 | 1p36.23 |
| SEQ ID 45 | MM1206-003 | 10 | 106,447,066 | 106,456,507 | 9,442 | 10q25.1 |
| SEQ ID 46 | SK0002-003 | 3 | 150,841,628 | 150,849,596 | 7,969 | 3q25.1 |
| SEQ ID 47 | SK0413-003 | 7 | 124,324,707 | 124,335,800 | 11,094 | 7q31.33 |
| SEQ ID 48 | MM0022-003 | 7 | 124,324,707 | 124,335,800 | 11,094 | 7q31.33 |
| SEQ ID 49 | SK0494-003 | 3 | 77,559,671 | 77,571,280 | 11,610 | 3p12.3 |
| SEQ ID 50 | SK0179-003 | 3 | 77,559,671 | 77,571,280 | 11,610 | 3p12.3 |
| SEQ ID 51 | MM1112-003 | 8 | 24,361,792 | 24,390,072 | 28,281 | 8p21.2 |
| SEQ ID 52 | SK0517-003 | 5 | 19,717,165 | 19,733,656 | 16,492 | p14.3 |
| SEQ ID 53 | NA0099-000 | 11 | 61,261,340 | 61,276,498 | 15,159 | 11q12.2 |
| SEQ ID 54 | SK0197-004 | 4 | 155,727,144 | 155,743,337 | 16,194 | 4q32.1 |
| SEQ ID 55 | SK0002-003 | 14 | 63,987,698 | 63,996,124 | 8,427 | 14q23.2 |
| SEQ ID 56 | SK0144-004 | 5 | 149,899,127 | 149,953,911 | 54,785 | 5q33.1 |
| SEQ ID 57 | SK0347-003 | 17 | 26,494,561 | 26,507,432 | 12,872 | 17q11.2 |
| SEQ ID 58 | SK0455-003 | 9 | 14,194,914 | 14,203,254 | 8,341 | 9p22.3 |
| SEQ ID 59 | SK0252-003 | 7 | 131,702,414 | 131,719,045 | 16,632 | 7q32.3 |
| SEQ ID 60 | MM1131-003 | 1 | 45,759,003 | 45,768,207 | 9,205 | 1p34.1 |
| SEQ ID 61 | SK0195/MM1003-003 | X | 16,688,462 | 16,707,232 | 18,771 | Xp22.2 |
| SEQ ID 62 | SK0196-005 | X | 16,688,462 | 16,707,232 | 18,771 | Xp22.2 |
| SEQ ID 63 | NA0186-000 | 17 | 74,398,583 | 74,447,566 | 48,984 | 17q25.3 |
| SEQ ID 64 | NA0176-000 | 11 | 118,439,435 | 118,458,458 | 19,024 | 11q23.3 |
| SEQ ID 65 | SK0354-006 | 1 | 27,662,588 | 27,679,450 | 16,863 | 1p36.11 |
| SEQ ID 66 | MM0211-004 | X | 151,729,935 | 151,853,805 | 123,871 | Xq28 |

TABLE 1-continued

| SEQ ID No | Sample | Chr | Start | End | Size | Band |
|---|---|---|---|---|---|---|
| SEQ ID 67 | MM1226-003 | 1 | 70,149,725 | 70,161,066 | 11,342 | 1p31.1 |
| SEQ ID 68 | SK0083-003 | 17 | 1,182,304 | 1,207,115 | 24,812 | 17p13.3 |
| SEQ ID 69 | SK0267-003 | 17 | 1,182,533 | 1,206,944 | 24,412 | 17p13.3 |
| SEQ ID 70 | MM0270-003 | 8 | 145,990,558 | 146,003,494 | 12,937 | 8q24.3 |
| SEQ ID 71 | MM1209-003 | 8 | 145,990,558 | 146,003,494 | 12,937 | 8q24.3 |
| SEQ ID 72 | SK0218-003 | X | 1,513,747 | 1,571,540 | 57,794 | Xp22.33 |
| SEQ ID 73 | SK0095-003 | 12 | 67,309,307 | 67,318,585 | 9,279 | 12q15 |
| SEQ ID 74 | MM1132-003 | 6 | 45,929,914 | 46,097,897 | 167,984 | 6p12.3 |
| SEQ ID 75 | MM0142-004 | 17 | 8,310,684 | 8,318,441 | 7,758 | 17p13.1 |
| SEQ ID 76 | MM0277-003 | 4 | 77,833,964 | 77,842,490 | 8,527 | 4q21.1 |

| SEQ ID No | CNV Type | Validation by qPCR | Priority Number |
|---|---|---|---|
| SEQ ID 1 | loss | validated (de novo) | 1 |
| SEQ ID 2 | gain | not done | 2 |
| SEQ ID 3 | loss | not done | 3 |
| SEQ ID 4 | loss | not done | 4 |
| SEQ ID 5 | loss | not done | 5 |
| SEQ ID 6 | loss | not done | 6 |
| SEQ ID 7 | loss | not done | 7 |
| SEQ ID 8 | loss | validated (paternal inheritance) | 8 |
| SEQ ID 9 | loss | validated (maternal inheritance) | 9 |
| SEQ ID 10 | loss | Proband Validated (Loss), maternal inheritance | 10 |
| SEQ ID 11 | loss | validated (maternal inheritance), loss in maternal grandmother, detected in one unaffected sibling 99797 and not in other unaffected sibling 99798 | 11 |
| SEQ ID 12 | loss | validated (maternal inheritance), detected in proband and the two affected siblings | 12 |
| SEQ ID 13 | loss | validated (maternal inheritance) | 13 |
| SEQ ID 14 | gain | validated (paternal inheritance)-gain was present in the affected sibling as well, affected sib and the proband has both autism and ADHD. | 14 |
| SEQ ID 15 | loss | validated (maternal inheritance) | 15 |
| SEQ ID 16 | loss | validated (maternal inheritance) | 16 |
| SEQ ID 17 | loss | Proband Validated (Loss), maternal inheritance in proband, US1 (41344) and US3 (41347), DNA unavailable for US2 | 17 |
| SEQ ID 18 | gain | validated (paternal inheritance), three unaffected siblings, none of them have CNV | 18 |
| SEQ ID 19 | loss | validated (maternal inheritance) | 19 |
| SEQ ID 20 | loss | Proband Validated (Loss), paternal inheritance in proband and unaffected sibling, but not in affected sibling | 20 |
| SEQ ID 21 | loss | validated (parents unavailable), detected in proband and affected sibling, not detected in the three unaffected siblings | 21 |
| SEQ ID 22 | loss | validated (paternally inherited) | 22 |
| SEQ ID 23 | gain | validated (unknown inheritance), mother has no CNV and father's DNA not available | 23 |
| SEQ ID 24 | gain | validated (maternally inherited), detected in affected sibling as well | 24 |
| SEQ ID 25 | loss | validated (paternal inheritance) | 25 |
| SEQ ID 26 | gain | validated (paternally inherited), not present in the unaffected sibling | 26 |
| SEQ ID 27 | loss | validated (maternal inheritance), present in unaffected sibling | 27 |
| SEQ ID 28 | loss | validated (maternal inheritance) | 28 |
| SEQ ID 29 | loss | loss in the proband (maternally inherited), and present in unaffected sibling MM1165-005 | 29 |
| SEQ ID 30 | loss | loss in proband (paternally inherited), not present in unaffected sibling, present in paternal grandfather | 30 |
| SEQ ID 31 | loss | validated (paternal inheritance), detected in proband and unaffected sibling 75743 | 31 |
| SEQ ID 32 | loss | validated (maternally inherited), present in unaffected sibling 60512 and not in the proband 60005. | 32 |
| SEQ ID 33 | loss | Proband Validated (Loss), maternal inheritance | 33 |
| SEQ ID 34 | loss | validated (maternal inheritance), present in all the 3 unaffected siblings | 34 |
| SEQ ID 35 | loss | validated, mother does not have the loss, father's DNA and sib's DNA is not available | 35 |
| SEQ ID 36 | gain | validated (maternal inheritance), present in affected sibling (MM0022-004) and not in the other affected sibling (MM0022-005) | 36 |
| SEQ ID 37 | loss | loss in the proband and two of the affected siblings, mother has no CNV and father's DNA is unavailable | 37 |
| SEQ ID 38 | gain | validated (Paternal inheritance), not present in sibling | 38 |
| SEQ ID 39 | gain | validated (maternal inheritance)-present in unaffected female sib SK0009-005, not present in other female unaffected sib SK0009-003 | 39 |
| SEQ ID 40 | loss | validated (maternal inheritance), father's DNA unavailable | 40 |
| SEQ ID 41 | loss | validated (maternal inheritance), present in unaffected sibling (NA0066-002) but not in the other unaffected sibling (NA0066-003) and affected sibling (NA0066-001) | 41 |

TABLE 1-continued

| | | | |
|---|---|---|---|
| SEQ ID 42 | loss | Proband Validated (Loss) (paternal inheritance in proband only) | 42 |
| SEQ ID 43 | gain | paternally inherited gain | 43 |
| SEQ ID 44 | loss | Proband Validated (Loss), present in unaffected sibling, no paternal DNA available | 44 |
| SEQ ID 45 | loss | validated (maternally inherited), unaffected sibling does not have this loss | 45 |
| SEQ ID 46 | gain | Proband validated (gain), parent DNA unavailable | 46 |
| SEQ ID 47 | gain | validated (paternal inheritance) | 47 |
| SEQ ID 48 | gain | validated (maternal inheritance), present in affected sibling (MM0022-004) and not in the other affected sibling (MM0022-005) | 48 |
| SEQ ID 49 | loss | Proband Validated (Loss), maternal inheritance, present in affected sibling and one unaffected sibling (167372) but not in the other unaffected sibling | 49 |
| SEQ ID 50 | loss | Proband Validated (Loss), present in both affected siblings, parent DNA unavailable | 50 |
| SEQ ID 51 | gain | validated (paternal inheritance), not present in unaffected sibling | 51 |
| SEQ ID 52 | gain | gain in the proband (maternally inherited), not present in the other two siblings | 52 |
| SEQ ID 53 | loss | validated (paternally inherited), present in one affected sibling and another unaffected sibling | 53 |
| SEQ ID 54 | gain | validated (maternally inherited), not present in the proband | 54 |
| SEQ ID 55 | gain | validated, missing parents | 55 |
| SEQ ID 56 | gain | validated (paternally inherited), not present in unaffected and affected siblings | 56 |
| SEQ ID 57 | loss | validated (maternal inheritance), not present in unaffected sib | 57 |
| SEQ ID 58 | loss | Proband Validated (Loss), paternal inheritance in proband only | 58 |
| SEQ ID 59 | loss | Proband Validated (Loss) | 59 |
| SEQ ID 60 | loss | paternally inherited loss in proband and in unaffected sibling | 60 |
| SEQ ID 61 | gain | validated (maternally inherited), not detected in unaffected sibling | 61 |
| SEQ ID 62 | gain | validated (maternally inherited), detected in both unaffected siblings | 62 |
| SEQ ID 63 | gain | Proband Validated (Gain)(maternally inherited), present in unaffected sibling | 63 |
| SEQ ID 64 | gain | validated (paternally inherited) | 64 |
| SEQ ID 65 | loss | maternal inherited loss in proband, affected sibling and the third unaffected sibling, not present in the other two unaffected sibling | 65 |
| SEQ ID 66 | gain | Proband Validated (Gain), maternal inheritance in proband and affected sibling | 66 |
| SEQ ID 67 | gain | paternally inherited gain in the proband, present in unaffected sibling and in paternal grandfather | 67 |
| SEQ ID 68 | gain | validated (maternal inheritance), not present in unaffected sib | 68 |
| SEQ ID 69 | gain | validated (maternal inheritance) | 69 |
| SEQ ID 70 | loss | Proband Validated (Loss), maternal inheritance, not present in the affected sibling | 70 |
| SEQ ID 71 | loss | Proband Validated (Loss), paternal inheritance, not present in unaffected sibling | 71 |
| SEQ ID 72 | gain | validated (paternal inheritance), not present in affected sibling | 72 |
| SEQ ID 73 | loss | Proband Validated (Loss), maternal inheritance in proband and third unaffected sibling, not present in first and second unaffected siblings (no paternal DNA available) | 73 |
| SEQ ID 74 | gain | validated (maternally inherited), not present in unaffected sibling | 74 |
| SEQ ID 75 | gain | validated (maternal inheritance) | 75 |
| SEQ ID 76 | loss | Proband Validated (Loss) (paternal inheritance), not present in the affected sibling | 76 |

Hg18 March 2006 (NCBI Build 36.1)

TABLE 2

| Gene Number within CNV | Gene ID # | Gene Names | SEQ ID No | ACCESSION | VERSION | FEATURE START | FEATURE STOP | FEATURE SIZE |
|---|---|---|---|---|---|---|---|---|
| 1 | 1 | GPHN | SEQ ID 77 | NM_001024218 | NM_001024218.1 | 66043877 | 66718278 | 674401 |
| 1 | 1 | GPHN | SEQ ID 78 | NM_020806 | NM_020806.4 | 66043877 | 66718278 | 674401 |
| 1 | 1 | GPHN | SEQ ID 77 | NM_001024218 | NM_001024218.1 | 66043877 | 66718278 | 674401 |
| 1 | 1 | GPHN | SEQ ID 78 | NM_020806 | NM_020806.4 | 66043877 | 66718278 | 674401 |
| 1 | 1 | GPHN | SEQ ID 77 | NM_001024218 | NM_001024218.1 | 66043877 | 66718278 | 674401 |
| 1 | 1 | GPHN | SEQ ID 78 | NM_020806 | NM_020806.4 | 66043877 | 66718278 | 674401 |
| 1 | 1 | GPHN | SEQ ID 77 | NM_001024218 | NM_001024218.1 | 66043877 | 66718278 | 674401 |
| 1 | 1 | GPHN | SEQ ID 78 | NM_020806 | NM_020806.4 | 66043877 | 66718278 | 674401 |
| 1 | 1 | GPHN | SEQ ID 77 | NM_001024218 | NM_001024218.1 | 66043877 | 66718278 | 674401 |
| 1 | 1 | GPHN | SEQ ID 78 | NM_020806 | NM_020806.4 | 66043877 | 66718278 | 674401 |
| 1 | 1 | GPHN | SEQ ID 77 | NM_001024218 | NM_001024218.1 | 66043877 | 66718278 | 674401 |
| 1 | 1 | GPHN | SEQ ID 78 | NM_020806 | NM_020806.4 | 66043877 | 66718278 | 674401 |

TABLE 2-continued

| | | | | | | | | |
|---|---|---|---|---|---|---|---|---|
| 1 | 1 | GPHN | SEQ ID 77 | NM_001024218 | NM_001024218.1 | 66043877 | 66718278 | 674401 |
| 1 | 1 | GPHN | SEQ ID 78 | NM_020806 | NM_020806.4 | 66043877 | 66718278 | 674401 |
| 1 | 2 | DPP10 | SEQ ID 79 | NM_001178036 | NM_001178036.1 | 114935649 | 116318796 | 1383147 |
| 1 | 2 | DPP10 | SEQ ID 80 | NM_020868 | NM_020868.3 | 114916368 | 116318796 | 1402428 |
| 1 | 2 | CNTNAP2 | SEQ ID 81 | NM_014141 | NM_014141.5 | 145444385 | 147749021 | 2304636 |
| 1 | 4 | NRXN3 | SEQ ID 82 | NM_004796 | NM_004796.4 | 77939845 | 79400513 | 1460668 |
| 1 | 5 | ERBB4 | SEQ ID 83 | NM_001042599 | NM_001042599.1 | 211948686 | 213111597 | 1162911 |
| 1 | 5 | ERBB4 | SEQ ID 84 | NM_005235 | NM_005235.2 | 211948686 | 213111597 | 1162911 |
| 1 | 6 | CNTNAP5 | SEQ ID 85 | NM_130773 | NM_130773.2 | 124499333 | 125389333 | 890000 |
| 1 | 6 | CNTNAP5 | SEQ ID 85 | NM_130773 | NM_130773.2 | 124499333 | 125389333 | 890000 |
| 1 | 7 | NCKAP5 | SEQ ID 86 | NM_207363 | NM_207363.2 | 133145841 | 134042501 | 896660 |
| 1 | 7 | NCKAP5 | SEQ ID 87 | NM_207481 | NM_207481.3 | 133145841 | 134042501 | 896660 |
| 1 | 7 | NCKAP5 | SEQ ID 86 | NM_207363 | NM_207363.2 | 133145841 | 134042501 | 896660 |
| 1 | 7 | NCKAP5 | SEQ ID 87 | NM_207481 | NM_207481.3 | 133145841 | 134042501 | 896660 |
| 1 | 8 | NRXN1 | SEQ ID 88 | NM_001135659 | NM_001135659.1 | 49999146 | 51113178 | 1114032 |
| 1 | 8 | NRXN1 | SEQ ID 89 | NM_004801 | NM_004801.4 | 49999146 | 51113178 | 1114032 |
| 1 | 9 | SLIT2 | SEQ ID 90 | NM_004787 | NM_004787.1 | 19864332 | 20229886 | 365554 |
| 1 | 10 | CTNNA2 | SEQ ID 91 | NM_001164883 | NM_001164883.1 | 79593567 | 80729499 | 1135932 |
| 1 | 10 | CTNNA2 | SEQ ID 92 | NM_004389 | NM_004389.3 | 79593567 | 80729499 | 1135932 |
| 1 | 11 | DPYD | SEQ ID 93 | NM_000110 | NM_000110.3 | 97315887 | 98159203 | 843316 |
| 1 | 12 | PRKCI | SEQ ID 94 | NM_002740 | NM_002740.5 | 171422913 | 171506464 | 83551 |
| 1 | 13 | RGS7 | SEQ ID 95 | NM_002924 | NM_002924.4 | 239005439 | 239587101 | 581662 |
| 1 | 13 | RGS7 | SEQ ID 95 | NM_002924 | NM_002924.4 | 239005439 | 239587101 | 581662 |
| 1 | 14 | SAE1 | SEQ ID 96 | NM_001145713 | NM_001145713.1 | 52325919 | 52405733 | 79814 |
| 1 | 14 | SAE1 | SEQ ID 97 | NM_001145714 | NM_001145714.1 | 52325919 | 52405733 | 79814 |
| 1 | 14 | SAE1 | SEQ ID 98 | NM_005500 | NM_005500.2 | 52325919 | 52405733 | 79814 |
| 1 | 14 | SAE1 | SEQ ID 99 | NR_027280 | NR_027280.1 | 52325954 | 52405733 | 79779 |
| 7 | 15 | IGLL5 | SEQ ID 100 | NM_001178126 | NM_001178126.1 | 21559959 | 21568013 | 8054 |
| 7 | 15 | IGLL5 | SEQ ID 101 | NM_001256296 | NM_001256296.1 | 21559959 | 21568013 | 8054 |
| 7 | 16 | GNAZ | SEQ ID 102 | NM_002073 | NM_002073.2 | 21742668 | 21797221 | 54553 |
| 7 | 17 | BCR | SEQ ID 103 | NM_004327 | NM_004327.3 | 21852551 | 21990224 | 137673 |
| 7 | 18 | RAB36 | SEQ ID 104 | NM_004914 | NM_004914.2 | 21817512 | 21836531 | 19019 |
| 7 | 19 | RTDR1 | SEQ ID 105 | NM_014433 | NM_014433.2 | 21731592 | 21814241 | 82649 |
| 7 | 20 | BCR | SEQ ID 106 | NM_021574 | NM_021574.2 | 21852551 | 21990224 | 137673 |
| 7 | 21 | MIR650 | SEQ ID 107 | NR_030755 | NR_030755.1 | 21495269 | 21495365 | 96 |
| 7 | 22 | FBXW4P1 | SEQ ID 108 | NR_033408 | NR_033408.1 | 21934953 | 21937186 | 2233 |
| 1 | 23 | GRID2 | SEQ ID 109 | NM_001510 | NM_001510.2 | 93444572 | 94912672 | 1468100 |
| 1 | 24 | GRM8 | SEQ ID 110 | NM_000845 | NM_000845.2 | 125865887 | 126670805 | 804918 |
| 1 | 24 | GRM8 | SEQ ID 111 | NM_001127323 | NM_001127323.1 | 125865887 | 126679664 | 813777 |
| 1 | 24 | GRM8 | SEQ ID 112 | NR_028041 | NR_028041.1 | 125865887 | 126670805 | 804918 |
| 1 | 25 | DMD | SEQ ID 113 | NM_000109 | NM_000109.3 | 31047265 | 33267647 | 2220382 |
| 1 | 25 | DMD | SEQ ID 114 | NM_004006 | NM_004006.2 | 31047265 | 33139594 | 2092329 |
| 1 | 25 | DMD | SEQ ID 115 | NM_004007 | NM_004007.2 | 31047265 | 32948238 | 1900973 |
| 1 | 25 | DMD | SEQ ID 116 | NM_004009 | NM_004009.3 | 31047265 | 33056466 | 2009201 |
| 1 | 25 | DMD | SEQ ID 117 | NM_004010 | NM_004010.3 | 31047265 | 33056465 | 2009200 |
| 1 | 25 | DMD | SEQ ID 113 | NM_000109 | NM_000109.3 | 31047265 | 33267647 | 2220382 |
| 1 | 25 | DMD | SEQ ID 114 | NM_004006 | NM_004006.2 | 31047265 | 33139594 | 2092329 |
| 1 | 26 | MACROD2 | SEQ ID 118 | NM_001033087 | NM_001033087.1 | 15125503 | 15981841 | 856338 |
| 1 | 26 | MACROD2 | SEQ ID 119 | NM_80676 | NM_080676.5 | 13924145 | 15981841 | 2057696 |
| 1 | 26 | MACROD2 | SEQ ID 118 | NM_001033087 | NM_001033087.1 | 15125503 | 15981841 | 856338 |
| 1 | 26 | MACROD2 | SEQ ID 119 | NM_80676 | NM_080676.5 | 13924145 | 15981841 | 2057696 |
| 1 | 27 | PARK2 | SEQ ID 120 | NM_004562 | NM_004562.2 | 161688579 | 163068824 | 1380245 |
| 1 | 27 | PARK2 | SEQ ID 121 | NM_013987 | NM_013987.2 | 161688579 | 163068824 | 1380245 |
| 1 | 27 | PARK2 | SEQ ID 122 | NM_013988 | NM_013988.2 | 161688579 | 163068824 | 1380245 |
| 1 | 28 | TRAP1 | SEQ ID 123 | NM_016292 | NM_016292.2 | 3648038 | 3707599 | 59561 |
| 1 | 29 | ZBTB20 | SEQ ID 124 | NM_001164343 | NM_001164343.1 | 115539636 | 116272951 | 733315 |
| 1 | 29 | ZBTB20 | SEQ ID 125 | NM_015642 | NM_015642.4 | 115539636 | 116348817 | 809181 |
| 1 | 30 | ATP2C2 | SEQ ID 126 | NM_014861 | NM_014861.4 | 82959633 | 83055294 | 95661 |
| 1 | 31 | CECR2 | SEQ ID 127 | NM_031413 | NM_031413.3 | 16336627 | 16413845 | 77218 |
| 1 | 32 | CHRNB3 | SEQ ID 128 | NM_000749 | NM_000749.3 | 42671718 | 42711366 | 39648 |
| 1 | 32 | CHRNB3 | SEQ ID 128 | NM_000749 | NM_000749.3 | 42671718 | 42711366 | 39648 |
| 1 | 33 | CIB2 | SEQ ID 129 | NM_006383 | NM_006383.2 | 76184045 | 76210933 | 26888 |
| 1 | 33 | CIB2 | SEQ ID 129 | NM_006383 | NM_006383.2 | 76184045 | 76210933 | 26888 |
| 1 | 34 | NXPH1 | SEQ ID 130 | NM_152745 | NM_152745.2 | 8440109 | 8759118 | 319009 |
| 1 | 34 | NXPH1 | SEQ ID 130 | NM_152745 | NM_152745.2 | 8440109 | 8759118 | 319009 |
| 1 | 35 | PTPN9 | SEQ ID 131 | NM_002833 | NM_002833.2 | 73546514 | 73658680 | 112166 |
| 1 | 36 | RERE | SEQ ID 132 | NM_001042681 | NM_001042681.1 | 8335050 | 8800286 | 465236 |
| 1 | 36 | RERE | SEQ ID 133 | NM_012102 | NM_012102.3 | 8335050 | 8800286 | 465236 |
| 1 | 36 | RERE | SEQ ID 132 | NM_001042681 | NM_001042681.1 | 8335050 | 8800286 | 465236 |
| 1 | 36 | RERE | SEQ ID 133 | NM_012102 | NM_012102.3 | 8335050 | 8800286 | 465236 |
| 1 | 37 | SORCS3 | SEQ ID 134 | NM_014978 | NM_014978.1 | 106390848 | 107014983 | 624135 |
| 1 | 38 | WWTR1 | SEQ ID 135 | NM_001168278 | NM_001168278.1 | 150717711 | 150903750 | 186039 |
| 1 | 38 | WWTR1 | SEQ ID 136 | NM_001168280 | NM_001168280.1 | 150717711 | 150858502 | 140791 |
| 1 | 38 | WWTR1 | SEQ ID 137 | NM_015472 | NM_015472.4 | 150717711 | 150858578 | 140867 |
| 1 | 39 | POT1 | SEQ ID 138 | NM_001042594 | NM_001042594.1 | 124249675 | 124357273 | 107598 |
| 1 | 39 | POT1 | SEQ ID 139 | NM_015450 | NM_015450.2 | 124249675 | 124357273 | 107598 |
| 1 | 39 | POT1 | SEQ ID 140 | NR_003102 | NR_003102.1 | 124249675 | 124357273 | 107598 |
| 1 | 39 | POT1 | SEQ ID 141 | NR_003103 | NR_003103.1 | 124249675 | 124357273 | 107598 |
| 1 | 39 | POT1 | SEQ ID 142 | NR_003104 | NR_003104.1 | 124249675 | 124357273 | 107598 |
| 1 | 39 | POT1 | SEQ ID 138 | NM_001042594 | NM_001042594 | 124249675 | 124357273 | 107598 |

TABLE 2-continued

| | | | | | | | | |
|---|---|---|---|---|---|---|---|---|
| 1 | 39 | POT1 | SEQ ID 139 | NM_015450 | NM_015450.2 | 124249675 | 124357273 | 107598 |
| 1 | 39 | POT1 | SEQ ID 140 | NR_003102 | NR_003102.1 | 124249675 | 124357273 | 107598 |
| 1 | 39 | POT1 | SEQ ID 141 | NR_003103 | NR_003103.1 | 124249675 | 124357273 | 107598 |
| 1 | 39 | POT1 | SEQ ID 142 | NR_003104 | NR_003104.1 | 124249675 | 124357273 | 107598 |
| 1 | 40 | ROBO2 | SEQ ID 143 | NM_001128929 | NM_001128929.2 | 77229852 | 77781804 | 551952 |
| 1 | 40 | ROBO2 | SEQ ID 144 | NM_002942 | NM_002942.4 | 77171983 | 77781804 | 609821 |
| 1 | 40 | ROBO2 | SEQ ID 143 | NM_001128929 | NM_001128929.2 | 77229852 | 77781804 | 551952 |
| 1 | 40 | ROBO2 | SEQ ID 144 | NM_002942 | NM_002942.4 | 77171983 | 77781804 | 609821 |
| 1 | 41 | ADAM7 | SEQ ID 145 | NM_003817 | NM_003817.3 | 24354453 | 24422967 | 68514 |
| 1 | 42 | CDH18 | SEQ ID 146 | NM_001167667 | NM_001167667.1 | 19508911 | 20024110 | 515199 |
| 1 | 42 | CDH18 | SEQ ID 147 | NM_004934 | NM_004934.3 | 19508911 | 20024110 | 515199 |
| 1 | 43 | DAGLA | SEQ ID 148 | NM_006133 | NM_006133.2 | 61204480 | 61271050 | 66570 |
| 1 | 44 | FGA | SEQ ID 149 | NM_000508 | NM_000508.3 | 155723729 | 155731347 | 7618 |
| 1 | 44 | FGA | SEQ ID 150 | NM_021871 | NM_021871.2 | 155725878 | 155731347 | 5469 |
| 1 | 45 | MTHFD1 | SEQ ID 151 | NM_005956 | NM_005956.3 | 63924511 | 63996478 | 71967 |
| 1 | 46 | NDST1 | SEQ ID 152 | NM_001543 | NM_001543.4 | 149867866 | 149917966 | 50100 |
| 1 | 47 | NF1 | SEQ ID 153 | NM_000267 | NM_000267.3 | 26446070 | 26728821 | 282751 |
| 1 | 47 | NF1 | SEQ ID 154 | NM_001042492 | NM_001042492.2 | 26446070 | 26728821 | 282751 |
| 1 | 47 | NF1 | SEQ ID 155 | NM_001128147 | NM_001128147.2 | 26446070 | 26573908 | 127838 |
| 1 | 48 | NFIB | SEQ ID 156 | NM_001190737 | NM_001190737.1 | 14071841 | 14304045 | 232204 |
| 1 | 48 | NFIB | SEQ ID 157 | NM_001190738 | NM_001190738.1 | 14071841 | 14388982 | 317141 |
| 1 | 48 | NFIB | SEQ ID 158 | NM_005596 | NM_005596.3 | 14071841 | 14304045 | 232204 |
| 1 | 49 | PLXNA4 | SEQ ID 159 | NM_001105543 | NM_001105543.1 | 131718786 | 131911863 | 193077 |
| 1 | 49 | PLXNA4 | SEQ ID 160 | NM_020911 | NM_020911.1 | 131458630 | 131911863 | 453233 |
| 1 | 50 | PRDX1 | SEQ ID 161 | NM_001202431 | NM_001202431.1 | 45749293 | 45761149 | 11856 |
| 1 | 50 | PRDX1 | SEQ ID 162 | NM_002574 | NM_002574.3 | 45749293 | 45760197 | 10904 |
| 1 | 50 | PRDX1 | SEQ ID 163 | NM_181696 | NM_181696.2 | 45749293 | 45760197 | 10904 |
| 1 | 50 | PRDX1 | SEQ ID 164 | NM_181697 | NM_181697.2 | 45749293 | 45760197 | 10904 |
| 1 | 51 | SYAP1 | SEQ ID 165 | NM_032796 | NM_032796.3 | 16647627 | 16690728 | 43101 |
| 1 | 51 | SYAP1 | SEQ ID 166 | NR_033181 | NR_033181.1 | 16647627 | 16690728 | 43101 |
| 1 | 51 | SYAP1 | SEQ ID 165 | NM_032796 | NM_032796.3 | 16647627 | 16690728 | 43101 |
| 1 | 51 | SYAP1 | SEQ ID 166 | NR_033181 | NR_033181.1 | 16647627 | 16690728 | 43101 |
| 2 | 52 | LOC100653515 | SEQ ID 167 | NM_001243540 | NM_001243540.1 | 74398256 | 74410894 | 12638 |
| 2 | 52 | LOC100653515 | SEQ ID 168 | NM_001243541 | NM_001243541.1 | 74398256 | 74410894 | 12638 |
| 2 | 53 | TIMP2 | SEQ ID 169 | NM_003255 | NM_003255.4 | 74360653 | 74433067 | 72414 |
| 1 | 54 | VPS11 | SEQ ID 170 | NM_021729 | NM_021729.4 | 118443702 | 118457898 | 14196 |
| 1 | 55 | WASF2 | SEQ ID 171 | NM_001201404 | NM_001201404.1 | 27603320 | 27689265 | 85945 |
| 1 | 55 | WASF2 | SEQ ID 172 | NM_006990 | NM_006990.3 | 27603320 | 27689265 | 85945 |
| 3 | 56 | NSDHL | SEQ ID 173 | NM_001129765 | NM_001129765.1 | 151750166 | 151788563 | 38397 |
| 3 | 57 | ZNF185 | SEQ ID 174 | NM_001178106 | NM_001178106.1 | 151833641 | 151892681 | 59040 |
| 3 | 57 | ZNF185 | SEQ ID 175 | NM_001178107 | NM_001178107.1 | 151833641 | 151892681 | 59040 |
| 3 | 57 | ZNF185 | SEQ ID 176 | NM_001178108 | NM_001178108.1 | 151833641 | 151892681 | 59040 |
| 3 | 57 | ZNF185 | SEQ ID 177 | NM_001178109 | NM_001178109.1 | 151833641 | 151892681 | 59040 |
| 3 | 57 | ZNF185 | SEQ ID 178 | NM_001178110 | NM_001178110.1 | 151833641 | 151892681 | 59040 |
| 3 | 57 | ZNF185 | SEQ ID 179 | NM_001178113 | NM_001178113.1 | 151837064 | 151892681 | 55617 |
| 3 | 58 | CETN2 | SEQ ID 180 | NM_004344 | NM_004344.1 | 151746526 | 151749957 | 3431 |
| 3 | 57 | ZNF185 | SEQ ID 181 | NM_007150 | NM_007150.3 | 151833641 | 151892681 | 59040 |
| 3 | 58 | NSDHL | SEQ ID 182 | NM_015922 | NM_015922.2 | 151750166 | 151788563 | 38397 |
| 2 | 59 | LRRC7 | SEQ ID 183 | NM_020794 | NM_020794.2 | 69998445 | 70361759 | 363314 |
| 2 | 60 | PIN1L | SEQ ID 184 | NR_023916 | NR_023916.1 | 70157592 | 70158588 | 996 |
| 1 | 61 | YWHAE | SEQ ID 185 | NM_006761 | NM_006761.4 | 1194583 | 1250306 | 55723 |
| 1 | 61 | YWHAE | SEQ ID 186 | NR_024058 | NR_024058.1 | 1194583 | 1250306 | 55723 |
| 1 | 61 | YWHAE | SEQ ID 185 | NM_006761 | NM_006761.4 | 1194583 | 1250306 | 55723 |
| 1 | 61 | YWHAE | SEQ ID 186 | NR_024058 | NR_024058.1 | 1194583 | 1250306 | 55723 |
| 1 | 62 | ZNF517 | SEQ ID 187 | NM_213605 | NM_213605.2 | 145995064 | 146005333 | 10269 |
| 1 | 62 | ZNF517 | SEQ ID 187 | NM_213605 | NM_213605.2 | 145995064 | 146005333 | 10269 |
| 2 | 63 | ASMTL | SEQ ID 188 | NM_001173473 | NM_001173473.1 | 1482031 | 1532655 | 50624 |
| 2 | 63 | ASMTL | SEQ ID 189 | NM_001173474 | NM_001173474.1 | 1482031 | 1531870 | 49839 |
| 2 | 63 | ASMTL | SEQ ID 190 | NM_004192 | NM_004192.3 | 1482031 | 1531870 | 49839 |
| 2 | 64 | P2RY8 | SEQ ID 191 | NM_178129 | NM_178129.4 | 1541465 | 1616037 | 74572 |
| 1 | 65 | RAP1B | SEQ ID 192 | NM_001010942 | NM_001010942.2 | 67290885 | 67340653 | 49768 |
| 1 | 65 | RAP1B | SEQ ID 193 | NM_001251917 | NM_001251917.1 | 67290885 | 67340653 | 49768 |
| 1 | 65 | RAP1B | SEQ ID 194 | NM_001251918 | NM_001251918.1 | 67290885 | 67340653 | 49768 |
| 1 | 65 | RAP1B | SEQ ID 195 | NM_001251921 | NM_001251921.1 | 67290885 | 67340653 | 49768 |
| 1 | 65 | RAP1B | SEQ ID 196 | NM_001251922 | NM_001251922.1 | 67290885 | 67340653 | 49768 |
| 1 | 65 | RAP1B | SEQ ID 197 | NM_015646 | NM_015646.5 | 67290885 | 67340653 | 49768 |
| 1 | 66 | CLIC5 | SEQ ID 198 | NM_001114086 | NM_001114086.1 | 45974165 | 46156044 | 181879 |
| 1 | 66 | CLIC5 | SEQ ID 199 | NM_001256023 | NM_001256023.1 | 45987337 | 46091585 | 104248 |
| 1 | 66 | CLIC5 | SEQ ID 200 | NM_016929 | NM_016929.4 | 45974165 | 46091585 | 117420 |
| 1 | 66 | CLIC5 | SEQ ID 201 | NR_045672 | NR_045672.1 | 45974165 | 46013312 | 39147 |
| 1 | 66 | CLIC5 | SEQ ID 202 | NR_045673 | NR_045673.1 | 45974165 | 46013312 | 39147 |
| 1 | 66 | CLIC5 | SEQ ID 203 | NR_045674 | NR_045674.1 | 45987337 | 46013312 | 25975 |
| 2 | 67 | NDEL1 | SEQ ID 204 | NM_001025579 | NM_001025579.2 | 8279894 | 8312220 | 32326 |
| 2 | 68 | MYH10 | SEQ ID 205 | NM_001256012 | NM_001256012.1 | 8318247 | 8474804 | 156557 |
| 2 | 68 | MYH10 | SEQ ID 206 | NM_001256095 | NM_001256095.1 | 8318247 | 8474804 | 156557 |
| 2 | 68 | MYH10 | SEQ ID 207 | NM_005964 | NM_005964.3 | 8318247 | 8474804 | 156557 |
| 2 | 67 | NDEL1 | SEQ ID 208 | NM_030808 | NM_030808.4 | 8279894 | 8312220 | 32326 |
| 1 | 69 | SHROOM3 | SEQ ID 209 | NM_020859 | NM_020859.3 | 77575276 | 77923429 | 348153 |

TABLE 2-continued

| Gene Number within CNV | Gene ID # | Gene Names | SEQ ID No | Gene Description | Priority Number |
|---|---|---|---|---|---|
| 1 | 1 | GPHN | SEQ ID 77 | gephyrin (GPHN), transcript variant 2, mRNA | 1 |
| 1 | 1 | GPHN | SEQ ID 78 | gephyrin (GPHN), transcript variant 1, mRNA | 1 |
| 1 | 1 | GPHN | SEQ ID 77 | gephyrin (GPHN), transcript variant 2, mRNA | 1 |
| 1 | 1 | GPHN | SEQ ID 78 | gephyrin (GPHN), transcript variant 1, mRNA | 1 |
| 1 | 1 | GPHN | SEQ ID 77 | gephyrin (GPHN), transcript variant 2, mRNA | 1 |
| 1 | 1 | GPHN | SEQ ID 78 | gephyrin (GPHN), transcript variant 1, mRNA | 1 |
| 1 | 1 | GPHN | SEQ ID 77 | gephyrin (GPHN), transcript variant 2, mRNA | 1 |
| 1 | 1 | GPHN | SEQ ID 78 | gephyrin (GPHN), transcript variant 1, mRNA | 1 |
| 1 | 1 | GPHN | SEQ ID 77 | gephyrin (GPHN), transcript variant 2, mRNA | 1 |
| 1 | 1 | GPHN | SEQ ID 78 | gephyrin (GPHN), transcript variant 1, mRNA | 1 |
| 1 | 1 | GPHN | SEQ ID 77 | gephyrin (GPHN), transcript variant 2, mRNA | 1 |
| 1 | 1 | GPHN | SEQ ID 78 | gephyrin (GPHN), transcript variant 1, mRNA | 1 |
| 1 | 1 | GPHN | SEQ ID 77 | gephyrin (GPHN), transcript variant 2, mRNA | 1 |
| 1 | 1 | GPHN | SEQ ID 78 | gephyrin (GPHN), transcript variant 1, mRNA | 1 |
| 1 | 2 | DPP10 | SEQ ID 79 | dipeptidyl-peptidase 10 (non-functional) (DPP10), transcript variant 5, mRNA | 1 |
| 1 | 2 | DPP10 | SEQ ID 80 | dipeptidyl-peptidase 10 (non-functional) (DPP10), transcript variant 1, mRNA | 1 |
| 1 | 2 | CNTNAP2 | SEQ ID 81 | contactin associated protein-like 2 (CNTNAP2), mRNA | 1 |
| 1 | 4 | NRXN3 | SEQ ID 82 | neurexin 3 (NRXN3), transcript variant 1, mRNA | 1 |
| 1 | 5 | ERBB4 | SEQ ID 83 | v-erb-a erythroblastic leukemia viral oncogene homolog 4 (avian) (ERBB4), transcript variant JM-a/CVT-2, mRNA | 1 |
| 1 | 5 | ERBB4 | SEQ ID 84 | v-erb-a erythroblastic leukemia viral oncogene homolog 4 (avian) (ERBB4), transcript variant JM-a/CVT-1, mRNA | 1 |
| 1 | 6 | CNTNAP5 | SEQ ID 85 | contactin associated protein-like 5 (CNTNAP5), mRNA | 1 |
| 1 | 6 | CNTNAP5 | SEQ ID 85 | contactin associated protein-like 5 (CNTNAP5), mRNA | 1 |
| 1 | 7 | NCKAP5 | SEQ ID 86 | NCK-associated protein 5 (NCKAP5), transcript variant 1, mRNA | 1 |
| 1 | 7 | NCKAP5 | SEQ ID 87 | *Homo sapiens* NCK-associated protein 5 (NCKAP5), transcript variant 2, mRNA | 1 |
| 1 | 7 | NCKAP5 | SEQ ID 86 | NCK-associated protein 5 (NCKAP5), transcript variant 1, mRNA | 1 |
| 1 | 7 | NCKAP5 | SEQ ID 87 | *Homo sapiens* NCK-associated protein 5 (NCKAP5), transcript variant 2, mRNA | 1 |
| 1 | 8 | NRXN1 | SEQ ID 88 | neurexin 1 (NRXN1), transcript variant alpha2, mRNA | 1 |
| 1 | 8 | NRXN1 | SEQ ID 89 | neurexin 1 (NRXN1), transcript variant alpha1, mRNA | 1 |
| 1 | 9 | SLIT2 | SEQ ID 90 | slit homolog 2 (*Drosophila*) (SLIT2), mRNA | 1 |
| 1 | 10 | CTNNA2 | SEQ ID 91 | catenin (cadherin-associated protein), alpha 2 (CTNNA2), transcript variant 2, mRNA | 1 |
| 1 | 10 | CTNNA2 | SEQ ID 92 | catenin (cadherin-associated protein), alpha 2 (CTNNA2), transcript variant 1, mRNA | 1 |
| 1 | 11 | DPYD | SEQ ID 93 | dihydropyrimidine dehydrogenase (DPYD), transcript variant 1, mRNA | 1 |
| 1 | 12 | PRKCI | SEQ ID 94 | protein kinase C, iota (PRKCI), mRNA | 1 |
| 1 | 13 | RGS7 | SEQ ID 95 | regulator of G-protein signaling 7 (RGS7), mRNA | 1 |
| 1 | 13 | RGS7 | SEQ ID 95 | regulator of G-protein signaling 7 (RGS7), mRNA | 1 |
| 1 | 14 | SAE1 | SEQ ID 96 | SUMO1 activating enzyme subunit 1 (SAE1), transcript variant 2, mRNA | 1 |

TABLE 2-continued

| | | | | | |
|---|---|---|---|---|---|
| 1 | 14 | SAE1 | SEQ ID 97 | SUMO1 activating enzyme subunit 1 (SAE1), transcript variant 3, mRNA | 1 |
| 1 | 14 | SAE1 | SEQ ID 98 | SUMO1 activating enzyme subunit 1 (SAE1), transcript variant 1, mRNA | 1 |
| 1 | 14 | SAE1 | SEQ ID 99 | SUMO1 activating enzyme subunit 1 (SAE1), transcript variant 4, non-coding RNA | 1 |
| 7 | 15 | IGLL5 | SEQ ID 100 | immunoglobulin lambda-like polypeptide 5 (IGLL5), transcript variant 1, mRNA | 7 |
| 7 | 15 | IGLL5 | SEQ ID 101 | *Homo sapiens* immunoglobulin lambda-like polypeptide 5 (IGLL5), transcript variant 2, mRNA | 7 |
| 7 | 16 | GNAZ | SEQ ID 102 | guanine nucleotide binding protein (G protein), alpha z polypeptide (GNAZ), mRNA | 7 |
| 7 | 17 | BCR | SEQ ID 103 | breakpoint cluster region (BCR), transcript variant 1, mRNA | 7 |
| 7 | 18 | RAB36 | SEQ ID 104 | RAB36, member RAS oncogene family (RAB36), mRNA | 7 |
| 7 | 19 | RTDR1 | SEQ ID 105 | rhabdoid tumor deletion region gene 1 (RTDR1), mRNA | 7 |
| 7 | 20 | BCR | SEQ ID 106 | breakpoint cluster region (BCR), transcript variant 2, mRNA | 7 |
| 7 | 21 | MIR650 | SEQ ID 107 | microRNA 650 (MIR650), microRNA | 7 |
| 7 | 22 | FBXW4P1 | SEQ ID 108 | F-box and WD repeat domain containing 4 pseudogene 1 (FBXW4P1), non-coding RNA | 1 |
| 1 | 23 | GRID2 | SEQ ID 109 | glutamate receptor, ionotropic, delta 2 (GRID2), mRNA | 1 |
| 1 | 24 | GRM8 | SEQ ID 110 | glutamate receptor, metabotropic 8 (GRM8), transcript variant 1, mRNA | 1 |
| 1 | 24 | GRM8 | SEQ ID 111 | glutamate receptor, metabotropic 8 (GRM8), transcript variant 2, mRNA | 1 |
| 1 | 24 | GRM8 | SEQ ID 112 | glutamate receptor, metabotropic 8 (GRM8), transcript variant 3, non-coding RNA | 1 |
| 1 | 25 | DMD | SEQ ID 113 | dystrophin (DMD), transcript variant Dp427c, mRNA | 1 |
| 1 | 25 | DMD | SEQ ID 114 | dystrophin (DMD), transcript variant Dp427m, mRNA | 1 |
| 1 | 25 | DMD | SEQ ID 115 | dystrophin (DMD), transcript variant Dp427l, mRNA | 1 |
| 1 | 25 | DMD | SEQ ID 116 | dystrophin (DMD), transcript variant Dp427p1, mRNA | 1 |
| 1 | 25 | DMD | SEQ ID 117 | dystrophin (DMD), transcript variant Dp427p2, mRNA | 1 |
| 1 | 25 | DMD | SEQ ID 113 | dystrophin (DMD), transcript variant Dp427c, mRNA | 1 |
| 1 | 25 | DMD | SEQ ID 114 | dystrophin (DMD), transcript variant Dp427m, mRNA | 1 |
| 1 | 26 | MACROD2 | SEQ ID 118 | MACRO domain containing 2 (MACROD2), transcript variant 2, mRNA | 1 |
| 1 | 26 | MACROD2 | SEQ ID 119 | MACRO domain containing 2 (MACROD2), transcript variant 1, mRNA | 1 |
| 1 | 26 | MACROD2 | SEQ ID 118 | MACRO domain containing 2 (MACROD2), transcript variant 2, mRNA | 1 |
| 1 | 26 | MACROD2 | SEQ ID 119 | MACRO domain containing 2 (MACROD2), transcript variant 1, mRNA | 1 |
| 1 | 27 | PARK2 | SEQ ID 120 | parkinson protein 2, E3 ubiquitin protein ligase (parkin) (PARK2), transcript variant 1, mRNA | 1 |
| 1 | 27 | PARK2 | SEQ ID 121 | parkinson protein 2, E3 ubiquitin protein ligase (parkin) (PARK2), transcript variant 2, mRNA | 1 |
| 1 | 27 | PARK2 | SEQ ID 122 | parkinson protein 2, E3 ubiquitin protein ligase (parkin) (PARK2), transcript variant 3, mRNA | 1 |
| 1 | 28 | TRAP1 | SEQ ID 123 | TNF receptor-associated protein 1 (TRAP1), mRNA | 1 |
| 1 | 29 | ZBTB20 | SEQ ID 124 | zinc finger and BTB domain containing 20 (ZBTB20), transcript variant 3, mRNA | 1 |
| 1 | 29 | ZBTB20 | SEQ ID 125 | zinc finger and BTB domain containing 20 (ZBTB20), transcript variant 2, mRNA | 1 |
| 1 | 30 | ATP2C2 | SEQ ID 126 | ATPase, Ca++ transporting, type 2C, member 2 (ATP2C2), mRNA | 1 |
| 1 | 31 | CECR2 | SEQ ID 127 | cat eye syndrome chromosome region, candidate 2 (CECR2), mRNA | 1 |
| 1 | 32 | CHRNB3 | SEQ ID 128 | cholinergic receptor, nicotinic, beta 3 (CHRNB3), mRNA | 1 |

TABLE 2-continued

| | | | | | |
|---|---|---|---|---|---|
| 1 | 32 | CHRNB3 | SEQ ID 128 | cholinergic receptor, nicotinic, beta 3 (CHRNB3), mRNA | 1 |
| 1 | 33 | CIB2 | SEQ ID 129 | calcium and integrin binding family member 2 (CIB2), mRNA | 1 |
| 1 | 33 | CIB2 | SEQ ID 129 | calcium and integrin binding family member 2 (CIB2), mRNA | 1 |
| 1 | 34 | NXPH1 | SEQ ID 130 | neurexophilin 1 (NXPH1), mRNA | 1 |
| 1 | 34 | NXPH1 | SEQ ID 130 | neurexophilin 1 (NXPH1), mRNA | 1 |
| 1 | 35 | PTPN9 | SEQ ID 131 | protein tyrosine phosphatase, non-receptor type 9 (PTPN9), mRNA | 1 |
| 1 | 36 | RERE | SEQ ID 132 | *Homo sapiens* arginine-glutamic acid dipeptide (RE) repeats (RERE), transcript variant 2, mRNA. | 1 |
| 1 | 36 | RERE | SEQ ID 133 | *Homo sapiens* arginine-glutamic acid dipeptide (RE) repeats (RERE), transcript variant 1, mRNA | 1 |
| 1 | 36 | RERE | SEQ ID 132 | *Homo sapiens* arginine-glutamic acid dipeptide (RE) repeats (RERE), transcript variant 2, mRNA. | 1 |
| 1 | 36 | RERE | SEQ ID 133 | *Homo sapiens* arginine-glutamic acid dipeptide (RE) repeats (RERE), transcript variant 1, mRNA | 1 |
| 1 | 37 | SORCS3 | SEQ ID 134 | sortilin-related VPS10 domain containing receptor 3 (SORCS3), mRNA | 1 |
| 1 | 38 | WWTR1 | SEQ ID 135 | WW domain containing transcription regulator 1 (WWTR1), transcript variant 2, mRNA | 1 |
| 1 | 38 | WWTR1 | SEQ ID 136 | WW domain containing transcription regulator 1 (WWTR1), transcript variant 3, mRNA | 1 |
| 1 | 38 | WWTR1 | SEQ ID 137 | WW domain containing transcription regulator 1 (WWTR1), transcript variant 1, mRNA | 1 |
| 1 | 39 | POT1 | SEQ ID 138 | protection of telomeres 1 homolog (*S. pombe*) (POT1), transcript variant 4, mRNA | 1 |
| 1 | 39 | POT1 | SEQ ID 139 | protection of telomeres 1 homolog (*S. pombe*) (POT1), transcript variant 1, mRNA | 1 |
| 1 | 39 | POT1 | SEQ ID 140 | protection of telomeres 1 homolog (*S. pombe*) (POT1), transcript variant 2, non-coding RNA | 1 |
| 1 | 39 | POT1 | SEQ ID 141 | protection of telomeres 1 homolog (*S. pombe*) (POT1), transcript variant 3, non-coding RNA | 1 |
| 1 | 39 | POT1 | SEQ ID 142 | protection of telomeres 1 homolog (*S. pombe*) (POT1), transcript variant 5, non-coding RNA | 1 |
| 1 | 39 | POT1 | SEQ ID 138 | protection of telomeres 1 homolog (*S. pombe*) (POT1), transcript variant 4, mRNA | 1 |
| 1 | 39 | POT1 | SEQ ID 139 | protection of telomeres 1 homolog (*S. pombe*) (POT1), transcript variant 1, mRNA | 1 |
| 1 | 39 | POT1 | SEQ ID 140 | protection of telomeres 1 homolog (*S. pombe*) (POT1), transcript variant 2, non-coding RNA | 1 |
| 1 | 39 | POT1 | SEQ ID 141 | protection of telomeres 1 homolog (*S. pombe*) (POT1), transcript variant 3, non-coding RNA | 1 |
| 1 | 39 | POT1 | SEQ ID 142 | protection of telomeres 1 homolog (*S. pombe*) (POT1), transcript variant 5, non-coding RNA | 1 |
| 1 | 40 | ROBO2 | SEQ ID 143 | roundabout, axon guidance receptor, homolog 2 (*Drosophila*) (ROBO2), transcript variant 1, mRNA | 1 |
| 1 | 40 | ROBO2 | SEQ ID 144 | roundabout, axon guidance receptor, homolog 2 (*Drosophila*) (ROBO2), transcript variant 2, mRNA | 1 |
| 1 | 40 | ROBO2 | SEQ ID 143 | roundabout, axon guidance receptor, homolog 2 (*Drosophila*) (ROBO2), transcript variant 1, mRNA | 1 |
| 1 | 40 | ROBO2 | SEQ ID 144 | roundabout, axon guidance receptor, homolog 2 (*Drosophila*) (ROBO2), transcript variant 2, mRNA | 1 |
| 1 | 41 | ADAM7 | SEQ ID 145 | ADAM metallopeptidase domain 7 (ADAM7), mRNA | 1 |
| 1 | 42 | CDH18 | SEQ ID 146 | cadherin 18, type 2 (CDH18), transcript variant 2, mRNA | 1 |

TABLE 2-continued

| 1 | 42 | CDH18 | SEQ ID 147 | cadherin 18, type 2 (CDH18), transcript variant 1, mRNA | 1 |
|---|---|---|---|---|---|
| 1 | 43 | DAGLA | SEQ ID 148 | diacylglycerol lipase, alpha (DAGLA), mRNA | 1 |
| 1 | 44 | FGA | SEQ ID 149 | fibrinogen alpha chain (FGA), transcript variant alpha-E, mRNA | 1 |
| 1 | 44 | FGA | SEQ ID 150 | fibrinogen alpha chain (FGA), transcript variant alpha, mRNA | 1 |
| 1 | 45 | MTHFD1 | SEQ ID 151 | methylenetetrahydrofolate dehydrogenase (NADP+ dependent) 1, methenyltetrahydrofolate cyclohydrolase, formyltetrahydrofolate synthetase (MTHFD1), mRNA | 1 |
| 1 | 46 | NDST1 | SEQ ID 152 | N-deacetylase/N-sulfotransferase (heparan glucosaminyl) 1 (NDST1), mRNA | 1 |
| 1 | 47 | NF1 | SEQ ID 153 | neurofibromin 1 (NF1), transcript variant 2, mRNA | 1 |
| 1 | 47 | NF1 | SEQ ID 154 | neurofibromin 1 (NF1), transcript variant 1, mRNA | 1 |
| 1 | 47 | NF1 | SEQ ID 155 | neurofibromin 1 (NF1), transcript variant 3, mRNA | 1 |
| 1 | 48 | NFIB | SEQ ID 156 | nuclear factor I/B (NFIB), transcript variant 1, mRNA | 1 |
| 1 | 48 | NFIB | SEQ ID 157 | nuclear factor I/B (NFIB), transcript variant 2, mRNA | 1 |
| 1 | 48 | NFIB | SEQ ID 158 | nuclear factor I/B (NFIB), transcript variant 3, mRNA | 1 |
| 1 | 49 | PLXNA4 | SEQ ID 159 | plexin A4 (PLXNA4), transcript variant 3, mRNA | 1 |
| 1 | 49 | PLXNA4 | SEQ ID 160 | plexin A4 (PLXNA4), transcript variant 1, mRNA | 1 |
| 1 | 50 | PRDX1 | SEQ ID 161 | peroxiredoxin 1 (PRDX1), transcript variant 4, mRNA | 1 |
| 1 | 50 | PRDX1 | SEQ ID 162 | peroxiredoxin 1 (PRDX1), transcript variant 1, mRNA | 1 |
| 1 | 50 | PRDX1 | SEQ ID 163 | peroxiredoxin 1 (PRDX1), transcript variant 2, mRNA | 1 |
| 1 | 50 | PRDX1 | SEQ ID 164 | peroxiredoxin 1 (PRDX1), transcript variant 3, mRNA | 1 |
| 1 | 51 | SYAP1 | SEQ ID 165 | synapse associated protein 1 (SYAP1), transcript variant 1, mRNA | 1 |
| 1 | 51 | SYAP1 | SEQ ID 166 | synapse associated protein 1 (SYAP1), transcript variant 2, non-coding RNA | 1 |
| 1 | 51 | SYAP1 | SEQ ID 165 | synapse associated protein 1 (SYAP1), transcript variant 1, mRNA | 1 |
| 1 | 51 | SYAP1 | SEQ ID 166 | synapse associated protein 1 (SYAP1), transcript variant 2, non-coding RNA | 1 |
| 2 | 52 | LOC100653515 | SEQ ID 167 | differential display clone 8 (LOC100653515), transcript variant 2, mRNA | 2 |
| 2 | 52 | LOC100653515 | SEQ ID 168 | differential display clone 8 (LOC100653515), transcript variant 2, mRNA | 2 |
| 2 | 53 | TIMP2 | SEQ ID 169 | TIMP metallopeptidase inhibitor 2 (TIMP2), mRNA | 2 |
| 1 | 54 | VPS11 | SEQ ID 170 | vacuolar protein sorting 11 homolog (*S. cerevisiae*) (VPS11), mRNA | 1 |
| 1 | 55 | WASF2 | SEQ ID 171 | WAS protein family, member 2 (WASF2), transcript variant 2, mRNA | 1 |
| 1 | 55 | WASF2 | SEQ ID 172 | WAS protein family, member 2 (WASF2), transcript variant 1, mRNA | 1 |
| 3 | 56 | NSDHL | SEQ ID 173 | NAD(P) dependent steroid dehydrogenase-like (NSDHL), transcript variant 2, mRNA | 3 |
| 3 | 57 | ZNF185 | SEQ ID 174 | zinc finger protein 185 (LIM domain) (ZNF185), transcript variant 1, mRNA | 3 |
| 3 | 57 | ZNF185 | SEQ ID 175 | zinc finger protein 185 (LIM domain) (ZNF185), transcript variant 2, mRNA | 3 |
| 3 | 57 | ZNF185 | SEQ ID 176 | *Homo sapiens* zinc finger protein 185 (LIM domain) (ZNF185), transcript variant 3, mRNA | 3 |
| 3 | 57 | ZNF185 | SEQ ID 177 | zinc finger protein 185 (LIM domain) (ZNF185), transcript variant 5, mRNA | 3 |
| 3 | 57 | ZNF185 | SEQ ID 178 | zinc finger protein 185 (LIM domain) (ZNF185), transcript variant 6, mRNA | 3 |
| 3 | 57 | ZNF185 | SEQ ID 179 | zinc finger protein 185 (LIM domain) (ZNF185), transcript variant 7, mRNA | 3 |
| 3 | 58 | CETN2 | SEQ ID 180 | centrin, EF-hand protein, 2 (CETN2), mRNA | 3 |

TABLE 2-continued

| | | | | | |
|---|---|---|---|---|---|
| 3 | 57 | ZNF185 | SEQ ID 181 | zinc finger protein 185 (LIM domain) (ZNF185), transcript variant 4, mRNA | 3 |
| 3 | 58 | NSDHL | SEQ ID 182 | NAD(P) dependent steroid dehydrogenase-like (NSDHL), transcript variant 1, mRNA | 3 |
| 2 | 59 | LRRC7 | SEQ ID 183 | leucine rich repeat containing 7 (LRRC7), mRNA | 2 |
| 2 | 60 | PIN1L | SEQ ID 184 | peptidylprolyl cis/trans isomerase, NIMA-interacting 1 pseudogene 1 (PIN1P1), non-coding RNA | 2 |
| 1 | 61 | YWHAE | SEQ ID 185 | tyrosine 3-monooxygenase/tryptophan 5-monooxygenase activation protein, epsilon polypeptide (YWHAE), transcript variant 1, mRNA | 1 |
| 1 | 61 | YWHAE | SEQ ID 186 | tyrosine 3-monooxygenase/tryptophan 5-monooxygenase activation protein, epsilon polypeptide (YWHAE), transcript variant 2, non-coding RNA | 1 |
| 1 | 61 | YWHAE | SEQ ID 185 | tyrosine 3-monooxygenase/tryptophan 5-monooxygenase activation protein, epsilon polypeptide (YWHAE), transcript variant 1, mRNA | 1 |
| 1 | 61 | YWHAE | SEQ ID 186 | tyrosine 3-monooxygenase/tryptophan 5-monooxygenase activation protein, epsilon polypeptide (YWHAE), transcript variant 2, non-coding RNA | 1 |
| 1 | 62 | ZNF517 | SEQ ID 187 | zinc finger protein 517 (ZNF517), mRNA | 1 |
| 1 | 62 | ZNF517 | SEQ ID 187 | zinc finger protein 517 (ZNF517), mRNA | 1 |
| 2 | 63 | ASMTL | SEQ ID 188 | acetylserotonin O-methyltransferase-like (ASMTL), transcript variant 2, mRNA | 2 |
| 2 | 63 | ASMTL | SEQ ID 189 | acetylserotonin O-methyltransferase-like (ASMTL), transcript variant 3, mRNA | 2 |
| 2 | 63 | ASMTL | SEQ ID 190 | acetylserotonin O-methyltransferase-like (ASMTL), transcript variant 1, mRNA | 2 |
| 2 | 64 | P2RY8 | SEQ ID 191 | purinergic receptor P2Y, G-protein coupled, 8 (P2RY8), mRNA | 2 |
| 1 | 65 | RAP1B | SEQ ID 192 | RAP1B, member of RAS oncogene family (RAP1B), transcript variant 2, mRNA | 1 |
| 1 | 65 | RAP1B | SEQ ID 193 | *Homo sapiens* RAP1B, member of RAS oncogene family (RAP1B), transcript variant 3, mRNA | 1 |
| 1 | 65 | RAP1B | SEQ ID 194 | *Homo sapiens* RAP1B, member of RAS oncogene family (RAP1B), transcript variant 4, mRNA | 1 |
| 1 | 65 | RAP1B | SEQ ID 195 | *Homo sapiens* RAP1B, member of RAS oncogene family (RAP1B), transcript variant 5, mRNA | 1 |
| 1 | 65 | RAP1B | SEQ ID 196 | *Homo sapiens* RAP1B, member of RAS oncogene family (RAP1B), transcript variant 6, mRNA | 1 |
| 1 | 65 | RAP1B | SEQ ID 197 | RAP1B, member of RAS oncogene family (RAP1B), transcript variant 1, mRNA | 1 |
| 1 | 66 | CLIC5 | SEQ ID 198 | chloride intracellular channel 5 (CLIC5), nuclear gene encoding mitochondrial protein, transcript variant 1, mRNA | 1 |
| 1 | 66 | CLIC5 | SEQ ID 199 | *Homo sapiens* chloride intracellular channel 5 (CLIC5), nuclear gene encoding mitochondrial protein, transcript variant 3, mRNA | 1 |
| 1 | 66 | CLIC5 | SEQ ID 200 | chloride intracellular channel 5 (CLIC5), nuclear gene encoding mitochondrial protein, transcript variant 2, mRNA | 1 |
| 1 | 66 | CLIC5 | SEQ ID 201 | *Homo sapiens* chloride intracellular channel 5 (CLIC5), transcript variant 4, non-coding RNA | 1 |
| 1 | 66 | CLIC5 | SEQ ID 202 | *Homo sapiens* chloride intracellular channel 5 (CLIC5), transcript variant 5, non-coding RNA | 1 |
| 1 | 66 | CLIC5 | SEQ ID 203 | *Homo sapiens* chloride intracellular channel 5 (CLIC5), transcript variant 6, non-coding RNA | 1 |
| 2 | 67 | NDEL1 | SEQ ID 204 | nudE nuclear distribution gene E homolog (*A. nidulans*)-like 1 (NDEL1), transcript variant 1, mRNA | 2 |
| 2 | 68 | MYH10 | SEQ ID 205 | *Homo sapiens* myosin, heavy chain 10, non-muscle (MYH10), transcript variant 1, mRNA | 2 |
| 2 | 68 | MYH10 | SEQ ID 206 | *Homo sapiens* myosin, heavy chain 10, non-muscle (MYH10), transcript variant 3, mRNA | 2 |

TABLE 2-continued

| | | | | | |
|---|---|---|---|---|---|
| 2 | 68 | MYH10 | SEQ ID 207 | myosin, heavy chain 10, non-muscle (MYH10), mRNA | 2 |
| 2 | 67 | NDEL1 | SEQ ID 208 | nudE nuclear distribution gene E homolog (*A. nidulans*)-like 1 (NDEL1), transcript variant 2, mRNA | 2 |
| 1 | 69 | SHROOM3 | SEQ ID 209 | shroom family member 3 (SHROOM3), mRNA | 1 |

Hg18 March 2006 (NCBI Build 36.1)

Computer-Implemented Aspects

As understood by those of ordinary skill in the art, the methods and information described herein (genetic variation association with developmental disorders) can be implemented, in all or in part, as computer execuTable instructions on known computer readable media. For example, the methods described herein can be implemented in hardware. Alternatively, the method can be implemented in software stored in, for example, one or more memories or other computer readable medium and implemented on one or more processors. As is known, the processors can be associated with one or more controllers, calculation units and/or other units of a computer system, or implanted in firmware as desired. If implemented in software, the routines can be stored in any computer readable memory such as in RAM, ROM, flash memory, a magnetic disk, a laser disk, or other storage medium, as is also known. Likewise, this software can be delivered to a computing device via any known delivery method including, for example, over a communication channel such as a telephone line, the Internet, a wireless connection, etc., or via a transporTable medium, such as a computer readable disk, flash drive, etc.

More generally, and as understood by those of ordinary skill in the art, the various steps described above can be implemented as various blocks, operations, tools, modules and techniques which, in turn, can be implemented in hardware, firmware, software, or any combination of hardware, firmware, and/or software. When implemented in hardware, some or all of the blocks, operations, techniques, etc. can be implemented in, for example, a custom integrated circuit (IC), an application specific integrated circuit (ASIC), a field programmable logic array (FPGA), a programmable logic array (PLA), etc.

Results from such genotyping can be stored in a data storage unit, such as a data carrier, including computer databases, data storage disks, or by other convenient data storage means. In certain embodiments, the computer database is an object database, a relational database or a post-relational database. Data can be retrieved from the data storage unit using any convenient data query method.

When implemented in software, the software can be stored in any known computer readable medium such as on a magnetic disk, an optical disk, or other storage medium, in a RAM or ROM or flash memory of a computer, processor, hard disk drive, optical disk drive, tape drive, etc. Likewise, the software can be delivered to a user or a computing system via any known delivery method including, for example, on a computer readable disk or other transporTable computer storage mechanism.

The steps of the claimed methods can be operational with numerous other general purpose or special purpose computing system environments or configurations. Examples of well known computing systems, environments, and/or configurations that can be suitable for use with the methods or system of the claims include, but are not limited to, personal computers, server computers, hand-held or laptop devices, multiprocessor systems, microprocessor-based systems, set top boxes, programmable consumer electronics, network PCs, minicomputers, mainframe computers, distributed computing environments that include any of the above systems or devices, and the like.

The steps of the claimed method and system can be described in the general context of computer-execuTable instructions, such as program modules, being executed by a computer. Generally, program modules include routines, programs, objects, components, and/or data structures that perform particular tasks or implement particular abstract data types. The methods and apparatus can also be practiced in distributed computing environments where tasks are performed by remote processing devices that are linked through a communications network. In both integrated and distributed computing environments, program modules can be located in both local and remote computer storage media including memory storage devices. Numerous alternative embodiments could be implemented, using either current technology or technology developed after the filing date of this application, which would still fall within the scope of the claims defining the disclosure.

While the risk evaluation system and method, and other elements, have been described as preferably being implemented in software, they can be implemented in hardware, firmware, etc., and can be implemented by any other processor. Thus, the elements described herein can be implemented in a standard multi-purpose CPU or on specifically designed hardware or firmware such as an application-specific integrated circuit (ASIC) or other hard-wired device as desired. When implemented in software, the software routine can be stored in any computer readable memory such as on a magnetic disk, a laser disk, or other storage medium, in a RAM or ROM of a computer or processor, in any database, etc. Likewise, this software can be delivered to a user or a screening system via any known or desired delivery method including, for example, on a computer readable disk or other transporTable computer storage mechanism or over a communication channel, for example, a telephone line, the internet, or wireless communication. Modifications and variations can be made in the techniques and structures described and illustrated herein without departing from the spirit and scope of the present disclosure.

ASD Therapeutics

Resarch into a cure for Pervasive Developmental Disorders (PDD), such as ASD or Pervasive Developmental Disorders—Not Otherwise Specified (PDD-NOS), such as Asperger Syndrome, Rett Syndrome, fragile X syndrome, and/or Childhood Disintegrative Disorder is ongoing. Ways to help minimize the symptoms of autism and to maximize learning exist, including but not limited to, behavioral therapy, educational and/or school-based options, and medication options, although currently there are no medications that can cure autism spectrum disorders or all of the symptoms. The U.S. Food and Drug Administration has not yet approved any medications specifically for the treatment of autism, but in many cases medication can treat some of the symptoms associated with autism. These treatments can include behavior management therapy to help reinforce wanted behaviors and reduce unwanted behaviors, which is often based on Applied Behavior Analysis (ABA), use of speech-language therapists to help people with autism improve their ability to communicate and interact with others, use of occupational therapists to help people find ways to adjust tasks to match their needs and abilities, and physical therapists design activities and exercise to build motor control and improve posture and balance, free appropriate public education from age 3 through high school or age 21, integration of a team of people, including the parents, teachers, caregivers, school psychologists, and other child development specialists to work together to design an Individualized Education Plan (IEP) to help guide the child's school experiences, selective serotonin reuptake inhibitors (SSRIs), tricyclics, psychoactive/anti-psychotics, stimulants, and anti-anxiety drugs are among the medications that a health care provider might use to treat symptoms of autism spectrum disorders.

A person skilled in the art will appreciate and understand that the genetic variants described herein in general may not, by themselves, provide an absolute identification of individuals who will develop a developmental disorder or related conditions. The variants described herein can indicate increased and/or decreased likelihood that individuals carrying the at-risk or protective variants of the disclosure will develop symptoms associated with a developmental disorder. This information can be used to, for example, initiate preventive measures at an early stage, perform regular physical and/or mental exams to monitor the progress and/or appearance of symptoms, or to schedule exams at a regular interval to identify early symptoms, so as to be able to apply treatment at an early stage. This is in particular important since developmental disorders and related disorders are heterogeneous disorders with symptoms that can be individually vague. Screening criteria require a number of symptoms to be present over a period of time; therefore, it is important to be able to establish additional risk factors that can aid in the screening, or facilitate the screening through in-depth phenotyping and/or more frequent examination, or both. For example, individuals with early symptoms that typically are not individually associated with a clinical screening of a developmental disorder and carry an at-risk genetic variation can benefit from early therapeutic treatment, or other preventive measure, or more rigorous supervision or more frequent examination. Likewise, individuals that have a family history of the disease, or are carriers of other risk factors associated with a developmental disorder can, in the context of additionally carrying at least one at-risk genetic variation, benefit from early therapy or other treatment.

Early symptoms of behavioral disorders such as a developmental disorder and related conditions may not be sufficient to fulfill standardized screening criteria. To fulfill those, a certain pattern of symptoms and behavioral disturbance needs to manifest itself over a period of time. Sometimes, certain physical characteristics can also be present. This makes at-risk genetic variants valuable in a screening setting, in particular high-risk variants. Determination of the presence of such variants warrants increased monitoring of the individual in question. Appearance of symptoms combined with the presence of such variants facilitates early screening, which makes early treatment possible. Genetic testing can thus be used to aid in the screening of disease in its early stages, before all criteria for formal screening criteria are all fulfilled. It is well established that early treatment is extremely important for developmental disorders and related disorders, which lends further support to the value of genetic testing for early diagnosis, prognosis, or theranosis of these disorders.

The present disclosure provides methods for identifying compounds or agents that can be used to treat a developmental disorder. Thus, the genetic variations and associated proteins of the disclosure are useful as targets for the identification and/or development of therapeutic agents. In certain embodiments, such methods include assaying the ability of an agent or compound to modulate the activity and/or expression of a nucleic acid that is associated with at least one genetic variation described herein (Table 1), encoded products of the gene sequence, and any other molecules or proteins associated with these genes. This in turn can be used to identify agents or compounds that inhibit, enhance, or alter the undesired activity, localization, binding and/or expression of the encoded nucleic acid product, such as mRNA or polypeptides. For example, in some embodiments, small molecule drugs can be developed to target the aberrant protein(s) or RNA(s) resulting from specific disease-causing mutation(s) within a gene, such as described in: Peitz et al. (2009) RNA Biology 6(3):329-34; Van Goor et al. (2009) Proc. Natl. Acad. Sci. USA 106(44): 18825-30; Van Goor et al. (2011) Proc. Natl. Acad. Sci. USA 108(46):18843-8; Ramsey et al. (2011) N. Engl. J. Med. 365(18):1663-72. The proteins associated with the CNVs listed in Table 1 are described in Table 2 as the accession number (accession) of mRNAs that would encode said proteins. Assays for performing such experiments can be performed in cell-based systems or in cell-free systems, as known to the skilled person. Cell-based systems include cells naturally expressing the nucleic acids of interest, or recombinant cells that have been genetically modified so as to express a certain desired nucleic acid molecule.

Variant gene expression in a subject can be assessed by expression of a variant-containing nucleic acid sequence or by altered expression of a normal/wild-type nucleic acid sequence due to variants affecting the level or pattern of expression of the normal transcripts, for example, variants in the regulatory or control region of the gene. Assays for gene expression include direct nucleic acid assays (mRNA), assays for expressed protein levels, or assays of collateral compounds involved in a pathway, for example, a signal pathway. Furthermore, the expression of genes that are up- or down-regulated in response to the signal pathway can also be assayed. Some embodiments includes operably linking a reporter gene, such as luciferase, to the regulatory region of one or more gene of interest.

Modulators of gene expression can in some embodiments be identified when a cell is contacted with a candidate compound or agent, and the expression of mRNA is determined. The expression level of mRNA in the presence of the candidate compound or agent is compared to the expression level in the absence of the compound or agent. Based on this comparison, candidate compounds or agents for treating a developmental disorder can be identified as those modulating the gene expression of the variant gene, or gene expression of one or more other genes occurring within the same biological pathway or known, for example, to be binding partners of the variant gene. When expression of mRNA or the encoded protein is statistically significantly greater in the presence of the candidate compound or agent than in its absence, then the candidate compound or agent is identified as a stimulator or up-regulator of expression of the nucleic acid. When nucleic acid expression or protein level is statistically significantly less in the presence of the candidate compound or agent than in its absence, then the candidate compound can be identified as an inhibitor or down-regulator of the nucleic acid expression. The disclosure further provides methods of treatment using a compound identified through drug (compound and/or agent) screening as a gene modulator.

The genetic variations described herein can be used to identify novel therapeutic targets for a developmental disorder. For example, genes containing, or in linkage disequilibrium with, the genetic variations, or their products, as well as genes or their products that are directly or indirectly regulated by or interact with these variant genes or their products, can be targeted for the development of therapeutic agents to treat a developmental disorder, or prevent or delay onset of symptoms associated with a developmental disorder. Therapeutic agents can comprise one or more of, for example, small non-protein and non-nucleic acids, proteins, peptides, protein fragments, nucleic acids (DNA, RNAJ, PNA (peptide nucleic acids), or their derivatives or mimetics which can modulate the function and/or levels of the target genes or their gene products. In some embodiments, treatment of ASD can comprise treatment of one of the genes, or gene products derived thereof, such as mRNA or a polypeptide, with one or more of the therapeutics disclosed herein. In some embodiments, treatment of ASD can comprise treatment of 2 or 3, or 4, or 5, or 6, or 7, or 8, or 9, or 10 or more of the genes, or gene products derived there from, with 2 or 3, or 4, or 5, or 6, or 7, or 8, or 9, or 10 or more of the therapeutics disclosed herein.

RNA Therapeutics

The nucleic acids and/or variants of the disclosure, or nucleic acids comprising their complementary sequence, can be used as antisense constructs to control gene expression in cells, tissues or organs. The methodology associated with antisense techniques is well known to the skilled artisan, and is described and reviewed in Antisense Drug Technology: Principles, Strategies, and Applications, Crooke, Marcel Dekker Inc., New York (2001) In general, antisense nucleic acids are designed to be complementary to a region of mRNA expressed by a gene, so that the antisense molecule hybridizes to the mRNA, thus blocking translation of the mRNA into protein Several classes of antisense oligonucleotide are known to those skilled in the art, including cleavers and blockers. The former bind to target RNA sites, activate intracellular nucleases {e.g., Rnase H or Rnase L) that cleave the target RNA. Blockers bind to target RNA, inhibit protein translation by steric hindrance of the ribosomes. Examples of blockers include nucleic acids, morpholino compounds, locked nucleic acids and methylphosphonates (Thompson, Drug Discovery Today, 7:912-917 (2002)) Antisense oligonucleotides are useful directly as therapeutic agents, and are also useful for determining and validating gene function, for example, by gene knock-out or gene knock-down experiments. Antisense technology is further described in Layery et al., Curr. Opin. Drug Discov Devel 6 561-569 (2003), Stephens et al., Curr. Opin. Mol. Ther. 5.118-122 (2003), Kurreck, Eur. J. Biochem. 270.1628-44 (2003), Dias et al, Mol Cancer Ter. 1-347-55 (2002), Chen, Methods Mol. Med. 75:621-636 (2003), Wang et al., Curr Cancer Drug Targets 1.177-96 (2001), and Bennett, Antisense Nucleic Acid Drug. Dev. 12 215-24 (2002)

The variants described herein can be used for the selection and design of antisense reagents that are specific for particular variants (e.g., particular genetic variations, or polymorphic markers in LD with particular genetic variations). Using information about the variants described herein, antisense oligonucleotides or other antisense molecules that specifically target mRNA molecules that contain one or more variants of the disclosure can be designed. In this manner, expression of mRNA molecules that contain one or more variant of the present disclosure (markers and/or haplotypes) can be inhibited or blocked. In some embodiments, the antisense molecules are designed to specifically bind a particular allelic form (i.e., one or several variants (alleles and/or haplotypes)) of the target nucleic acid, thereby inhibiting translation of a product originating from this specific allele or haplotype, but which do not bind other or alternate variants at the specific polymorphic sites of the target nucleic acid molecule.

As antisense molecules can be used to inactivate mRNA so as to inhibit gene expression, and thus protein expression, the molecules can be used to treat a disease or disorder, such as a developmental disorder. The methodology can involve cleavage by means of ribozymes containing nucleotide sequences complementary to one or more regions in the mRNA that attenuate the ability of the mRNA to be translated. Such mRNA regions include, for example, protein-coding regions, in particular protein-coding regions corresponding to catalytic activity, substrate and/or ligand binding sites, or other functional domains of a protein.

The phenomenon of RNA interference (RNAi) has been actively studied for the last decade, since its original discovery in C. elegans (Fire et al., Nature 391:806-11 (1998)), and in recent years its potential use in treatment of human disease has been actively pursued (reviewed in Kim & Rossi, Nature Rev, Genet. 8: 173-204 (2007)). RNA interference (RNAi), also called gene silencing, is based on using double-stranded RNA molecules (dsRNA) to turn off specific genes. In the cell, cytoplasmic double-stranded RNA molecules (dsRNA) are processed by cellular complexes into small interfering RNA (siRNA). The siRNA guide the targeting of a protein-RNA complex to specific sites on a target mRNA, leading to cleavage of the mRNA (Thompson, Drug Discovery Today, 7:912-917 (2002)). The siRNA molecules are typically about 20, 21, 22 or 23 nucleotides in length. Thus, one aspect of the disclosure relates to isolated nucleic acid sequences, and the use of those molecules for RNA interference, for example, as small interfering RNA molecules (siRNA). In some embodiments, the isolated nucleic acid sequences can be 18-26 nucleotides in length, preferably 19-25 nucleotides in length, more preferably 20-24 nucleotides in length, and more preferably 21, 22 or 23 nucleotides in length.

Another pathway for RNAi-mediated gene silencing originates in endogenously encoded primary microRNA (pn-miRNA) transcripts, which are processed in the cell to generate precursor miRNA (pre-miRNA). These miRNA molecules are exported from the nucleus to the cytoplasm, where they undergo processing to generate mature miRNA molecules (miRNA), which direct translational inhibition by recognizing target sites in the 3' untranslated regions of mRNAs, and subsequent mRNA degradation by processing P-bodies (reviewed in Kim & Rossi, Nature Rev. Genet. 8: 173-204 (2007)).

Clinical applications of RNAi include the incorporation of synthetic siRNA duplexes, which preferably are approximately 20-23 nucleotides in size, and preferably have 3' overlaps of 2 nucleotides. Knockdown of gene expression is established by sequence-specific design for the target mRNA. Several commercial sites for optimal design and synthesis of such molecules are known to those skilled in the art.

Other applications provide longer siRNA molecules (typically 25-30 nucleotides in length, preferably about 27 nucleotides), as well as small hairpin RNAs (shRNAs; typically about 29 nucleotides in length). The latter are naturally expressed, as described in Amarzguioui et al. (FEBS Lett. 579:5974-81 (2005)). Chemically synthetic siRNAs and shRNAs are substrates for in vivo processing, and in some cases provide more potent gene-silencing than shorter designs (Kim et al., Nature Biotechnol. 23:222-226 (2005); Siola et al., Nature Biotechnol. 23:227-231 (2005)). In general siRNAs provide for transient silencing of gene expression, because their intracellular concentration is diluted by subsequent cell divisions. By contrast, expressed shRNAs mediate long-term, stable knockdown of target transcripts, for as long as transcription of the snRNA takes place (Marques et al., Nature Biotechnol. 23.559-565 (2006), Brummelkamp et al., Science 296. 550-553 (2002)).

Since RNAi molecules, including siRNA, miRNA and snRNA, act in a sequence-dependent manner, variants described herein can be used to design RNAi reagents that recognize specific nucleic acids comprising specific genetic variations, alleles and/or haplotypes, while not recognizing nucleic acid sequences not comprising the genetic variation, or comprising other alleles or haplotypes. These RNAi reagents can thus recognize and destroy the target nucleic acid sequences. As with antisense reagents, RNAi reagents can be useful as therapeutic agents (i.e., for turning off disease-associated genes or disease-associated gene variants), but can also be useful for characterizing and validating gene function (e.g., by gene knock-out or gene knock-down experiments).

Delivery of RNAi can be performed by a range of methodologies known to those skilled in the art. Methods utilizing non-viral delivery include cholesterol, stable nucleic acid-lipid particle (SNALP), heavy-chain antibody fragment (Fab), aptamers and nanoparticles Viral delivery methods include use of lentivirus, adenovirus and adeno-associated virus The siRNA molecules are in some embodiments chemically modified to increase their stability. This can include modifications at the 2' position of the ribose, including 2'-β-methylpunnes and 2'-fluoropyrimidmes, which provide resistance to RNase activity. Other chemical modifications are possible and known to those skilled in the art.

The following references provide a further summary of RNAi, and possibilities for targeting specific genes using RNAi: Kim & Rossi, Nat. Rev. Genet. 8: 173-184 (2007), Chen & Rajewsky, Nat. Rev. Genet. 8: 93-103 (2007), Reynolds, et al., Nat. Biotechnol 22 326-330 (2004), Chi et al., Proc. Natl. Acad. Sa. USA 100-6343-6346 (2003), Vickers et al., J Biol. Chem. 278:7108-7118 (2003), Agami, Curr Opin. Chem. Biol. 6:829-834 (2002), Layery, et al., Curr. Opin. Drug Discov. Devel. 6:561-569 (2003), Shi, Trends Genet. 19:9-12 (2003), Shuey et al., Drug Discov. Today 7 1040-46 (2002), McManus et al., Nat. Rev. Genet. 3.737-747 (2002), Xia et al., Nat. Biotechnol. 20.1006-10 (2002), Plasterk et al., Curr. Opin Genet. Dev. 10 562-7 (2000), Bosher et al., Nat. Cell Biol. 2:E31-6 (2000), and Hunter, Curr. Biol. 9:R440-442 (1999).

A genetic defect leading to increased predisposition or risk for development of a disease, including a developmental disorder, or a defect causing the disease, can be corrected permanently by administering to a subject carrying the defect a nucleic acid fragment that incorporates a repair sequence that supplies the normal/wild-type nucleotide(s) at the site of the genetic defect. Such site-specific repair sequence can encompass an RNA/DNA oligonucleotide that operates to promote endogenous repair of a subject's genomic DNA. The administration of the repair sequence can be performed by an appropriate vehicle, such as a complex with polyethelamine, encapsulated in anionic liposomes, a viral vector such as an adenovirus vector, or other pharmaceutical compositions suitable for promoting intracellular uptake of the administered nucleic acid. The genetic defect can then be overcome, since the chimeric oligonucleotides induce the incorporation of the normal sequence into the genome of the subject, leading to expression of the normal/wild-type gene product. The replacement is propagated, thus rendering a permanent repair and alleviation of the symptoms associated with the disease or condition.

Double stranded oligonucleotides are formed by the assembly of two distinct oligonucleotide sequences where the oligonucleotide sequence of one strand is complementary to the oligonucleotide sequence of the second strand; such double stranded oligonucleotides are generally assembled from two separate oligonucleotides (e.g., siRNA), or from a single molecule that folds on itself to form a double stranded structure (e.g., shRNA or short hairpin RNA). These double stranded oligonucleotides known in the art all have a common feature in that each strand of the duplex has a distinct nucleotide sequence, wherein only one nucleotide sequence region (guide sequence or the antisense sequence) has complementarity to a target nucleic acid sequence and the other strand (sense sequence) comprises nucleotide sequence that is homologous to the target nucleic acid sequence.

Double stranded RNA induced gene silencing can occur on at least three different levels: (i) transcription inactivation, which refers to RNA guided DNA or histone methylation; (ii) siRNA induced mRNA degradation; and (iii) mRNA induced transcriptional attenuation. It is generally considered that the major mechanism of RNA induced silencing (RNA interference, or RNAi) in mammalian cells is mRNA degradation. RNA interference (RNAi) is a mechanism that inhibits gene expression at the stage of translation or by hindering the transcription of specific genes. Specific RNAi pathway proteins are guided by the dsRNA to the targeted messenger RNA (mRNA), where they "cleave" the target, breaking it down into smaller portions that can no longer be translated into protein. Initial attempts to use RNAi in mammalian cells focused on the use of long strands of dsRNA. However, these attempts to induce RNAi met with limited success, due in part to the induction of the interferon response, which results in a general, as opposed to a target-specific, inhibition of protein synthesis. Thus, long dsRNA is not a viable option for RNAi in mammalian systems. Another outcome is epigenetic changes to a gene—histone modification and DNA methylation—affecting the degree the gene is transcribed.

More recently it has been shown that when short (18-30 bp) RNA duplexes are introduced into mammalian cells in culture, sequence-specific inhibition of target mRNA can be realized without inducing an interferon response. Certain of these short dsRNAs, referred to as small inhibitory RNAs ("siRNAs"), can act catalytically at sub-molar concentrations to cleave greater than 95% of the target mRNA in the cell. A description of the mechanisms for siRNA activity, as well as some of its applications are described in Provost et al., Ribonuclease Activity and RNA Binding of Recombinant Human Dicer, E.M.B.O. J., 2002 Nov. 1; 21(21): 5864-5874; Tabara et al. The dsRNA Binding Protein RDE-4 Interacts with RDE-1, DCR-1 and a DexH-box Helicase to Direct RNAi in C. elegans, Cell 2002, June 28; 109(7):861-71; Ketting et al., Dicer Functions in RNA Interference and in Synthesis of Small RNA Involved in Developmental Timing in *C. elegans*; Martinez et al., Single-Stranded Antisense siRNAs Guide Target RNA Cleavage in RNAi, Cell 2002, September. 6; 110(5):563; Hutvagner & Zamore, A microRNA in a multiple-turnover RNAi enzyme complex, Science 2002, 297:2056.

From a mechanistic perspective, introduction of long double stranded RNA into plants and invertebrate cells is broken down into siRNA by a Type III endonuclease known as Dicer. Sharp, RNA interference—2001, Genes Dev. 2001, 15:485. Dicer, a ribonuclease-III-like enzyme, processes the dsRNA into 19-23 base pair short interfering RNAs with characteristic two base 3' overhangs. Bernstein, Caudy, Hammond, & Hannon, Role for a bidentate ribonuclease in the initiation step of RNA interference, Nature 2001, 409: 363. The siRNAs are then incorporated into an RNA-induced silencing complex (RISC) where one or more helicases unwind the siRNA duplex, enabling the complementary antisense strand to guide target recognition (Nykanen, Haley, & Zamore, ATP requirements and small interfering RNA structure in the RNA interference pathway, *Cell* 2001, 107:309). Upon binding to the appropriate target mRNA, one or more endonucleases within the RISC cleaves the target to induce silencing. Elbashir, Lendeckel, & Tuschl, RNA interference is mediated by 21- and 22-nucleotide RNAs, Genes Dev 2001, 15:188, FIG. 1.

Generally, the antisense sequence is retained in the active RISC complex and guides the RISC to the target nucleotide sequence by means of complementary base-pairing of the antisense sequence with the target sequence for mediating sequence-specific RNA interference. It is known in the art that in some cell culture systems, certain types of unmodified siRNAs can exhibit "off target" effects. It is hypothesized that this off-target effect involves the participation of the sense sequence instead of the antisense sequence of the siRNA in the RISC complex (see for example, Schwarz et al., 2003, Cell, 115, 199-208). In this instance the sense sequence is believed to direct the RISC complex to a sequence (off-target sequence) that is distinct from the intended target sequence, resulting in the inhibition of the off-target sequence. In these double stranded nucleic acid sequences, each strand is complementary to a distinct target nucleic acid sequence. However, the off-targets that are affected by these dsRNAs are not entirely predicTable and are non-specific.

The term "siRNA" refers to small inhibitory RNA duplexes that induce the RNA interference (RNAi) pathway. These molecules can vary in length (generally between 18-30 basepairs) and contain varying degrees of complementarity to their target mRNA in the antisense strand. Some, but not all, siRNA have unpaired overhanging bases on the 5' or 3' end of the sense strand and/or the antisense strand. The term "siRNA" includes duplexes of two separate strands, as well as single strands that can form hairpin structures comprising a duplex region. Small interfering RNA (siRNA), sometimes known as short interfering RNA or silencing RNA, are a class of 20-25 nucleotide-long double-stranded RNA molecules that play a variety of roles in biology.

While the two RNA strands do not need to be completely complementary, the strands should be sufficiently complementary to hybridize to form a duplex structure. In some instances, the complementary RNA strand can be less than 30 nucleotides, preferably less than 25 nucleotides in length, more preferably 19 to 24 nucleotides in length, more preferably 20-23 nucleotides in length, and even more preferably 22 nucleotides in length. The dsRNA of the present disclosure can further comprise at least one single-stranded nucleotide overhang. The dsRNA of the present disclosure can further comprise a substituted or chemically modified nucleotide. As discussed in detail below, the dsRNA can be synthesized by standard methods known in the art.

siRNA can be divided into five (5) groups including non-functional, semi-functional, functional, highly functional, and hyper-functional based on the level or degree of silencing that they induce in cultured cell lines. As used herein, these definitions are based on a set of conditions where the siRNA is transfected into said cell line at a concentration of 100 nM and the level of silencing is tested at a time of roughly 24 hours after transfection, and not exceeding 72 hours after transfection. In this context, "non-functional siRNA" are defined as those siRNA that induce less than 50% (<50%) target silencing. "Semi-functional siRNA" induce 50-79% target silencing. "Functional siRNA" are molecules that induce 80-95% gene silencing. "Highly-functional siRNA" are molecules that induce greater than 95% gene silencing. "Hyperfunctional siRNA" are a special class of molecules. For purposes of this document, hyperfunctional siRNA are defined as those molecules that: (1) induce greater than 95% silencing of a specific target when they are transfected at subnanomolar concentrations (i.e., less than one nanomolar); and/or (2) induce functional (or better) levels of silencing for greater than 96 hours. These relative functionalities (though not intended to be absolutes) can be used to compare siRNAs to a particular target for applications such as functional genomics, target identification and therapeutics.

microRNAs (miRNA) are single-stranded RNA molecules of about 21-23 nucleotides in length, which regulate gene expression. miRNAs are encoded by genes that are transcribed from DNA but not translated into protein (non-coding RNA); instead they are processed from primary transcripts known as pri-miRNA to short stem-loop structures called pre-miRNA and finally to functional miRNA. Mature miRNA molecules are partially complementary to one or more messenger RNA (mRNA) molecules, and their main function is to downregulate gene expression.

Antibody-Based Therapeutics

The present disclosure embodies agents that modulate a peptide sequence or RNA expressed from a gene associated with a developmental disorder. The term biomarker, as used herein, can comprise a genetic variation of the present disclosure or a gene product, for example, RNA and polypeptides, of any one of the genes listed in Table 2. Such modulating agents include, but are not limited to, proteins, peptides, peptidomimetics, peptoids, or any other forms of a molecule, which bind to, and alter the signaling or function associated with the a developmental disorder associated biomarker, have an inhibitory or stimulatory effect on the developmental disorder associated biomarkers, or have a stimulatory or inhibitory effect on the expression or activity of the a developmental disorder associated biomarkers' ligands, for example, polyclonal antibodies and/or monoclonal antibodies that specifically bind one form of the gene product but not to the other form of the gene product are also provided, or which bind a portion of either the variant or the reference gene product that contains the polymorphic site or sites.

In some embodiments, the present disclosure provides antibody-based agents targeting a developmental disorder associated biomarkers. The antibody-based agents in any suitable form of an antibody e.g., monoclonal, polyclonal, or synthetic, can be utilized in the therapeutic methods disclosed herein. The antibody-based agents include any target-binding fragment of an antibody and also peptibodies, which are engineered therapeutic molecules that can bind to human drug targets and contain peptides linked to the constant domains of antibodies. In some embodiments, the antibodies used for targeting a developmental disorder associated biomarkers are humanized antibodies. Methods for humanizing antibodies are well known in the art. In another embodiment, the therapeutic antibodies comprise an antibody generated against a developmental disorder associated biomarkers described in the present disclosure, wherein the antibodies are conjugated to another agent or agents, for example, a cytotoxic agent or agents.

The term "antibody" as used herein refers to immunoglobulin molecules and immunologically active portions of immunoglobulin molecules, i.e., molecules that contain antigen-binding sites that specifically bind an antigen. A molecule that specifically binds to a polypeptide of the disclosure is a molecule that binds to that polypeptide or a fragment thereof, but does not substantially bind other molecules in a sample, e.g., a biological sample, which naturally contains the polypeptide. Examples of immunologically active portions of immunoglobulin molecules include F(ab) and F(ab')2 fragments which can be generated by treating the antibody with an enzyme such as pepsin. The disclosure provides polyclonal and monoclonal antibodies that bind to a polypeptide of the disclosure. The term "monoclonal antibody" or "monoclonal antibody composition", as used herein, refers to a population of antibody molecules that contain only one species of an antigen binding site capable of immunoreacting with a particular epitope of a polypeptide of the disclosure. A monoclonal antibody composition thus typically displays a single binding affinity for a particular polypeptide of the disclosure with which it immunoreacts.

Polyclonal antibodies can be prepared as described above by immunizing a suitable subject with a desired immunogen, e.g., polypeptide of the disclosure or a fragment thereof. The antibody titer in the immunized subject can be monitored over time by standard techniques, such as with an enzyme linked immunosorbent assay (ELISA) using immobilized polypeptide. If desired, the antibody molecules directed against the polypeptide can be isolated from the mammal (e.g., from the blood) and further purified by well-known techniques, such as protein A chromatography to obtain the IgG fraction. At an appropriate time after immunization, e.g., when the antibody titers are highest, antibody-producing cells can be obtained from the subject and used to prepare monoclonal antibodies by standard techniques, such as the hybndoma technique originally described by Kohler and Milstein, Nature 256:495-497 (1975), the human B cell hybridoma technique (Kozbor et al., Immunol. Today 4: 72 (1983)), the EBV-hybndoma technique (Cole et al., Monoclonal Antibodies and Cancer Therapy, Alan R. Liss (1985) Inc., pp. 77-96) or trioma techniques. The technology for producing hybndomas is well known (see generally Current Protocols in Immunology (1994) Coligan et al., (eds.) John Wiley & Sons, Inc., New York, N.Y.). Briefly, an immortal cell line (typically a myeloma) is fused to lymphocytes (typically splenocytes) from a mammal immunized with an immunogen as described above, and the culture supernatants of the resulting hybridoma cells are screened to identify a hybridoma producing a monoclonal antibody that binds a polypeptide of the disclosure.

Any of the many well known protocols used for fusing lymphocytes and immortalized cell lines can be applied for the purpose of generating a monoclonal antibody to a polypeptide of the disclosure (see, e.g., Current Protocols in Immunology, supra; Galfre et al., Nature 266:55052 (1977); R. H. Kenneth, in Monoclonal Antibodies: A New Dimension In Biological Analyses, Plenum Publishing Corp., New York, N.Y. (1980); and Lerner, Yale J. Biol. Med. 54:387-402 (1981)). Moreover, the ordinarily skilled worker can appreciate that there are many variations of such methods that also would be useful. Alternative to preparing monoclonal antibody-secreting hybridomas, a monoclonal antibody to a polypeptide of the disclosure can be identified and isolated by screening a recombinant combinatorial immunoglobulin library (e.g., an antibody phage display library) with the polypeptide to thereby isolate immunoglobulin library members that bind the polypeptide. Kits for generating and screening phage display libraries are commercially available (e.g., the Pharmacia Recombinant Phage Antibody System, Catalog No. 27-9400-01; and the Stratagene SurfZAP$^a$ Phage Display Kit, Catalog No. 240612). Additionally, examples of methods and reagents particularly amenable for use in generating and screening antibody display library can be found in, for example, U.S. Pat. No. 5,223,409; PCT Publication Nos. WO 92/18619, WO 91/17271, WO 92/20791, WO 92/15679; WO 93/01288, WO 92/01047, WO 92/09690, and WO 90/02809; Fuchs et al., Bio/Technology 9: 1370-1372 (1991); Hay et al., Hum. Antibod. Hybndomas 3:81-85 (1992); Huse et al., Science 246: 1275-1281 (1989); and Griffiths et al., EMBO J. 12:725-734 (1993).

Additionally, recombinant antibodies, such as chimeric and humanized monoclonal antibodies, comprising both human and non-human portions, which can be made using standard recombinant DNA techniques, are within the scope of the disclosure. Such chimeric and humanized monoclonal antibodies can be produced by recombinant DNA techniques known in the art.

In general, antibodies of the disclosure (e.g., a monoclonal antibody) can be used to isolate a polypeptide of the disclosure by standard techniques, such as affinity chromatography or immunoprecipitation. A polypeptide-specific antibody can facilitate the purification of natural polypeptide from cells and of recombinants produced polypeptide expressed in host cells. Moreover, an antibody specific for a polypeptide of the disclosure can be used to detect the polypeptide (e.g., in a cellular lysate, cell supernatant, or tissue sample) in order to evaluate the abundance and pattern of expression of the polypeptide. Antibodies can be used diagnostically, prognostically, or theranostically to monitor protein levels in tissue as part of a clinical testing procedure, e.g., to, for example, determine the efficacy of a given treatment regimen. The antibody can be coupled to a detecTable substance to facilitate its detection. Examples of detecTable substances include various enzymes, prosthetic groups, fluorescent materials, luminescent materials, bioluminescent materials, and radioactive materials. Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotnazinylamine fluorescein, dansyl chloride or phycoerythnn; an example of a luminescent material includes luminol; examples of bioluminescent materials include luciferase, luciferin, and aequorin, and examples of suitable radioactive material include $^{125}$I, $^{131}$I, $^{35}$S or $^{3}$H. Antibodies can also be useful in pharmacogenomic analysis. In such embodiments, antibodies against variant proteins encoded by nucleic acids according to the disclosure, such as variant proteins that are encoded by nucleic acids that contain at least one genetic variation of the disclosure, can be used to identify individuals that require modified treatment modalities.

Antibodies can furthermore be useful for assessing expression of variant proteins in disease states, such as in active stages of a disease, or in an individual with a predisposition to a disease related to the function of the protein, in particular a developmental disorder. Antibodies specific for a variant protein of the present disclosure that is encoded by a nucleic acid that comprises at least one polymorphic marker or haplotype as described herein can be used to screen for the presence of the variant protein, for example, to screen for a predisposition to a developmental disorder as indicated by the presence of the variant protein.

Antibodies can be used in other methods. Thus, antibodies are useful as screening tools for evaluating proteins, such as variant proteins of the disclosure, in conjunction with analysis by electrophoretic mobility, isoelectric point, tryptic or other protease digest, or for use in other physical assays known to those skilled in the art. Antibodies can also be used in tissue typing. In one such embodiment, a specific variant protein has been correlated with expression in a specific tissue type, and antibodies specific for the variant protein can then be used to identify the specific tissue type.

Subcellular localization of proteins, including variant proteins, can also be determined using antibodies, and can be applied to assess aberrant subcellular localization of the protein in cells in various tissues. Such use can be applied in genetic testing, but also in monitoring a particular treatment modality. In the case where treatment is aimed at correcting the expression level or presence of the variant protein or aberrant tissue distribution or developmental expression of the variant protein, antibodies specific for the variant protein or fragments thereof can be used to monitor therapeutic efficacy.

Antibodies are further useful for inhibiting variant protein function, for example, by blocking the binding of a variant protein to a binding molecule or partner. Such uses can also be applied in a therapeutic context in which treatment involves inhibiting a variant protein's function. An antibody can be for example, be used to block or competitively inhibit binding, thereby modulating (i.e., agonizing or antagonizing) the activity of the protein. Antibodies can be prepared against specific protein fragments containing sites required for specific function or against an intact protein that is associated with a cell or cell membrane.

The present disclosure also embodies the use of any pharmacologic agent that can be conjugated to an antibody or an antibody binding fragment, and delivered in active form. Examples of such agents include cytotoxins, radio-isotopes, hormones such as a steroid, anti-metabolites such as cytosines, and chemotherapeutic agents. Other embodiments can include agents such as a coagulant, a cytokine, growth factor, bacterial endotoxin or a moiety of bacterial endotoxin. The targeting antibody-based agent directs the toxin to, and thereby selectively modulates the cell expressing the targeted surface receptor. In some embodiments, therapeutic antibodies employ cross-linkers that provide high in vivo stability (Thorpe et al., Cancer Res., 48:6396, 1988). In any event, it is proposed that agents such as these can, if desired, be successfully conjugated to antibodies or antibody binding fragments, in a manner that will allow their targeting, internalization, release or presentation at the site of the targeted cells expressing the ASD associated biomarkers as required using known conjugation technology. For administration in vivo, for example, an antibody can be linked with an additional therapeutic payload, such as radio-nuclide, an enzyme, an immunogenic epitope, or a cytotoxic agent, including bacterial toxins (diphtheria or plant toxins, such as ricin). The in vivo half-life of an antibody or a fragment thereof can be increased by pegylation through conjugation to polyethylene glycol.

Gene Therapy

In some embodiments, gene therapy can be used as as therapeutic to modulate a peptide sequence or RNA expressed from a gene associated with a developmental disorder. Gene therapy involves the use of DNA as a pharmaceutical agent to treat disease. DNA can be used to supplement or alter genes within an individual's cells as a therapy to treat disease. Gene therapy can be used to alter the signaling or function associated with the a developmental disorder associated biomarker, have an inhibitory or stimulatory effect on the developmental disorder associated biomarkers, or have a stimulatory or inhibitory effect on the expression or activity of the a developmental disorder associated biomarkers' ligands. In one embodiement, gene therapy involves using DNA that encodes a functional, therapeutic gene in order to replace a mutated gene. Other forms involve directly correcting a mutation, or using DNA that encodes a therapeutic protein drug (rather than a natural human gene) to provide treatment. DNA that encodes a therapeutic protein can be packaged within a vector, which can used to introduce the DNA inside cells within the body. Once inside, the DNA becomes expressed by the cell machinery, resulting in the production of the therapeutic, which in turn can treat the subject's disease.

Gene therapy agents and other agents for testing therapeutics can include plasmids, viral vectors, artificial chromosomes and the like containing therapeutic genes or polynucleotides encoding therapeutic products, including coding sequences for small interfering RNA (siRNA), ribozymes and antisense RNA, which in certain further embodiments can comprise an operably linked promoter such as a constitutive promoter or a regulaTable promoter, such as an inducible promoter (e.g., IPTG inducible), a tightly regulated promoter (e.g., a promoter that permits little or no detecTable transcription in the absence of its cognate inducer or derepressor) or a tissue-specific promoter. Methodologies for preparing, testing and using these and related agents are known in the art. See, e.g., Ausubel (Ed.), Current Protocols in Molecular Biology (2007 John Wiley & Sons, NY); Rosenzweig and Nabel (Eds), Current Protocols in Human Genetics (esp. Ch. 13 therein, "Delivery Systems for Gene Therapy", 2008 John Wiley & Sons, NY); Abell, Advances in Amino Acid Mimetics and Peptidomimetics, 1997 Elsevier, N.Y. In another embodiment, gene therapy agents may encompass zinc finger nuclease (ZFN) or transcription activator-like effector nuclease (TALEN) strategies, see for example: Urnov et al. (2010), Nature Reviews Genetics 11(9):636-46; Yusa et al. (2011), Nature 478 (7369):391-4; Bedell et al. (2012), Nature ePub September 23, PubMed ID 23000899.

As a non-limiting example, one such embodiment contemplates introduction of a gene therapy agent for treating ASD (e.g., an engineered therapeutic virus, a therapeutic agent-carrying nanoparticle, etc.) to one or more injection sites in a subject, without the need for imaging, surgery, or histology on biopsy specimens. Of course, periodic monitoring of the circulation for leaked therapeutic agent and/or subsequent analysis of a biopsy specimen, e.g., to assess the effects of the agent on the target tissue, can also be considered. A gene therapy includes a therapeutic polynucleotide administered before, after, or at the same time as any other therapy described herein. In some embodiments, therapeutic genes may include an antisense version of a biomarker disclosed herein, a sequence of a biomarker described herein, or an inhibitor of a biomarker disclosed herein.

Methods of Treatment

Some embodiments of the present disclosure relates to methods of using pharmaceutical compositions and kits comprising agents that inhibit a developmental disorder associated biomarker or a developmental disorder associated biomarkers to inhibit or decrease a developmental disorder progression. Another embodiment of the present disclosure provides methods, pharmaceutical compositions, and kits for the treatment of animal subjects. The term "animal subject" as used herein includes humans as well as other mammals. The term "treating" as used herein includes achieving a therapeutic benefit and/or a prophylactic benefit. By therapeutic benefit is meant eradication or amelioration of the underlying viral infection. Also, a therapeutic benefit is achieved with the eradication or amelioration of one or more of the physiological symptoms associated a developmental disorder such that an improvement is observed in the animal subject, notwithstanding the fact that the animal subject can still be afflicted with a developmental disorder.

For embodiments where a prophylactic benefit is desired, a pharmaceutical composition of the disclosure can be administered to a subject at risk of developing a developmental disorder, or to a subject reporting one or more of the physiological symptoms of a developmental disorder, even though a screening of the condition cannot have been made. Administration can prevent a developmental disorder from developing, or it can reduce, lessen, shorten and/or otherwise ameliorate the progression of a developmental disorder, or symptoms that develop. The pharmaceutical composition can modulate or target a developmental disorder's associated biomarker. Wherein, the term modulate includes inhibition of a developmental disorder's associated biomarkers or alternatively activation of a developmental disorder associated biomarkers.

Reducing the activity of a developmental disorder's associated biomarkers, is also referred to as "inhibiting" the developmental disorder's associated biomarkers. The term "inhibits" and its grammatical conjugations, such as "inhibitory," do not require complete inhibition, but refer to a reduction in a developmental disorder's associated biomarkers' activities. In some embodiments such reduction is by at least 5%, at least 10%, at least 20%, at least 30%, at least 40%, at least 50%, at least 75%, at least 90%, and can be by at least 95% of the activity of the enzyme or other biologically important molecular process in the absence of the inhibitory effect, e.g., in the absence of an inhibitor. Conversely, the phrase "does not inhibit" and its grammatical conjugations refer to situations where there is less than 20%, less than 10%, and can be less than 5%, of reduction in enzyme activity in the presence of the agent. Further the phrase "does not substantially inhibit" and its grammatical conjugations refer to situations where there is less than 30%, less than 20%, and in some embodiments less than 10% of reduction in enzyme or other biologically important molecular activity in the presence of the agent.

Increasing the activity a developmental disorder's associated biomarkers is also referred to as "activating" the developmental disorder's associated biomarkers. The term "activated" and its grammatical conjugations, such as "activating," do not require complete activation, but refer to an increase in a developmental disorder associated biomarkers' activities. In some embodiments such increase is by at least 5%, at least 10%, at least 20%, at least 30%, at least 40%, at least 50%, at least 60%, at least 70%, at least 75%, at least 80%, at least 85%, at least 90%, and can be by at least 95% of the activity of the enzyme or other biologically important molecular process in the absence of the activation effect, e.g., in the absence of an activator. Conversely, the phrase "does not activate" and its grammatical conjugations refer to situations where there can be less than 20%, less than 10%, and less than 5%, of an increase in enzyme or other biologically important molecular activity in the presence of the agent. Further the phrase "does not substantially activate" and its grammatical conjugations refer to situations where there is less than 30%, less than 20%, and in some embodiments less than 10% of an increase in enzyme or other biologically important molecular activity in the presence of the agent.

The ability to reduce enzyme or other biologically important molecular activity is a measure of the potency or the activity of an agent, or combination of agents, towards or against the enzyme or other biologically important molecular process. Potency can be measured by cell free, whole cell and/or in vivo assays in terms of IC50, Ki and/or ED50 values. An IC50 value represents the concentration of an agent required to inhibit enzyme activity by half (50%) under a given set of conditions. A Ki value represents the equilibrium affinity constant for the binding of an inhibiting agent to the enzyme or other relevant biomolecule. An ED50 value represents the dose of an agent required to affect a half-maximal response in a biological assay. Further details of these measures will be appreciated by those of ordinary skill in the art, and can be found in standard texts on biochemistry, enzymology, and the like.

The present disclosure also includes kits that can be used to treat developmental disorders. These kits comprise an agent or combination of agents that inhibits a developmental disorder associated biomarker or a developmental disorder's associated biomarkers and in some embodiments instructions teaching the use of the kit according to the various methods and approaches described herein. Such kits can also include information, such as scientific literature references, package insert materials, clinical trial results, and/or summaries of these and the like, which indicate or establish the activities and/or advantages of the agent. Such information can be based on the results of various studies, for example, studies using experimental animals involving in vivo models and studies based on human clinical trials. Kits described herein can be provided, marketed and/or promoted to health providers, including physicians, nurses, pharmacists, formulary officials, and the like.

In some aspects a host cell can be used for testing or administering therapeutics. In some embodiments, a host cell can comprise a nucleic acid comprising expression control sequences operably-linked to a coding region. The host cell can be natural or non-natural. The non-natural host used in aspects of the method can be any cell capable of expressing a nucleic acid of the disclosure including, bacterial cells, fungal cells, insect cells, mammalian cells and plant cells. In some aspects the natural host is a mammalian tissue cell and the non-natural host is a different mammalian tissue cell. Other aspects of the method include a natural host that is a first cell normally residing in a first mammalian species and the non-natural host is second cell normally residing in a second mammalian species. In another alternative aspect, the method uses a first cell and the second cell that are from the same tissue type. In those aspects of the method where the coding region encodes a mammalian protein, the mammalian protein may be a hormone. In other aspects the coding region may encode a neuropeptide, an antibody, an antimetabolites or a protein or nucleotide therapeutic.

Expression control sequencescan be those nucleotide sequences, both 5' and 3' to a coding region, that are required for the transcription and translation of the coding region in a host organism. Regulatory sequences include a promoter, ribosome binding site, optional inducible elements and sequence elements required for efficient 3' processing, including polyadenylation. When the structural gene has been isolated from genomic DNA, the regulatory sequences also include those intronic sequences required for splicing of the introns as part of mRNA formation in the target host.

Formulations, Routes of Administration, and Effective Doses

Yet another aspect of the present disclosure relates to formulations, routes of administration and effective doses for pharmaceutical compositions comprising an agent or combination of agents of the instant disclosure. Such pharmaceutical compositions can be used to treat a developmental disorder progression and a developmental disorder associated symptoms as described above.

Compounds of the disclosure can be administered as pharmaceutical formulations including those suitable for oral (including buccal and sub-lingual), rectal, nasal, topical, transdermal patch, pulmonary, vaginal, suppository, or parenteral (including intramuscular, intraarterial, intrathecal, intradermal, intraperitoneal, subcutaneous and intravenous) administration or in a form suitable for administration by aerosolization, inhalation or insufflation. General information on drug delivery systems can be found in Ansel et al., Pharmaceutical Dosage Forms and Drug Delivery Systems (Lippencott Williams & Wilkins, Baltimore Md. (1999).

In various embodiments, the pharmaceutical composition includes carriers and excipients (including but not limited to buffers, carbohydrates, mannitol, proteins, polypeptides or amino acids such as glycine, antioxidants, bacteriostats, chelating agents, suspending agents, thickening agents and/or preservatives), water, oils including those of petroleum, animal, vegeTable or synthetic origin, such as peanut oil, soybean oil, mineral oil, sesame oil and the like, saline solutions, aqueous dextrose and glycerol solutions, flavoring agents, coloring agents, detackifiers and other accepTable additives, adjuvants, or binders, other pharmaceutically accepTable auxiliary substances as required to approximate physiological conditions, such as pH buffering agents, tonicity adjusting agents, emulsifying agents, wetting agents and the like. Examples of excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. In some embodiments, the pharmaceutical preparation is substantially free of preservatives. In other embodiments, the pharmaceutical preparation can contain at least one preservative. General methodology on pharmaceutical dosage forms is found in Ansel et al., Pharmaceutical Dosage Forms and Drug Delivery Systems (Lippencott, Williams, & Wilkins, Baltimore Md. (1999)). It will be recognized that, while any suitable carrier known to those of ordinary skill in the art can be employed to administer the compositions of this disclosure, the type of carrier will vary depending on the mode of administration.

Compounds can also be encapsulated within liposomes using well-known technology. Biodegradable microspheres can also be employed as carriers for the pharmaceutical compositions of this disclosure. Suitable biodegradable microspheres are disclosed, for example, in U.S. Pat. Nos. 4,897,268, 5,075,109, 5,928,647, 5,811,128, 5,820,883, 5,853,763, 5,814,344 and 5,942,252.

The compound can be administered in liposomes or microspheres (or microparticles). Methods for preparing liposomes and microspheres for administration to a subject are well known to those of skill in the art. U.S. Pat. No. 4,789,734, the contents of which are hereby incorporated by reference, describes methods for encapsulating biological materials in liposomes. Essentially, the material is dissolved in an aqueous solution, the appropriate phospholipids and lipids added, along with surfactants if required, and the material dialyzed or sonicated, as necessary. A review of known methods is provided by G. Gregoriadis, Chapter 14, "Liposomes," Drug Carriers in Biology and Medicine, pp. 2.sup.87-341 (Academic Press, 1979).

Microspheres formed of polymers or proteins are well known to those skilled in the art, and can be tailored for passage through the gastrointestinal tract directly into the blood stream. Alternatively, the compound can be incorporated and the microspheres, or composite of microspheres, implanted for slow release over a period of time ranging from days to months. See, for example, U.S. Pat. Nos. 4,906,474, 4,925,673 and 3,625,214, and Jein, TIPS 19:155-157 (1998), the contents of which are hereby incorporated by reference.

The concentration of drug can be adjusted, the pH of the solution buffered and the isotonicity adjusted to be compatible with intravenous injection, as is well known in the art.

The compounds of the disclosure can be formulated as a sterile solution or suspension, in suitable vehicles, well known in the art. The pharmaceutical compositions can be sterilized by conventional, well-known sterilization techniques, or can be sterile filtered. The resulting aqueous solutions can be packaged for use as is, or lyophilized, the lyophilized preparation being combined with a sterile solution prior to administration. Suitable formulations and additional carriers are described in Remington "The Science and Practice of Pharmacy" (20th Ed., Lippincott Williams & Wilkins, Baltimore Md.), the teachings of which are incorporated by reference in their entirety herein.

The agents or their pharmaceutically accepTable salts can be provided alone or in combination with one or more other agents or with one or more other forms. For example, a formulation can comprise one or more agents in particular proportions, depending on the relative potencies of each agent and the intended indication. For example, in compositions for targeting two different host targets, and where potencies are similar, about a 1:1 ratio of agents can be used. The two forms can be formulated together, in the same dosage unit e.g., in one cream, suppository, tablet, capsule, aerosol spray, or packet of powder to be dissolved in a beverage; or each form can be formulated in a separate unit, e.g., two creams, two suppositories, two tablets, two capsules, a tablet and a liquid for dissolving the tablet, two aerosol sprays, or a packet of powder and a liquid for dissolving the powder, etc.

The term "pharmaceutically accepTable salt" means those salts which retain the biological effectiveness and properties of the agents used in the present disclosure, and which are not biologically or otherwise undesirable. For example, a pharmaceutically accepTable salt does not interfere with the beneficial effect of an agent of the disclosure in inhibiting a developmental disorder associated biomarkers' components Typical salts are those of the inorganic ions, such as, for example, sodium, potassium, calcium, magnesium ions, and the like. Such salts include salts with inorganic or organic acids, such as hydrochloric acid, hydrobromic acid, phosphoric acid, nitric acid, sulfuric acid, methanesulfonic acid, p toluenesulfonic acid, acetic acid, fumaric acid, succinic acid, lactic acid, mandelic acid, malic acid, citric acid, tartaric acid or maleic acid. In addition, if the agent(s) contain a carboxy group or other acidic group, it can be converted into a pharmaceutically accepTable addition salt with inorganic or organic bases. Examples of suitable bases include sodium hydroxide, potassium hydroxide, ammonia, cyclohexylamine, dicyclohexyl-amine, ethanolamine, diethanolamine, triethanolamine, and the like.

A pharmaceutically accepTable ester or amide refers to those which retain biological effectiveness and properties of the agents used in the present disclosure, and which are not biologically or otherwise undesirable. For example, the ester or amide does not interfere with the beneficial effect of an agent of the disclosure in inhibiting a developmental disorder associated biomarkers' components. Typical esters include ethyl, methyl, isobutyl, ethylene glycol, and the like. Typical amides include unsubstituted amides, alkyl amides, dialkyl amides, and the like.

In some embodiments, an agent can be administered in combination with one or more other compounds, forms, and/or agents, e.g., as described above. Pharmaceutical compositions comprising combinations of a developmental disorder associated biomarkers' inhibitors with one or more other active agents can be formulated to comprise certain molar ratios. For example, molar ratios of about 99:1 to about 1:99 of a developmental disorder's associated biomarkers' inhibitors to the other active agent can be used. In some subset of the embodiments, the range of molar ratios of developmental disorder's associated biomarkers' inhibitors: other active agents are selected from about 80:20 to about 20:80; about 75:25 to about 25:75, about 70:30 to about 30:70, about 66:33 to about 33:66, about 60:40 to about 40:60; about 50:50; and about 90:10 to about 10:90. The molar ratio of a developmental disorder's associated biomarkers' inhibitors: other active agents can be about 1:9, and in some embodiments can be about 1:1. The two agents, forms and/or compounds can be formulated together, in the same dosage unit e.g., in one cream, suppository, tablet, capsule, or packet of powder to be dissolved in a beverage; or each agent, form, and/or compound can be formulated in separate units, e.g., two creams, suppositories, tablets, two capsules, a tablet and a liquid for dissolving the tablet, an aerosol spray a packet of powder and a liquid for dissolving the powder, etc.

If necessary or desirable, the agents and/or combinations of agents can be administered with still other agents. The choice of agents that can be co-administered with the agents and/or combinations of agents of the instant disclosure can depend, at least in part, on the condition being treated. Agents of particular use in the formulations of the present disclosure include, for example, any agent having a therapeutic effect for a viral infection, including, e.g., drugs used to treat inflammatory conditions. For example, in treatments for influenza, in some embodiments formulations of the instant disclosure can additionally contain one or more conventional anti-inflammatory drugs, such as an NSAID, e.g., ibuprofen, naproxen, acetaminophen, ketoprofen, or aspirin. In some alternative embodiments for the treatment of influenza formulations of the instant disclosure can additionally contain one or more conventional influenza antiviral agents, such as amantadine, rimantadine, zanamivir, and oseltamivir. In treatments for retroviral infections, such as HIV, formulations of the instant disclosure can additionally contain one or more conventional antiviral drug, such as protease inhibitors (lopinavir/ritonavir {Kaletra}, indinavir {Crixivan}, ritonavir {Norvir}, nelfinavir {Viracept}, saquinavir hard gel capsules {Invirase}, atazanavir {Reyataz}, amprenavir {Agenerase}, fosamprenavir {Telzir}, tipranavir{Aptivus}), reverse transcriptase inhibitors, including non-Nucleoside and Nucleoside/nucleotide inhibitors (AZT {zidovudine, Retrovir}, ddI {didanosine, Videx}, 3TC {lamivudine, Epivir}, d4T {stavudine, Zerit}, abacavir {Ziagen}, FTC {emtricitabine, Emtriva}, tenofovir {Viread}, efavirenz {Sustiva} and nevirapine {Viramune}), fusion inhibitors T20 {enfuvirtide, Fuzeon}, integrase inhibitors (MK-0518 and GS-9137), and maturation inhibitors (PA-457 {Bevirimat}). As another example, formulations can additionally contain one or more supplements, such as vitamin C, E or other anti-oxidants.

The agent(s) (or pharmaceutically accepTable salts, esters or amides thereof) can be administered per se or in the form of a pharmaceutical composition wherein the active agent(s) is in an admixture or mixture with one or more pharmaceutically accepTable carriers. A pharmaceutical composition, as used herein, can be any composition prepared for administration to a subject. Pharmaceutical compositions for use in accordance with the present disclosure can be formulated in conventional manner using one or more physiologically accepTable carriers, comprising excipients, diluents, and/or auxiliaries, e.g., which facilitate processing of the active agents into preparations that can be administered. Proper formulation can depend at least in part upon the route of administration chosen. The agent(s) useful in the present disclosure, or pharmaceutically accepTable salts, esters, or amides thereof, can be delivered to a subject using a number of routes or modes of administration, including oral, buccal, topical, rectal, transdermal, transmucosal, subcutaneous, intravenous, and intramuscular applications, as well as by inhalation.

For oral administration, the agents can be formulated readily by combining the active agent(s) with pharmaceutically accepTable carriers well known in the art. Such carriers enable the agents of the disclosure to be formulated as tablets, including chewable tablets, pills, dragees, capsules, lozenges, hard candy, liquids, gels, syrups, slurries, powders, suspensions, elixirs, wafers, and the like, for oral ingestion by a subject to be treated. Such formulations can comprise pharmaceutically accepTable carriers including solid diluents or fillers, sterile aqueous media and various non-toxic organic solvents. A solid carrier can be one or more substances which can also act as diluents, flavoring agents, solubilizers, lubricants, suspending agents, binders, preservatives, tablet disintegrating agents, or an encapsulating material. In powders, the carrier generally is a finely divided solid which is a mixture with the finely divided active component. In tablets, the active component generally is mixed with the carrier having the necessary binding capacity in suitable proportions and compacted in the shape and size desired. The powders and tablets preferably contain from about one (1) to about seventy (70) percent of the active compound. Suitable carriers include but are not limited to magnesium carbonate, magnesium stearate, talc, sugar, lactose, pectin, dextrin, starch, gelatin, tragacanth, methylcellulose, sodium carboxymethylcellulose, a low melting wax, cocoa butter, and the like. Generally, the agents of the disclosure will be included at concentration levels ranging from about 0.5%, about 5%, about 10%, about 20%, or about 30% to about 50%, about 60%, about 70%, about 80% or about 90% by weight of the total composition of oral dosage forms, in an amount sufficient to provide a desired unit of dosage.

Aqueous suspensions for oral use can contain agent(s) of this disclosure with pharmaceutically accepTable excipients, such as a suspending agent (e.g., methyl cellulose), a wetting agent (e.g., lecithin, lysolecithin and/or a long-chain fatty alcohol), as well as coloring agents, preservatives, flavoring agents, and the like.

In some embodiments, oils or non-aqueous solvents can be required to bring the agents into solution, due to, for example, the presence of large lipophilic moieties. Alternatively, emulsions, suspensions, or other preparations, for example, liposomal preparations, can be used. With respect to liposomal preparations, any known methods for preparing liposomes for treatment of a condition can be used. See, for example, Bangham et al., J. Mol. Biol. 23: 238-252 (1965) and Szoka et al., Proc. Natl. Acad. Sci. USA 75: 4194-4198 (1978), incorporated herein by reference. Ligands can also be attached to the liposomes to direct these compositions to particular sites of action. Agents of this disclosure can also be integrated into foodstuffs, e.g., cream cheese, butter, salad dressing, or ice cream to facilitate solubilization, administration, and/or compliance in certain subject populations.

Pharmaceutical preparations for oral use can be obtained as a solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; flavoring elements, cellulose preparations such as, for example, maize starch, wheat starch, rice starch, potato starch, gelatin, gum tragacanth, methyl cellulose, hydroxypropylmethyl cellulose, sodium carboxymethylcellulose, and/or polyvinyl pyrrolidone (PVP). If desired, disintegrating agents can be added, such as the cross linked polyvinyl pyrrolidone, agar, or alginic acid or a salt thereof such as sodium alginate. The agents can also be formulated as a sustained release preparation.

Dragee cores can be provided with suitable coatings. For this purpose, concentrated sugar solutions can be used, which can optionally contain gum arabic, talc, polyvinyl pyrrolidone, carbopol gel, polyethylene glycol, and/or titanium dioxide, lacquer solutions, and suitable organic solvents or solvent mixtures. Dyestuffs or pigments can be added to the tablets or dragee coatings for identification or to characterize different combinations of active agents.

Pharmaceutical preparations that can be used orally include push fit capsules made of gelatin, as well as soft, sealed capsules made of gelatin and a plasticizer, such as glycerol or sorbitol. The push fit capsules can contain the active ingredients in admixture with filler such as lactose, binders such as starches, and/or lubricants such as talc or magnesium stearate and, optionally, stabilizers. In soft capsules, the active agents can be dissolved or suspended in suitable liquids, such as fatty oils, liquid paraffin, or liquid polyethylene glycols. In addition, stabilizers can be added. All formulations for oral administration should be in dosages suitable for administration.

Other forms suitable for oral administration include liquid form preparations including emulsions, syrups, elixirs, aqueous solutions, aqueous suspensions, or solid form preparations which are intended to be converted shortly before use to liquid form preparations. Emulsions can be prepared in solutions, for example, in aqueous propylene glycol solutions or can contain emulsifying agents, for example, such as lecithin, sorbitan monooleate, or acacia. Aqueous solutions can be prepared by dissolving the active component in water and adding suitable colorants, flavors, stabilizers, and thickening agents. Aqueous suspensions can be prepared by dispersing the finely divided active component in water with viscous material, such as natural or synthetic gums, resins, methylcellulose, sodium carboxymethylcellulose, and other well known suspending agents. Suitable fillers or carriers with which the compositions can be administered include agar, alcohol, fats, lactose, starch, cellulose derivatives, polysaccharides, polyvinylpyrrolidone, silica, sterile saline and the like, or mixtures thereof used in suitable amounts. Solid form preparations include solutions, suspensions, and emulsions, and can contain, in addition to the active component, colorants, flavors, stabilizers, buffers, artificial and natural sweeteners, dispersants, thickeners, solubilizing agents, and the like.

A syrup or suspension can be made by adding the active compound to a concentrated, aqueous solution of a sugar, e.g., sucrose, to which can also be added any accessory ingredients. Such accessory ingredients can include flavoring, an agent to retard crystallization of the sugar or an agent to increase the solubility of any other ingredient, e.g., as a polyhydric alcohol, for example, glycerol or sorbitol.

When formulating compounds of the disclosure for oral administration, it can be desirable to utilize gastroretentive formulations to enhance absorption from the gastrointestinal (GI) tract. A formulation which is retained in the stomach for several hours can release compounds of the disclosure slowly and provide a sustained release that can be preferred in some embodiments of the disclosure. Disclosure of such gastro-retentive formulations are found in Klausner, E. A.; Lavy, E.; Barta, M.; Cserepes, E.; Friedman, M.; Hoffman, A. 2003 "Novel gastroretentive dosage forms: evaluation of gastroretentivity and its effect on levodopa in humans." Pharm. Res. 20, 1466-73, Hoffman, A.; Stepensky, D.; Lavy, E.; Eyal, S. Klausner, E.; Friedman, M. 2004 "Pharmacokinetic and pharmacodynamic aspects of gastroretentive dosage forms" Int. J. Pharm. 11, 141-53, Streubel, A.; Siepmann, J.; Bodmeier, R.; 2006 "Gastroretentive drug delivery systems" Expert Opin. Drug Deliver. 3, 217-3, and Chavanpatil, M. D.; Jain, P.; Chaudhari, S.; Shear, R.; Vavia, P. R.

"Novel sustained release, swellable and bioadhesive gastroretentive drug delivery system for olfoxacin" Int. J. Pharm. 2006. Expandable, floating and bioadhesive techniques can be utilized to maximize absorption of the compounds of the disclosure.

The compounds of the disclosure can be formulated for parenteral administration (e.g., by injection, for example, bolus injection or continuous infusion) and can be presented in unit dose form in ampoules, pre-filled syringes, small volume infusion or in multi-dose containers with an added preservative. The compositions can take such forms as suspensions, solutions, or emulsions in oily or aqueous vehicles, for example, solutions in aqueous polyethylene glycol.

For injecTable formulations, the vehicle can be chosen from those known in art to be suitable, including aqueous solutions or oil suspensions, or emulsions, with sesame oil, corn oil, cottonseed oil, or peanut oil, as well as elixirs, mannitol, dextrose, or a sterile aqueous solution, and similar pharmaceutical vehicles. The formulation can also comprise polymer compositions which are biocompatible, biodegradable, such as poly(lactic-co-glycolic)acid. These materials can be made into micro or nanospheres, loaded with drug and further coated or derivatized to provide superior sustained release performance. Vehicles suitable for periocular or intraocular injection include, for example, suspensions of therapeutic agent in injection grade water, liposomes and vehicles suitable for lipophilic substances. Other vehicles for periocular or intraocular injection are well known in the art.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition can also include a solubilizing agent and a local anesthetic such as lidocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients can be mixed prior to administration.

When administration is by injection, the active compound can be formulated in aqueous solutions, specifically in physiologically compatible buffers such as Hanks solution, Ringer's solution, or physiological saline buffer. The solution can contain formulatory agents such as suspending, stabilizing and/or dispersing agents. Alternatively, the active compound can be in powder form for constitution with a suitable vehicle, e.g., sterile pyrogen-free water, before use. In some embodiments, the pharmaceutical composition does not comprise an adjuvant or any other substance added to enhance the immune response stimulated by the peptide. In some embodiments, the pharmaceutical composition comprises a substance that inhibits an immune response to the peptide. Methods of formulation are known in the art, for example, as disclosed in Remington's Pharmaceutical Sciences, latest edition, Mack Publishing Co., Easton P.

In addition to the formulations described previously, the agents can also be formulated as a depot preparation. Such long acting formulations can be administered by implantation or transcutaneous delivery (for example, subcutaneously or intramuscularly), intramuscular injection or use of a transdermal patch. Thus, for example, the agents can be formulated with suitable polymeric or hydrophobic materials (for example, as an emulsion in an accepTable oil) or ion exchange resins, or as sparingly soluble derivatives, for example, as a sparingly soluble salt.

In some embodiments, pharmaceutical compositions comprising one or more agents of the present disclosure exert local and regional effects when administered topically or injected at or near particular sites of infection. Direct topical application, e.g., of a viscous liquid, solution, suspension, dimethylsulfoxide (DMSO)-based solutions, liposomal formulations, gel, jelly, cream, lotion, ointment, suppository, foam, or aerosol spray, can be used for local administration, to produce for example, local and/or regional effects. Pharmaceutically appropriate vehicles for such formulation include, for example, lower aliphatic alcohols, polyglycols (e.g., glycerol or polyethylene glycol), esters of fatty acids, oils, fats, silicones, and the like. Such preparations can also include preservatives (e.g., p-hydroxybenzoic acid esters) and/or antioxidants (e.g., ascorbic acid and tocopherol). See also Dermatological Formulations: Percutaneous absorption, Barry (Ed.), Marcel Dekker Incl, 1983.

Pharmaceutical compositions of the present disclosure can contain a cosmetically or dermatologically accepTable carrier. Such carriers are compatible with skin, nails, mucous membranes, tissues and/or hair, and can include any conventionally used cosmetic or dermatological carrier meeting these requirements. Such carriers can be readily selected by one of ordinary skill in the art. In formulating skin ointments, an agent or combination of agents of the instant disclosure can be formulated in an oleaginous hydrocarbon base, an anhydrous absorption base, a water-in-oil absorption base, an oil-in-water water-removable base and/or a water-soluble base. Examples of such carriers and excipients include, but are not limited to, humectants (e.g., urea), glycols (e.g., propylene glycol), alcohols (e.g., ethanol), fatty acids (e.g., oleic acid), surfactants (e.g., isopropyl myristate and sodium lauryl sulfate), pyrrolidones, glycerol monolaurate, sulfoxides, terpenes (e.g., menthol), amines, amides, alkanes, alkanols, water, calcium carbonate, calcium phosphate, various sugars, starches, cellulose derivatives, gelatin, and polymers such as polyethylene glycols.

Ointments and creams can, for example, be formulated with an aqueous or oily base with the addition of suitable thickening and/or gelling agents. Lotions can be formulated with an aqueous or oily base and will in general also containing one or more emulsifying agents, stabilizing agents, dispersing agents, suspending agents, thickening agents, or coloring agents. The construction and use of transdermal patches for the delivery of pharmaceutical agents is well known in the art. See, e.g., U.S. Pat. Nos. 5,023,252, 4,992,445 and 5,001,139. Such patches can be constructed for continuous, pulsatile, or on demand delivery of pharmaceutical agents.

Lubricants which can be used to form pharmaceutical compositions and dosage forms of the disclosure include, but are not limited to, calcium stearate, magnesium stearate, mineral oil, light mineral oil, glycerin, sorbitol, mannitol, polyethylene glycol, other glycols, stearic acid, sodium lauryl sulfate, talc, hydrogenated vegeTable oil (e.g., peanut oil, cottonseed oil, sunflower oil, sesame oil, olive oil, corn oil, and soybean oil), zinc stearate, ethyl oleate, ethyl laureate, agar, or mixtures thereof. Additional lubricants include, for example, a syloid silica gel, a coagulated aerosol of synthetic silica, or mixtures thereof A lubricant can optionally be added, in an amount of less than about 1 weight percent of the pharmaceutical composition.

The compositions according to the present disclosure can be in any form suitable for topical application, including aqueous, aqueous-alcoholic or oily solutions, lotion or serum dispersions, aqueous, anhydrous or oily gels, emulsions obtained by dispersion of a fatty phase in an aqueous phase (O/W or oil in water) or, conversely, (W/O or water in oil), microemulsions or alternatively microcapsules, microparticles or lipid vesicle dispersions of ionic and/or nonionic type. These compositions can be prepared according to conventional methods. Other than the agents of the disclosure, the amounts of the various constituents of the compositions according to the disclosure are those conventionally used in the art. These compositions in particular constitute protection, treatment or care creams, milks, lotions, gels or foams for the face, for the hands, for the body and/or for the mucous membranes, or for cleansing the skin. The compositions can also consist of solid preparations constituting soaps or cleansing bars.

Compositions of the present disclosure can also contain adjuvants common to the cosmetic and dermatological fields, such as hydrophilic or lipophilic gelling agents, hydrophilic or lipophilic active agents, preserving agents, antioxidants, solvents, fragrances, fillers, sunscreens, odor-absorbers and dyestuffs. The amounts of these various adjuvants are those conventionally used in the fields considered and, for example, are from about 0.01% to about 20% of the total weight of the composition. Depending on their nature, these adjuvants can be introduced into the fatty phase, into the aqueous phase and/or into the lipid vesicles.

In some embodiments, ocular viral infections can be effectively treated with ophthalmic solutions, suspensions, ointments or inserts comprising an agent or combination of agents of the present disclosure. Eye drops can be prepared by dissolving the active ingredient in a sterile aqueous solution such as physiological saline, buffering solution, etc., or by combining powder compositions to be dissolved before use. Other vehicles can be chosen, as is known in the art, including but not limited to: balance salt solution, saline solution, water soluble polyethers such as polyethyene glycol, polyvinyls, such as polyvinyl alcohol and povidone, cellulose derivatives such as methylcellulose and hydroxypropyl methylcellulose, petroleum derivatives such as mineral oil and white petrolatum, animal fats such as lanolin, polymers of acrylic acid such as carboxypolymethylene gel, vegeTable fats such as peanut oil and polysaccharides such as dextrans, and glycosaminoglycans such as sodium hyaluronate. If desired, additives ordinarily used in the eye drops can be added. Such additives include isotonizing agents (e.g., sodium chloride, etc.), buffer agent (e.g., boric acid, sodium monohydrogen phosphate, sodium dihydrogen phosphate, etc.), preservatives (e.g., benzalkonium chloride, benzethonium chloride, chlorobutanol, etc.), thickeners (e.g., saccharide such as lactose, mannitol, maltose, etc.; e.g., hyaluronic acid or its salt such as sodium hyaluronate, potassium hyaluronate, etc.; e.g., mucopolysaccharide such as chondroitin sulfate, etc.; e.g., sodium polyacrylate, carboxyvinyl polymer, crosslinked polyacrylate, polyvinyl alcohol, polyvinyl pyrrolidone, methyl cellulose, hydroxy propyl methylcellulose, hydroxyethyl cellulose, carboxymethyl cellulose, hydroxy propyl cellulose or other agents known to those skilled in the art).

The solubility of the components of the present compositions can be enhanced by a surfactant or other appropriate co-solvent in the composition. Such cosolvents include polysorbate 20, 60, and 80, Pluronic F68, F-84 and P-103, cyclodextrin, or other agents known to those skilled in the art. Such co-solvents can be employed at a level of from about 0.01% to 2% by weight.

The compositions of the disclosure can be packaged in multidose form. Preservatives can be preferred to prevent microbial contamination during use. Suitable preservatives include: benzalkonium chloride, thimerosal, chlorobutanol, methyl paraben, propyl paraben, phenylethyl alcohol, edetate disodium, sorbic acid, Onamer M, or other agents known to those skilled in the art. In the prior art ophthalmic products, such preservatives can be employed at a level of from 0.004% to 0.02%. In the compositions of the present application the preservative, preferably benzalkonium chloride, can be employed at a level of from 0.001% to less than 0.01%, e.g. from 0.001% to 0.008%, preferably about 0.005% by weight. It has been found that a concentration of benzalkonium chloride of 0.005% can be sufficient to preserve the compositions of the present disclosure from microbial attack.

In some embodiments, developmental disorder associated symptoms of the ear can be effectively treated with otic solutions, suspensions, ointments or inserts comprising an agent or combination of agents of the present disclosure.

In some embodiments, the agents of the present disclosure are delivered in soluble rather than suspension form, which allows for more rapid and quantitative absorption to the sites of action. In general, formulations such as jellies, creams, lotions, suppositories and ointments can provide an area with more extended exposure to the agents of the present disclosure, while formulations in solution, e.g., sprays, provide more immediate, short-term exposure.

In some embodiments relating to topical/local application, the pharmaceutical compositions can include one or more penetration enhancers. For example, the formulations can comprise suitable solid or gel phase carriers or excipients that increase penetration or help delivery of agents or combinations of agents of the disclosure across a permeability barrier, e.g., the skin. Many of these penetration-enhancing compounds are known in the art of topical formulation, and include, e.g., water, alcohols (e.g., terpenes like methanol, ethanol, 2-propanol), sulfoxides (e.g., dimethyl sulfoxide, decylmethyl sulfoxide, tetradecylmethyl sulfoxide), pyrrolidones (e.g., 2-pyrrolidone, N-methyl-2-pyrrolidone, N-(2-hydroxyethyl)pyrrolidone), laurocapram, acetone, dimethylacetamide, dimethylformamide, tetrahydrofurfuryl alcohol, L-α-amino acids, anionic, cationic, amphoteric or nonionic surfactants (e.g., isopropyl myristate and sodium lauryl sulfate), fatty acids, fatty alcohols (e.g., oleic acid), amines, amides, clofibric acid amides, hexamethylene lauramide, proteolytic enzymes, α-bisabolol, d-limonene, urea and N,N-diethyl-m-toluamide, and the like. Additional examples include humectants (e.g., urea), glycols (e.g., propylene glycol and polyethylene glycol), glycerol monolaurate, alkanes, alkanols, ORGELASE, calcium carbonate, calcium phosphate, various sugars, starches, cellulose derivatives, gelatin, and/or other polymers. In some embodiments, the pharmaceutical compositions will include one or more such penetration enhancers.

In some embodiments, the pharmaceutical compositions for local/topical application can include one or more antimicrobial preservatives such as quaternary ammonium compounds, organic mercurials, p-hydroxy benzoates, aromatic alcohols, chlorobutanol, and the like.

Gastrointestinal developmental disorder symptoms can be effectively treated with orally- or rectally delivered solutions, suspensions, ointments, enemas and/or suppositories comprising an agent or combination of agents of the present disclosure.

Respiratory developmental disorder symptoms can be effectively treated with aerosol solutions, suspensions or dry powders comprising an agent or combination of agents of the present disclosure. Administration by inhalation is particularly useful in treating viral infections of the lung, such as influenza. The aerosol can be administered through the respiratory system or nasal passages. For example, one skilled in the art will recognize that a composition of the present disclosure can be suspended or dissolved in an appropriate carrier, e.g., a pharmaceutically accepTable propellant, and administered directly into the lungs using a nasal spray or inhalant. For example, an aerosol formulation comprising a developmental disorder associated biomarkers' inhibitors can be dissolved, suspended or emulsified in a propellant or a mixture of solvent and propellant, e.g., for administration as a nasal spray or inhalant. Aerosol formulations can contain any accepTable propellant under pressure, such as a cosmetically or dermatologically or pharmaceutically accepTable propellant, as conventionally used in the art.

An aerosol formulation for nasal administration is generally an aqueous solution designed to be administered to the nasal passages in drops or sprays. Nasal solutions can be similar to nasal secretions in that they are generally isotonic and slightly buffered to maintain a pH of about 5.5 to about 6.5, although pH values outside of this range can additionally be used. Antimicrobial agents or preservatives can also be included in the formulation.

An aerosol formulation for inhalations and inhalants can be designed so that the agent or combination of agents of the present disclosure is carried into the respiratory tree of the subject when administered by the nasal or oral respiratory route. Inhalation solutions can be administered, for example, by a nebulizer. Inhalations or insufflations, comprising finely powdered or liquid drugs, can be delivered to the respiratory system as a pharmaceutical aerosol of a solution or suspension of the agent or combination of agents in a propellant, e.g., to aid in disbursement. Propellants can be liquefied gases, including halocarbons, for example, fluorocarbons such as fluorinated chlorinated hydrocarbons, hydrochlorofluorocarbons, and hydrochlorocarbons, as well as hydrocarbons and hydrocarbon ethers.

Halocarbon propellants useful in the present disclosure include fluorocarbon propellants in which all hydrogens are replaced with fluorine, chlorofluorocarbon propellants in which all hydrogens are replaced with chlorine and at least one fluorine, hydrogen-containing fluorocarbon propellants, and hydrogen-containing chlorofluorocarbon propellants. Halocarbon propellants are described in Johnson, U.S. Pat. No. 5,376,359; Byron et al., U.S. Pat. No. 5,190,029; and Purewal et al., U.S. Pat. No. 5,776,434. Hydrocarbon propellants useful in the disclosure include, for example, propane, isobutane, n-butane, pentane, isopentane and neopentane. A blend of hydrocarbons can also be used as a propellant. Ether propellants include, for example, dimethyl ether as well as the ethers. An aerosol formulation of the disclosure can also comprise more than one propellant. For example, the aerosol formulation can comprise more than one propellant from the same class, such as two or more fluorocarbons; or more than one, more than two, more than three propellants from different classes, such as a fluorohydrocarbon and a hydrocarbon. Pharmaceutical compositions of the present disclosure can also be dispensed with a compressed gas, e.g., an inert gas such as carbon dioxide, nitrous oxide or nitrogen.

Aerosol formulations can also include other components, for example, ethanol, isopropanol, propylene glycol, as well as surfactants or other components such as oils and detergents. These components can serve to stabilize the formulation and/or lubricate valve components.

The aerosol formulation can be packaged under pressure and can be formulated as an aerosol using solutions, suspensions, emulsions, powders and semisolid preparations. For example, a solution aerosol formulation can comprise a solution of an agent of the disclosure such as a developmental disorder associated biomarkers' inhibitors in (substantially) pure propellant or as a mixture of propellant and solvent. The solvent can be used to dissolve the agent and/or retard the evaporation of the propellant. Solvents useful in the disclosure include, for example, water, ethanol and glycols. Any combination of suitable solvents can be use, optionally combined with preservatives, antioxidants, and/or other aerosol components.

An aerosol formulation can also be a dispersion or suspension. A suspension aerosol formulation can comprise a suspension of an agent or combination of agents of the instant disclosure, e.g., a developmental disorder associated biomarkers' inhibitors, and a dispersing agent. Dispersing agents useful in the disclosure include, for example, sorbitan trioleate, oleyl alcohol, oleic acid, lecithin and corn oil. A suspension aerosol formulation can also include lubricants, preservatives, antioxidant, and/or other aerosol components.

An aerosol formulation can similarly be formulated as an emulsion. An emulsion aerosol formulation can include, for example, an alcohol such as ethanol, a surfactant, water and a propellant, as well as an agent or combination of agents of the disclosure, e.g., a developmental disorder associated biomarkers' inhibitors. The surfactant used can be nonionic, anionic or cationic. One example of an emulsion aerosol formulation comprises, for example, ethanol, surfactant, water and propellant. Another example of an emulsion aerosol formulation comprises, for example, vegeTable oil, glyceryl monostearate and propane.

The compounds of the disclosure can be formulated for administration as suppositories. A low melting wax, such as a mixture of triglycerides, fatty acid glycerides, Witepsol S55 (trademark of Dynamite Nobel Chemical, Germany), or cocoa butter is first melted and the active component is dispersed homogeneously, for example, by stirring. The molten homogeneous mixture is then poured into convenient sized molds, allowed to cool, and to solidify.

The compounds of the disclosure can be formulated for vaginal administration. Pessaries, tampons, creams, gels, pastes, foams or sprays containing in addition to the active ingredient such carriers as are known in the art to be appropriate.

It is envisioned additionally, that the compounds of the disclosure can be attached releasably to biocompatible polymers for use in sustained release formulations on, in or attached to inserts for topical, intraocular, periocular, or systemic administration. The controlled release from a biocompatible polymer can be utilized with a water soluble polymer to form an instillable formulation, as well. The controlled release from a biocompatible polymer, such as for example, PLGA microspheres or nanospheres, can be utilized in a formulation suitable for intra ocular implantation or injection for sustained release administration, as well any suitable biodegradable and biocompatible polymer can be used.

In one aspect of the disclosure, the subject's carrier status of any of the genetic variation risk variants described herein, or genetic variants identified via other analysis methods within the genes or regulatory loci that are identified by the CNVs described herein, can be used to help determine whether a particular treatment modality for a developmental disorder, such as any one of the above, or a combination thereof, should be administered. The present disclosure also relates to methods of monitoring progress or effectiveness of a treatment option for a developmental disorder. The treatment option can include any of the above mentioned treatment options commonly used. This can be done based on the outcome of determination of the presence of a particular genetic variation risk variant in the individual, or by monitoring expression of genes that are associated with the variants of the present disclosure. Expression levels and/or mRNA levels can thus be determined before and during treatment to monitor its effectiveness. Alternatively, or concomitantly, the status with respect to a genetic variation, and or genotype and/or haplotype status of at least one risk variant for a developmental disorder presented herein can determined before and during treatment to monitor its effectiveness. It can also be appreciated by those skilled in the art that aberrant expression levels of a gene impacted by a CNV or other mutations found as a consequence of targeted sequencing of the CNV-identified gene can be assayed or diagnostically tested for by measuring the protein expression level of said aberrantly expressed gene. In another embodiment, aberrant expression levels of a gene may result from a CNV impacting a DNA sequence (e.g., transcription factor binding site) that regulates a gene who's aberrant expression level is involved in or causes a developmental disorder, or other mutations found as a consequence of targeted sequencing of the CNV-identified gene regulatory sequence, can be assayed or diagnostically tested for by measuring the protein expression level of the gene involved in or causative of a developmental disorder. In some embodiments, a specific CNV mutation within a gene, or other specific mutations found upon targeted sequencing of a CNV-identified gene found to be involved in or causative of a developmental disorder, may cause an aberrant structural change in the expressed protein that results from said gene mutations and the altered protein structure(s) can be assayed via various methods know to those skilled in the art.

Alternatively, biological networks or metabolic pathways related to the genes within, or associated with, the genetic variations described herein can be monitored by determining mRNA and/or polypeptide levels. This can be done for example, by monitoring expression levels or polypeptides for several genes belonging to the network and/or pathway, in samples taken before and during treatment. Alternatively, metabolites belonging to the biological network or metabolic pathway can be determined before and during treatment. Effectiveness of the treatment is determined by comparing observed changes in expression levels/metabolite levels during treatment to corresponding data from healthy subjects.

In a further aspect, the genetic variations described herein, and/or those subsequently found (e.g., via other genetic analysis methods such as sequencing) via targeted analysis of those genes initially identified by the genetic variations described herein, can be used to increase power and effectiveness of clinical trials. Thus, individuals who are carriers of at least one at-risk genetic variation can be more likely to respond to a particular treatment modality for a developmental disorder. In some embodiments, individuals who carry at-risk variants for gene(s) in a pathway and/or metabolic network for which a particular treatment is targeting are more likely to be responders to the treatment. In another embodiment, individuals who carry at-risk variants for a gene, which expression and/or function is altered by the at-risk variant, are more likely to be responders to a treatment modality targeting that gene, its expression or its gene product. This application can improve the safety of clinical trials, but can also enhance the chance that a clinical trial can demonstrate statistically significant efficacy, which can be limited to a certain sub-group of the population. Thus, one possible outcome of such a trial is that carriers of certain genetic variants, are statistically significant and likely to show positive response to the therapeutic agent. Further, one or more of the genetic variations employed during clinical trials for a given therapeutic agent can be used in a companion diagnostic test that is administered to the patient prior to administration of the therapeutic agent to determine if the patient is likely to have favorable response to the therapeutic agent.

In a further aspect, the genetic variations described herein can be used for targeting the selection of pharmaceutical agents for specific individuals. The pharmaceutical agent can be any of the agents described in the above. Personalized selection of treatment modalities, lifestyle changes or combination of the two, can be realized by the utilization of the at-risk genetic variations or surrogate markers in linkage disequilibrium with the genetic variations. Thus, the knowledge of an individual's status for particular genetic variations can be useful for selection of treatment options, for example, for treatments that target genes or gene products affected by one or more of the genetic variations. Certain combinations of variants, including those described herein, but also combinations with other risk variants for a developmental disorder, can be suitable for one selection of treatment options, while other variant combinations can target other treatment options. Such combinations of variants can include one variant, two variants, three variants, or four or more variants, as needed to determine with clinically reliable accuracy the selection of treatment module.

Animal and Cell Models of Developmental disorders

Also provided herein are engineered cells that can harbor one or more polymorphism described herein, for example, one or more genetic variations associated with a developmental disorder, for example, a SNP or CNV. Such cells can be useful for studying the effect of a polymorphism on physiological function, and for identifying and/or evaluating potential therapeutic agents such as anti-psychotics for the treatment of a developmental disorder.

Methods are known in the art for generating cells, for example, by homologous recombination between the endogenous gene and an exogenous DNA molecule introduced into a cell, for example, a cell of an animal. In some cases, cells can be used to generate transgenic animals using methods known in the art.

The cells are preferably mammalian cells in which an endogenous gene has been altered to include a genetic variation as described herein. Techniques such as targeted homologous recombination, can be used to insert the heterologous DNA as described in, e.g., Chappel, U.S. Pat. No. 5,272,071; WO 91/06667. In another embodiment induced pluripotent stem cells with specific disease-causing or disease-associated mutations (such as CNVs and SNVs) can be used for disease modeling and drug discovery, for example, as described in Grskovic et al. (2011) Nat. Rev. Drug. Discov. 10(12):915-29.

Autism Spectrum Disorder is not known to occur naturally in any species other than humans, although recently, an animal model has been developed that shows some features of the disease. This mouse model was created by replacing the normal mouse neuroligin-3 gene with a mutated neuroligin-3 gene associated with autism in humans (Siidhof, M. D., et al., UT Southwestern; Tabuchi et al. (2007) Science 318(5847):71-6). By doing so, a gene was created in mice similar to the human autism disease gene. While the result amounted to a very small change in their genetic makeup, it mimics the same small change occurring in some patients with human autism. This and any other models described in the literature can be used with the methods of the disclosure.

Pharmaceutical compositions suitable for use in the present disclosure include compositions wherein the active ingredients are present in an effective amount, i.e., in an amount effective to achieve therapeutic and/or prophylactic benefit in a host with at least one a developmental disorder associated symptom. The actual amount effective for a particular application will depend on the condition or conditions being treated, the condition of the subject, the formulation, and the route of administration, as well as other factors known to those of skill in the art. Determination of an effective amount of a developmental disorder associated biomarkers' inhibitors is well within the capabilities of those skilled in the art, in light of the disclosure herein, and will be determined using routine optimization techniques.

The effective amount for use in humans can be determined from animal models. For example, a dose for humans can be formulated to achieve circulating, liver, topical and/or gastrointestinal concentrations that have been found to be effective in animals. One skilled in the art can determine the effective amount for human use, especially in light of the animal model experimental data described herein. Based on animal data, and other types of similar data, those skilled in the art can determine the effective amounts of compositions of the present disclosure appropriate for humans.

The effective amount when referring to an agent or combination of agents of the disclosure will generally mean the dose ranges, modes of administration, formulations, etc., that have been recommended or approved by any of the various regulatory or advisory organizations in the medical or pharmaceutical arts (e.g., FDA, AMA) or by the manufacturer or supplier.

Further, appropriate doses for a developmental disorder's associated biomarkers' inhibitors can be determined based on in vitro experimental results. For example, the in vitro potency of an agent in inhibiting a developmental disorder's associated biomarkers' components, provides information useful in the development of effective in vivo dosages to achieve similar biological effects. In some embodiments, administration of agents of the present disclosure can be intermittent, for example, administration once every two days, every three days, every five days, once a week, once or twice a month, and the like. In some embodiments, the amount, forms, and/or amounts of the different forms can be varied at different times of administration.

A person of skill in the art would be able to monitor in a subject the effect of administration of a particular agent. Other techniques would be apparent to one of skill in the art, wherein the active ingredients are present in an effective amount, for example, in an amount effective to achieve therapeutic and/or prophylactic benefit in a host with at least one developmental disorder associated symptom. The actual amount effective for a particular application will depend on the condition or conditions being treated, the condition of the subject, the formulation, and the route of administration, as well as other factors known to those of skill in the art. Determination of an effective amount of a developmental disorder's associated biomarkers' inhibitors is well within the capabilities of those skilled in the art, in light of the disclosure herein, and will be determined using routine optimization techniques.

Further, appropriate doses for a developmental disorder's associated biomarkers' inhibitors can be determined based on in vitro experimental results. For example, the in vitro potency of an agent in inhibiting a developmental disorder's associated biomarkers' components can provide information useful in the development of effective in vivo dosages to achieve similar biological effects.

Kits

Kits useful in the methods of the disclosure comprise components useful in any of the methods described herein, including for example, primers for nucleic acid amplification, hybridization probes for detecting genetic variation, or other marker detection, restriction enzymes, nucleic acid probes, optionally labeled with suitable labels, allele-specific oligonucleotides, antibodies that bind to an altered polypeptide encoded by a nucleic acid of the disclosure as described herein or to a wild type polypeptide encoded by a nucleic acid of the disclosure as described herein, means for amplification of genetic variations or fragments thereof, means for analyzing the nucleic acid sequence of nucleic acids comprising genetic variations as described herein, means for analyzing the amino acid sequence of a polypeptide encoded by a nucleic acid, or a nucleic acid associated with a genetic variation, etc. The kits can for example, include necessary buffers, nucleic acid primers for amplifying nucleic acids, and reagents for allele-specific detection of the fragments amplified using such primers and necessary enzymes (e.g., DNA polymerase). Additionally, kits can provide reagents for assays to be used in combination with the methods of the present disclosure, for example, reagents for use with other screening assays for a developmental disorder.

In some embodiments, the disclosure pertains to a kit for assaying a sample from a subject to detect the presence of a genetic variation, wherein the kit comprises reagents necessary for selectively detecting at least one particular genetic variation in the genome of the individual. In another embodiment, the disclosure pertains to a kit for assaying a sample from a subject to detect the presence of at least particular allele of at least one polymorphism associated with a genetic variation in the genome of the subject. In some embodiments, the reagents comprise at least one contiguous oligonucleotide that hybridizes to a fragment of the genome of the individual comprising at least genetic variation. In another embodiment, the reagents comprise at least one pair of oligonucleotides that hybridize to opposite strands of a genomic segment obtained from a subject, wherein each oligonucleotide primer pair is designed to selectively amplify a fragment of the genome of the individual that includes at least one genetic variation, or a fragment of a genetic variation. Such oligonucleotides or nucleic acids can be designed using the methods described herein. In another embodiment, the kit comprises one or more labeled nucleic acids capable of allele-specific detection of one or more specific polymorphic markers or haplotypes with a genetic variation, and reagents for detection of the label. In some embodiments, a kit for detecting SNP markers can comprise a detection oligonucleotide probe, that hybridizes to a segment of template DNA containing a SNP polymorphisms to be detected, an enhancer oligonucleotide probe, detection probe, primer and/or an endonuclease, for example, as described by Kutyavin et al. (Nucleic Acid Res. 34:e128 (2006)).

In some embodiments, the DNA template is amplified by any means of the present disclosure, prior to assessment for the presence of specific genetic variations as described herein. Standard methods well known to the skilled person for performing these methods can be utilized, and are within scope of the disclosure. In one such embodiment, reagents for performing these methods can be included in the reagent kit.

In a further aspect of the present disclosure, a pharmaceutical pack (kit) is provided, the pack comprising a therapeutic agent and a set of instructions for administration of the therapeutic agent to humans screened for one or more variants of the present disclosure, as disclosed herein. The therapeutic agent can be a small molecule drug, an antibody, a peptide, an antisense or RNAi molecule, or other therapeutic molecules as described herein. In some embodiments, an individual identified as a carrier of at least one variant of the present disclosure is instructed to take a prescribed dose of the therapeutic agent. In one such embodiment, an individual identified as a carrier of at least one variant of the present disclosure is instructed to take a prescribed dose of the therapeutic agent. In another embodiment, an individual identified as a non-carrier of at least one variant of the present disclosure is instructed to take a prescribed dose of the therapeutic agent.

Also provided herein are articles of manufacture, comprising a probe that hybridizes with a region of human chromosome as described herein and can be used to detect a polymorphism described herein. For example, any of the probes for detecting polymorphisms described herein can be combined with packaging material to generate articles of manufacture or kits. The kit can include one or more other elements including: instructions for use; and other reagents such as a label or an agent useful for attaching a label to the probe. Instructions for use can include instructions for screening applications of the probe for making a diagnosis, prognosis, or theranosis to a developmental disorder in a method described herein. Other instructions can include instructions for attaching a label to the probe, instructions for performing in situ analysis with the probe, and/or instructions for obtaining a sample to be analyzed from a subject. In some cases, the kit can include a labeled probe that hybridizes to a region of human chromosome as described herein.

The kit can also include one or more additional reference or control probes that hybridize to the same chromosome or another chromosome or portion thereof that can have an abnormality associated with a particular endophenotype. A kit that includes additional probes can further include labels, e.g., one or more of the same or different labels for the probes. In other embodiments, the additional probe or probes provided with the kit can be a labeled probe or probes. When the kit further includes one or more additional probe or probes, the kit can further provide instructions for the use of the additional probe or probes. Kits for use in self-testing can also be provided. Such test kits can include devices and instructions that a subject can use to obtain a biological sample (e.g., buccal cells, blood) without the aid of a health care provider. For example, buccal cells can be obtained using a buccal swab or brush, or using mouthwash.

Kits as provided herein can also include a mailer (e.g., a postage paid envelope or mailing pack) that can be used to return the sample for analysis, e.g., to a laboratory. The kit can include one or more containers for the sample, or the sample can be in a standard blood collection vial. The kit can also include one or more of an informed consent form, a test requisition form, and instructions on how to use the kit in a method described herein. Methods for using such kits are also included herein. One or more of the forms (e.g., the test requisition form) and the container holding the sample can be coded, for example, with a bar code for identifying the subject who provided the sample.

In some embodiments, an in vitro screening test can comprise one or more devices, tools, and equipment configured to collect a genetic sample from an individual. In some embodiments of an in vitro screening test, tools to collect a genetic sample can include one or more of a swab, a scalpel, a syringe, a scraper, a container, and other devices and reagents designed to facilitate the collection, storage, and transport of a genetic sample. In some embodiments, an in vitro screening test can include reagents or solutions for collecting, stabilizing, storing, and processing a genetic sample.

Such reagents and solutions for nucleotide collecting, stabilizing, storing, and processing are well known by those of skill in the art and can be indicated by specific methods used by an in vitro screening test as described herein. In another embodiment, an in vitro screening test as disclosed herein, can comprise a microarray apparatus and reagents, a flow cell apparatus and reagents, a multiplex nucleotide sequencer and reagents, and additional hardware and software necessary to assay a genetic sample for certain genetic markers and to detect and visualize certain genetic markers.

The present disclosure further relates to kits for using antibodies in the methods described herein. This includes, but is not limited to, kits for detecting the presence of a variant protein in a test sample. One preferred embodiment comprises antibodies such as a labeled or labelable antibody and a compound or agent for detecting variant proteins in a biological sample, means for determining the amount or the presence and/or absence of variant protein in the sample, and means for comparing the amount of variant protein in the sample with a standard, as well as instructions for use of the kit. In certain embodiments, the kit further comprises a set of instructions for using the reagents comprising the kit.

Unless otherwise explained, all technical and scientific terms used herein have the same meaning as commonly understood by one of ordinary skill in the art to which this disclosure belongs. The following references contain embodiments of the methods and compositions that can be used herein: The Merck Manual of Diagnosis and Therapy, 18th Edition, published by Merck Research Laboratories, 2006 (ISBN 0-911910-18-2); Benjamin Lewin, Genes IX, published by Jones & Bartlett Publishing, 2007 (ISBN-13: 9780763740634); Kendrew et al. (eds.), The Encyclopedia of Molecular Biology, published by Blackwell Science Ltd., 1994 (ISBN 0-632-02182-9); and Robert A. Meyers (ed.), Molecular Biology and Biotechnol-ogy: a Comprehensive Desk Reference, published by VCH Publishers, Inc., 1995 (ISBN 1-56081-569-8). Standard procedures of the present disclosure are described, e.g., in Maniatis et al., Molecular Cloning: A Laboratory Manual, Cold Spring Harbor Laboratory Press, Cold Spring Harbor, N.Y., USA (1982); Sambrook et al., Molecular Cloning: A Laboratory Manual (2 ed.), Cold Spring Harbor Laboratory Press, Cold Spring Harbor, N.Y., USA (1989); Davis et al., Basic Methods in Molecular Biology, Elsevier Science Publishing, Inc., New York, USA (1986); or Methods in Enzymology: Guide to Molecular Cloning Techniques Vol. 152, S. L. Berger and A. R. Kimmerl (eds.), Academic Press Inc., San Diego, USA (1987)). Current Protocols in Molecular Biology (CPMB) (Fred M. Ausubel, et al. ed., John Wiley and Sons, Inc.), Current Protocols in Protein Science (CPPS) (John E. Coligan, et. al., ed., John Wiley and Sons, Inc.), Current Protocols in Immunology (CPI) (John E. Coligan, et. al., ed. John Wiley and Sons, Inc.), Current Protocols in Cell Biology (CPCB) (Juan S. Bonifacino et. al. ed., John Wiley and Sons, Inc.), Culture of Animal Cells: A Manual of Basic Technique by R. Ian Freshney, Publisher: Wiley-Liss; 5th edition (2005), and Animal Cell Culture Methods (Methods in Cell Biology, Vol. 57, Jennie P. Mather and David Barnes editors, Academic Press, 1st edition, 1998), which are all incorporated by reference herein in their entireties.

It should be understood that the following examples should not be construed as being limiting to the particular methodology, protocols, and compositions, etc., described herein and, as such, can vary. The following terms used herein is for the purpose of describing particular embodiments only, and is not intended to limit the scope of the embodiments disclosed herein.

Disclosed herein are molecules, materials, compositions, and components that can be used for, can be used in conjunction with, can be used in preparation for, or are products of methods and compositions disclosed herein. It is understood that when combinations, subsets, interactions, groups, etc. of these materials are disclosed and while specific reference of each various individual and collective combinations and permutation of these molecules and compounds cannot be explicitly disclosed, each is specifically contemplated and described herein. For example, if a nucleotide or nucleic acid is disclosed and discussed and a number of modifications that can be made to a number of molecules including the nucleotide or nucleic acid are discussed, each and every combination and permutation of nucleotide or nucleic acid and the modifica-tions that are possible are specifically contemplated unless specifically indicated to the contrary. This concept applies to all aspects of this application including, but not limited to, steps in methods of making and using the disclosed molecules and compositions. Thus, if there are a variety of additional steps that can be performed it is understood that each of these additional steps can be performed with any specific embodiment or combination of embodiments of the disclosed methods, and that each such combination is specifically contemplated and should be considered disclosed.

Those skilled in the art will recognize, or be able to ascertain using no more than routine experimentation, many equivalents to the specific embodiments of the method and compositions described herein. Such equivalents are intended to be encompassed by the following claims.

It is understood that the disclosed methods and compositions are not limited to the particular methodology, protocols, and reagents described as these can vary. It is also to be understood that the terminology used herein is for the purpose of describing particular embodiments only, and is not intended to limit the scope of the present disclosure which will be limited only by the appended claims.

Unless defined otherwise, all technical and scientific terms used herein have the meanings that would be commonly understood by one of skill in the art in the context of the present specification.

It must be noted that as used herein and in the appended claims, the singular forms "a," "an," and "the" include plural reference unless the context clearly dictates otherwise. Thus, for example, reference to "a nucleotide" includes a plurality of such nucleotides; reference to "the nucleotide" is a reference to one or more nucleotides and equivalents thereof known to those skilled in the art, and so forth.

The term "and/or" shall in the present context be understood to indicate that either or both of the items connected by it are involved. While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein can be employed in practicing the disclosure. It is intended that the following claims define the scope of the disclosure and that methods and structures within the scope of these claims and their equivalents be covered thereby.

EXAMPLES

Example 1

In the present study, an Agilent 1M CGH array was used to detect novel, rare CNVs in a total of 818 individuals, including 703 unrelated ASD probands, 35 affected ASD siblings, 45 parents, 34 unaffected siblings and one individual with developmental delay. A vast majority of these samples have been previously run on other SNP microarrays. The ASD cases were competitively hybridized to a pool of fifty sex-matched Caucasian controls as a reference. The CNV calling was performed using Aberration Detection Module 2 (ADM2) algorithm of DNA Analytics 4.0.85 and a circular binary segmentation (CBS) algorithm implemented in the DNAcopy package. The CNVs detected by both algorithms were defined as stringent and were utilized for further analyses. The calls were compared with the CNV data from Illumina 1M single and duo, Affymetrix 500K, Affymetrix 6.0, and Illumina 2.5M arrays. For example, 350 samples in the dataset were run previously on Illumina 1M single array which was analyzed using two algorithms iPattern and QuantiSNP. The average number of stringent calls generated for Agilent 1M and Illumina 1M is 36 and 18, respectively. Only 27% of the total Agilent 1M call sets were found to be detected using the Illumina 1M platform. Conversely, 46% of the Illumina 1M calls were not detected using the Agilent 1M platform. The difference in the CNVs detected using multiple platforms is mainly due to the differences in probe distribution and sensitivity of the detection algorithms used. For example, the probe distribution on the Agilent 1M array is more evenly spaced across the genome as compared to SNP genotyping platforms such as the Illumina 1M array.

Stringent ASD CNVs were classified as rare if they were not detected in any of the 4,139 controls (1,782 subjects from the SAGE study, 1,234 unrelated controls from the OHI study, and 1,123 European controls from the PopGen study). The SAGE controls were genotyped with Illumina Human 1M-single BeadChip arrays and a subset of stringent CNVs detected by both iPattern and QuantiSNP were used. The OHI and PopGen controls were genotyped with Affymetrix Genome-Wide Human SNP 6.0 arrays and the stringent subset consisted of regions that were detected by at least two of the three different CNV calling algorithms, Birdsuite, iPattern and Affymetrix Genotyping Console.

For each sample for which CNV calls from SNP microarrays were available, stringent CNVs detected using the Agilent 1M array were overlapped with the stringent CNVs detected by corresponding SNP microarray experiments. The CNVs from the SNP arrays were filtered to include only the regions with five probes or more. The CNVs were considered to be novel when 50% or more by length of the detected call was unique to a platform.

A threshold log2ratio value was used to determine losses and gains. For DNA Analytics, a log2ratio cutoff of 0.25 and −0.25 to classify gains and losses respectively was used. For DNAcopy, a log2ratio cutoff of 0.1 and −0.13 to classify gains and losses respectively was used. An example of a CNV detected by the DNA Analytics log2ratio algorithm can be seen in FIG. 1. The genomic DNA was isolated using standard Autopure (Qiagen) method. Methods and settings recommended by Agilent for processing of the samples and microarray hybridization techniques were followed. Agilent DNA Microarray Scanner was used to quantify the Cy3/Cy5 signals. Standard conditions were used for the Agilent 1M microarray and stringent settings were used for the analysis. A minimum of 50% reciprocal overlap to tag the CNVs as identified was used. Parameters for ADM2 (DNA Analytics 4.0.85) were set as follows: Threshold: 6.0, Centralization: OFF, Fuzzy Zero: OFF, Combine Replicates (Intra Array): ON, Combine Replicates (Inter Array): OFF, Genome: hg18, Aberration Filters: minProbes=5 AND minAvgAbsLogRatio=0.25 AND maxAberrations=10000 AND percentPenetrance=0 Feature Level Filters: gIsSaturated=true OR rIsSaturated=true OR gIsFeatNonUnifOL=true OR rIsFeatNonUnifOL=true, Array Level Filters: NONE, Expand Non Unique Probes: ON, Genomic Boundaries: Not Applied, Parameters for CBS algorithms (DNA copy version 1.22.1): smooth.CNA (x, smooth.region=2, outlier.SD-.scale=4, smooth.SD.scale=2, trim=0.025), segment (x, weights=NULL, alpha=0.01, nperm=10000, p.method=c ("hybrid", "perm"), min width=2, kmax=25, nmin=200, eta=0.05, sbdry=NULL, trim=0.025, undo.splits=c ("none"), verbose=1)

Details on the parameters used for iPattern and QuantiSNP algorithms can be found in Pinto et al. (2010), Nature 466(7304):368-72.

Example 2

Figure 2:
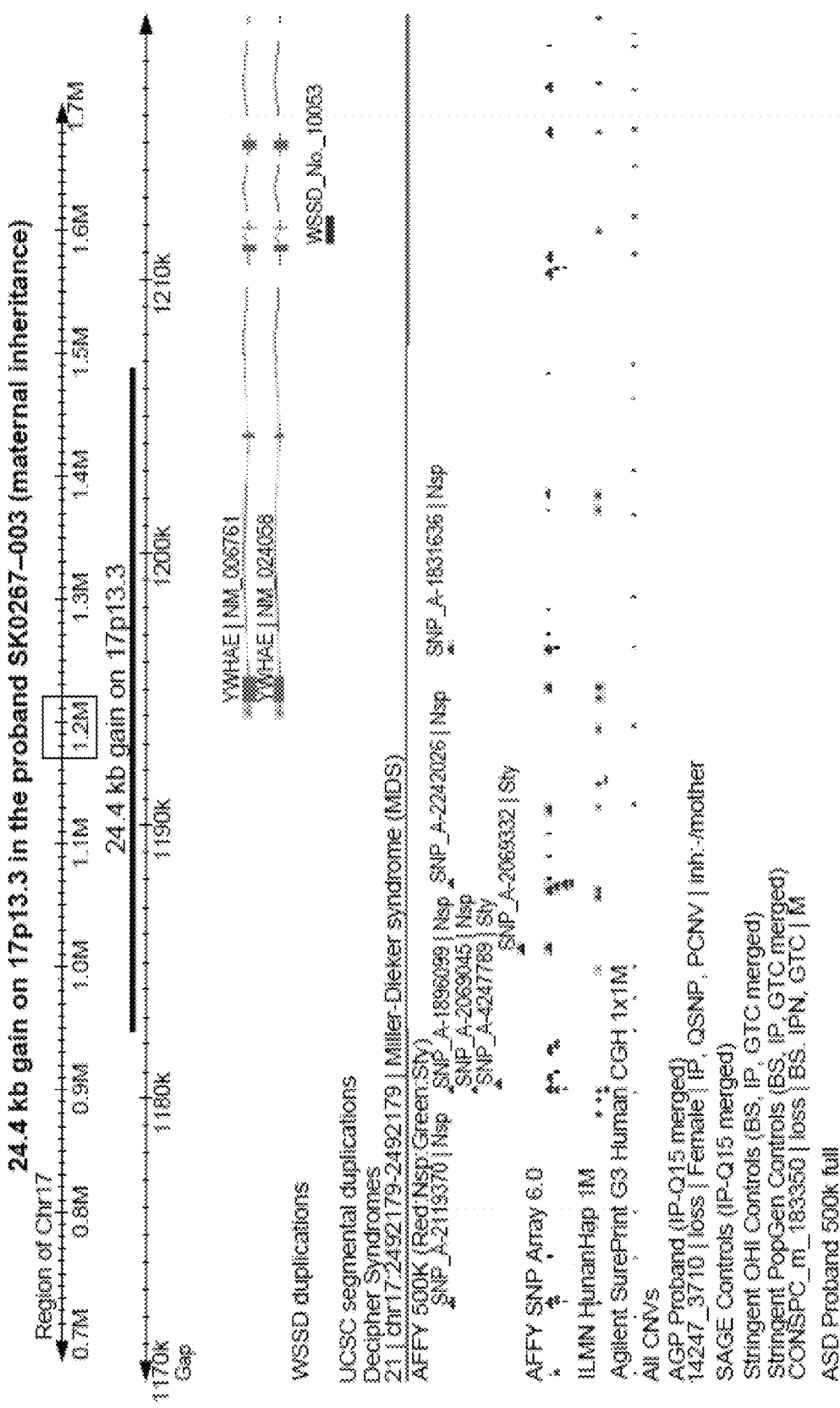
FIG. 2 is an annotated version of the log2ratio plot from FIG. 1.

Another interesting recurrent CNV of size 24.8 kb was detected in two unrelated ASD cases, a duplication event disrupting two exons of YWHAE (tyrosine 3/tryptophan 5-monooxygenase gene) gene at the 17p13.3 locus (FIG. 2). It was maternally inherited in both ASD cases and was not present in controls. YWHAE belongs to the 14-3-3 family of proteins, which mediate signal transduction, and is highly conserved in both plants and mammals Only micro-duplications in YWHAE gene have been reported in ASD. It has been shown that the phenotype of patients with a 17p13.3 micro-duplication involving YWHAE gene show autistic manifestation, behavioral symptoms, speech and motor delay, subtle dysmorphic facial features, and subtle hand-foot malformation.

Example 3

Figure 3:
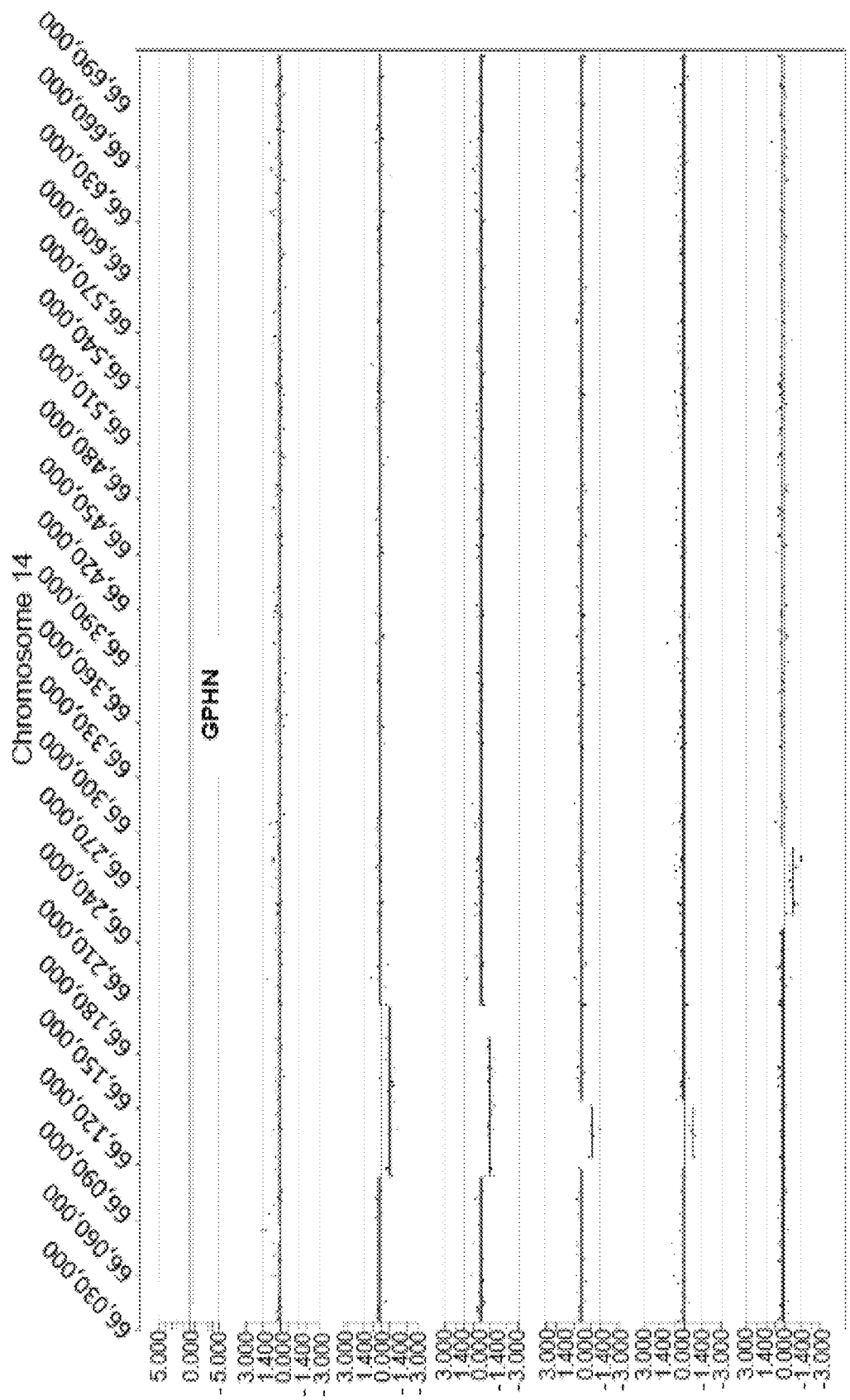
FIG. 3 represents an example of intronic CNVs clustered within an intronic region of the gene GPHN located on chromosome 14. There are 7 ASD cases in total and 6 of these are depicted. The CNVs include a gain (log2ratio>0.35) and losses (log2ratio<−0.35). The order of ASD patient Hospital IDs (top to bottom) are: SS0054, SSO254, SS0100, SS0025, SS0711, SS0175.

FIG. 3 represents an example of intronic CNVs clustered within an intronic region of the gene GPHN (gephyrin) located on chromosome 14. There are 7 ASD cases in total and 6 of these are depicted. The CNVs include a gain (log2ratio>0.35) and losses (log2ratio<−0.35).

In the figure, two types of data track information are shown, from top to bottom: 1) RefSeq gene annotation showing the genome location (x-axis) of genes demarcated in light gray (introns) and dark gray (exons) and with multiple entries depicted if multiple transcript variants are annotated that correspond to the gene, and 2) array CGH data (black dots correspond to the probes on the microarray) for ASD cases (6 total) with a CNV wherein the y-axis is the log2ratio value of the test (ASD case) and reference (healthy control) genomic DNAs and the x-axis corresponds to the genome location of the probes and CNVs, which are depicted as line segments shifted positively (copy number gain) or negatively (copy number loss) relative to the baseline (log2 ratio=0). Order of ASD patient Hospital IDs (top to bottom) are: SS0054, SSO254, SS0100, SS0025, SS0711, SS0175.

Example 4

Figure 4:
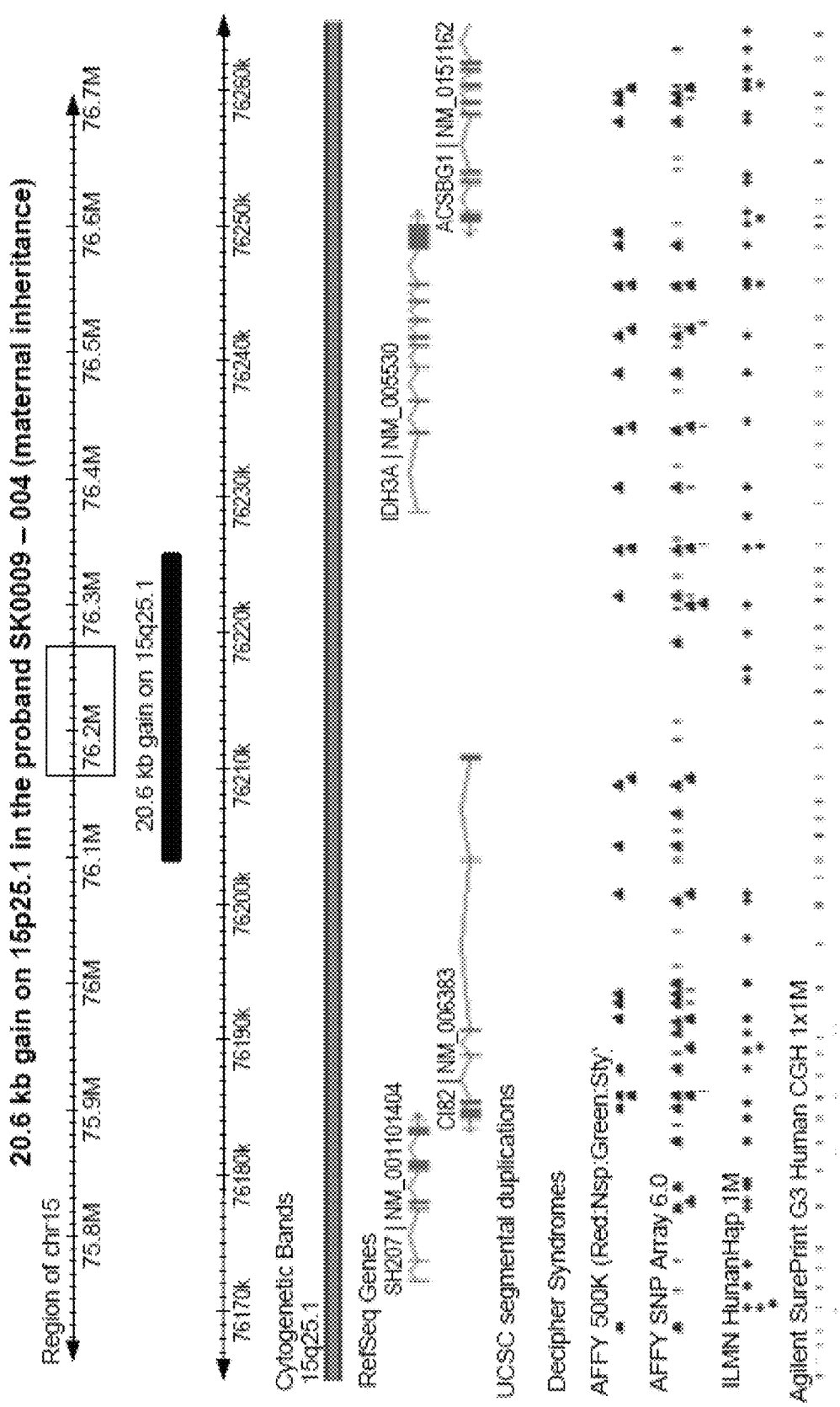
FIG. 4 is an annotated version of rare CN-(s) impacting gene CIB2.

One of the ASD-specific CNVs was a maternally inherited duplication at 15q25.1 in three unrelated ASD cases FIG. 4) disrupting the exon of CIB2 (Calcium and integrin binding family member 2). The transcript and protein of CIB2 gene is found to be present mainly in the hippocampus and cortex of the brain. The encoded protein of this gene is shown to be involved in $Ca^{2+}$ signaling, which controls a variety of processes in many cell types. In neurons, $Ca2^+$ signaling maintains synaptic transmission, neuronal development and plasticity.

Example 5

Figure 5:
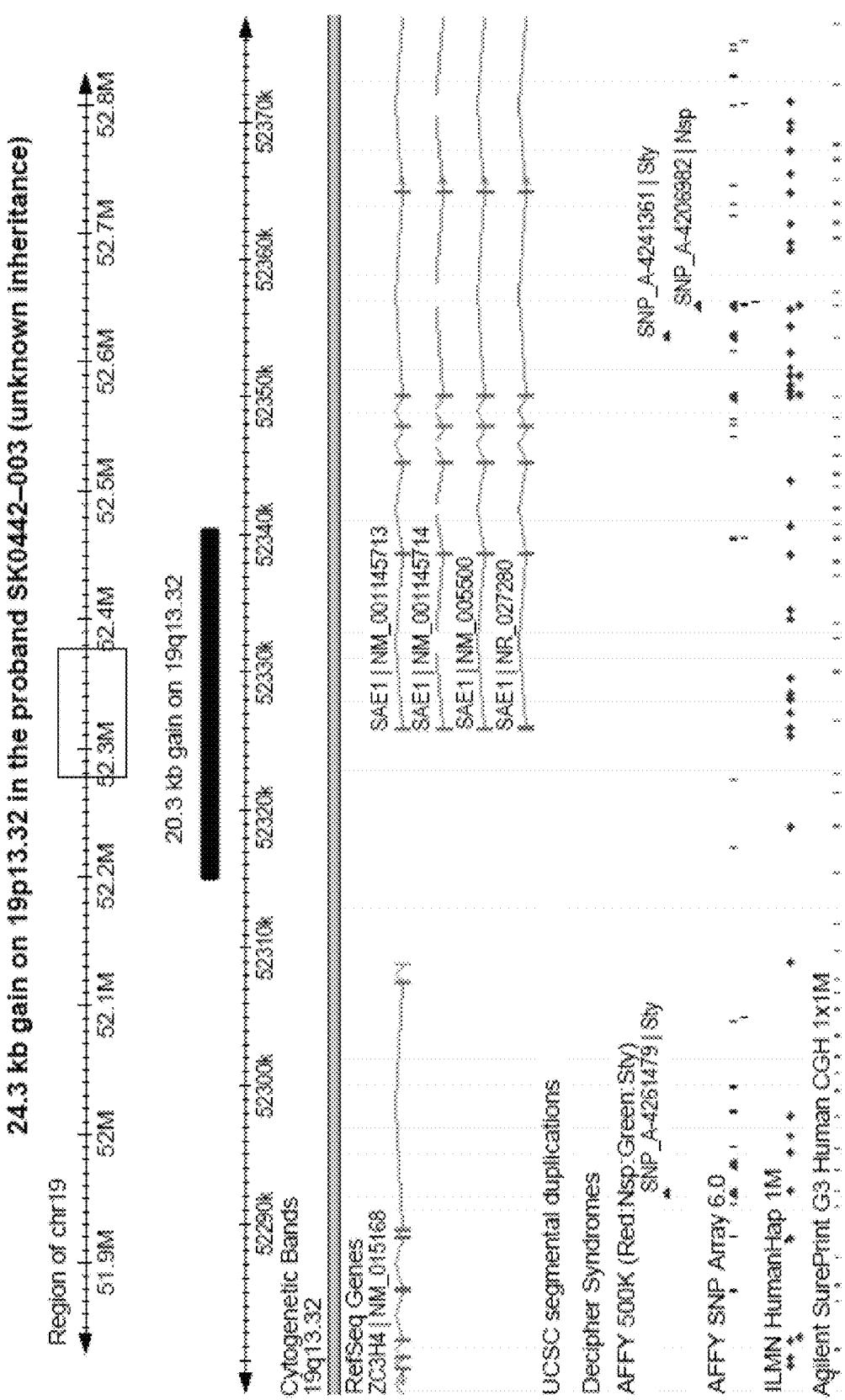
FIG. 5 is an annotated version of rare CN-(s) impacting gene SAE1.

In three unrelated male ASD probands, a recurrent novel CNV was observed, a 24.3 kb duplication encompassing two exons of the SAE1 (SUMO1 activating enzyme subunit 1) gene at the 19q13.32 locus (FIG. 5). The same CNV was also found in one control. Interestingly, another duplication of size 50.8 kb disrupting six exons of SAE1 was observed in a fourth unrelated ASD case using the Agilent 1M CGH array and was also detected by previous SNP microarray study. The SAE1 gene is involved in protein sumoylation process and is shown to interact with the ARX gene, which is involved in Autistic disorder.

Eample 6

Figure 6:
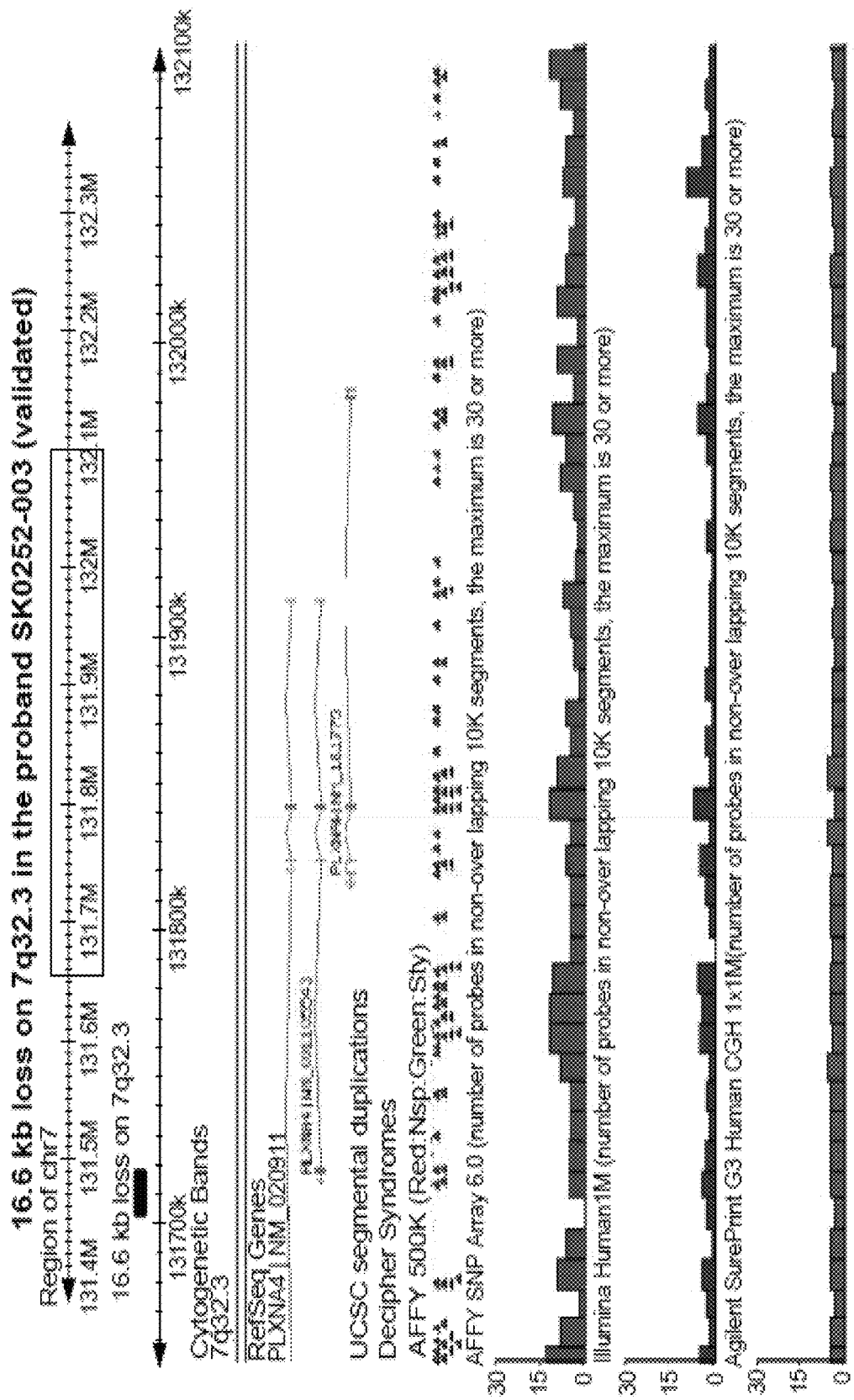
FIG. 6 is an annotated version of rare CN-(s) impacting gene PLXNA4.

In one ASD case, a 16.6 kb loss impacting the PLXNA4 (plexin A4) gene at the 7q32.3 locus (FIG. 6) was identified. PLXNA4 is involved in axon guidance as well as nervous system development.

Example 7

Figure 7:
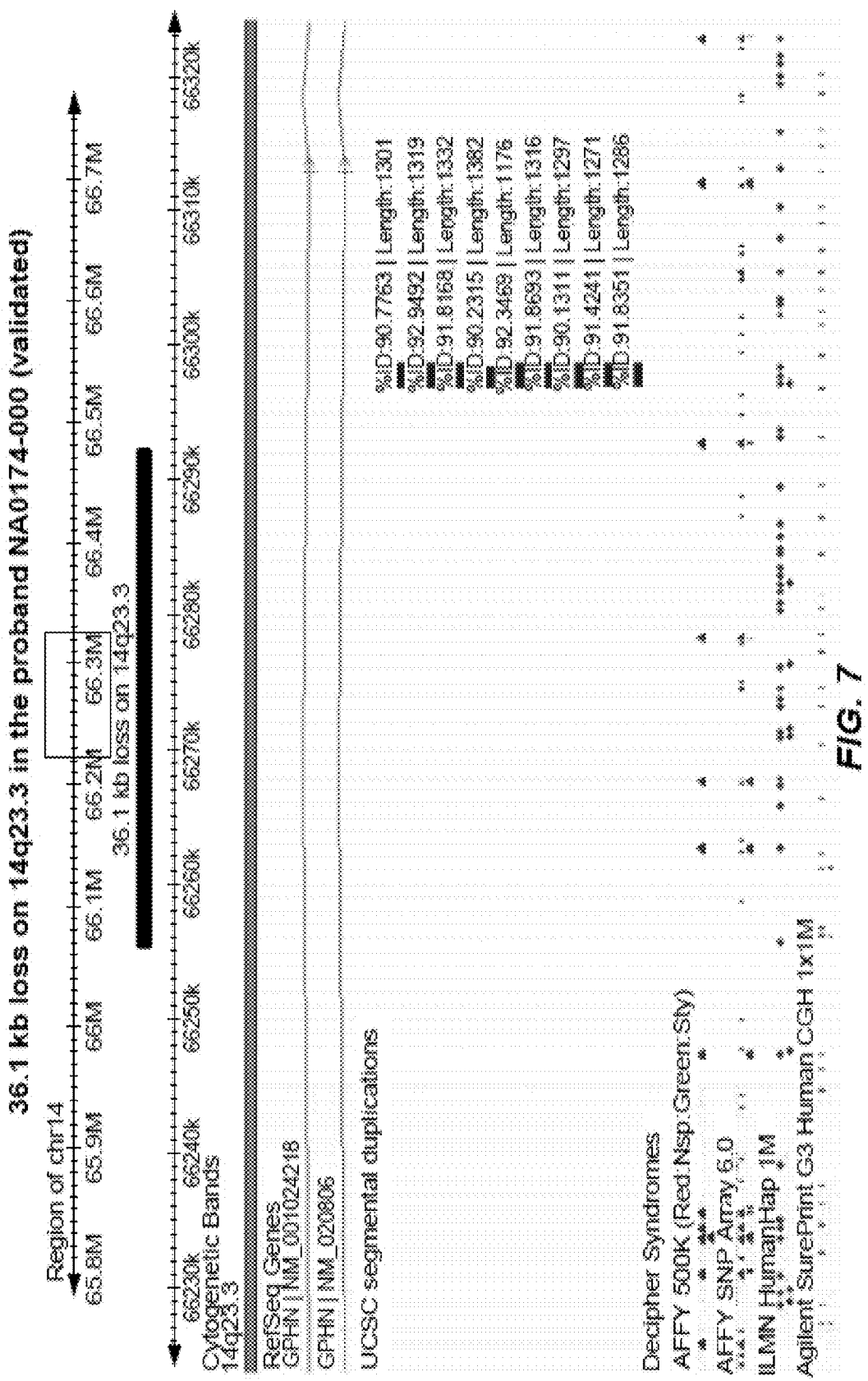
FIG. 7 is an annotated version of rare CN-(s) impacting gene GPHN.

It was validated that at least one CNV affecting GPHN was de novo in origin (the other 6 GPHN CNVs reported herein were not tested for parent of origin), a 36.1 kb loss encompassing the intron of the GPHN (Gephyrin) gene at the 14q23.3 locus. This de novo CNV (FIG. 7) was found in a male ASD proband and was not picked up on the previous SNP array and it was not found in any of the controls. Gephyrin is suggested to play a central organizer role in assembling and stabilizing inhibitory postsynaptic membranes in human brain. The lack of novel, rare de novo CNVs described herein may be due to the study design employed because nearly all the de novo CNVs reported for the ASD cohort described herein are relatively larger in size and therefore were already detected using SNP microarrays (e.g., in Pinto et al. 2010). All the novel rare CNVs that were experimentally validated were inherited from either parent. Also detected were other novel, rare CNVs present in only one unrelated ASD case in previously identified genes associated with ASD such as ERBB4, CTNND2, CDH18, PARK2, NXPH1, MTHFD1 and NF1.

Example 8

Figure 8:
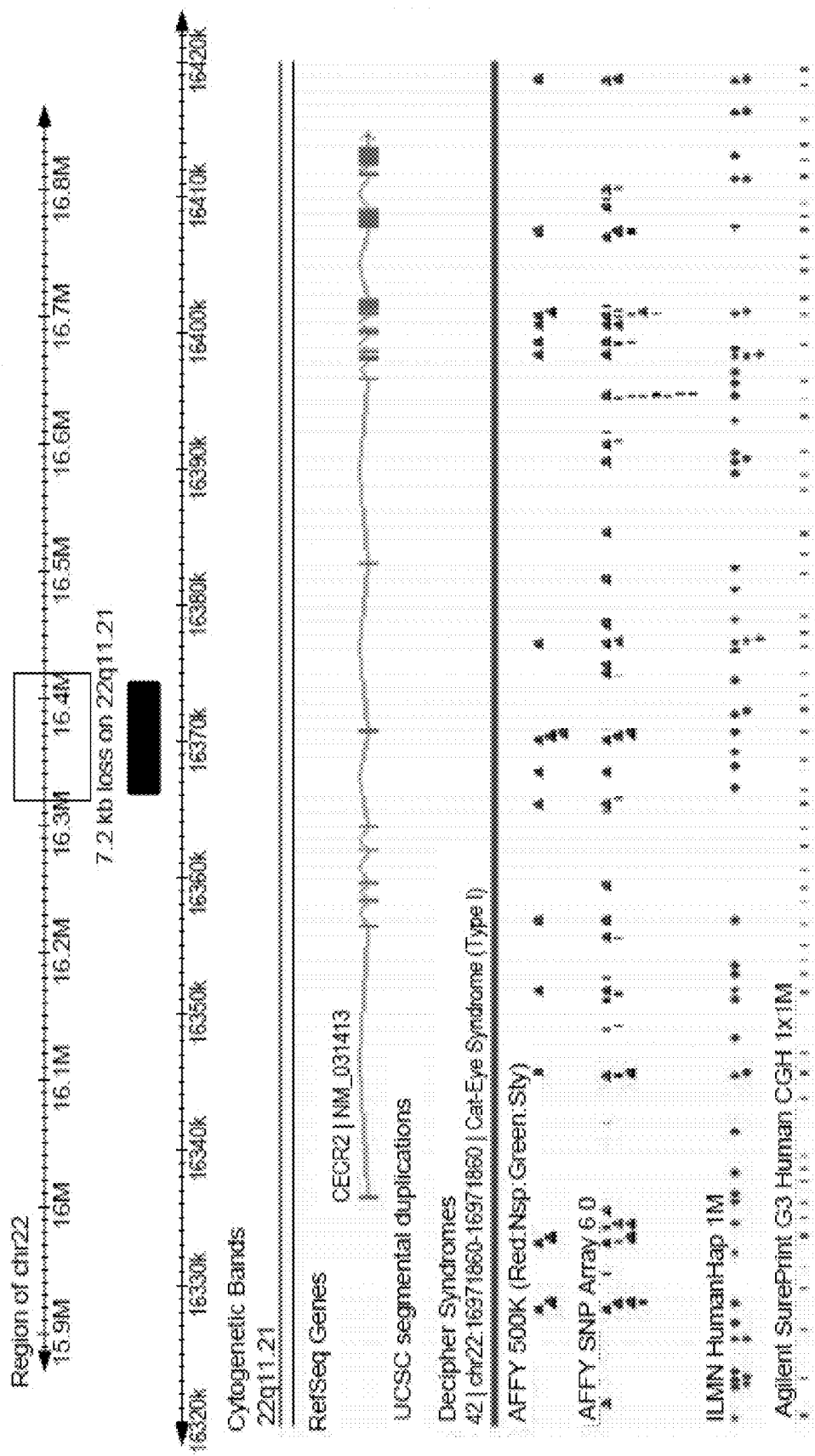
FIG. 8 is an annotated version of rare CN-(s) impacting gene CECR2.

In a female ASD case, a 7.2 kb loss disrupting an exon of the CECR2 (cat eye syndrome chromosome region, candidate 2) gene at the 22q11.21 locus (FIG. 8) was observed, which was not observed in controls. CECR2 is a chromatin remodeling factor that has been proposed to play a role in embryonic nervous system development (Banting et al. 2005).

Example 9

Figure 9:
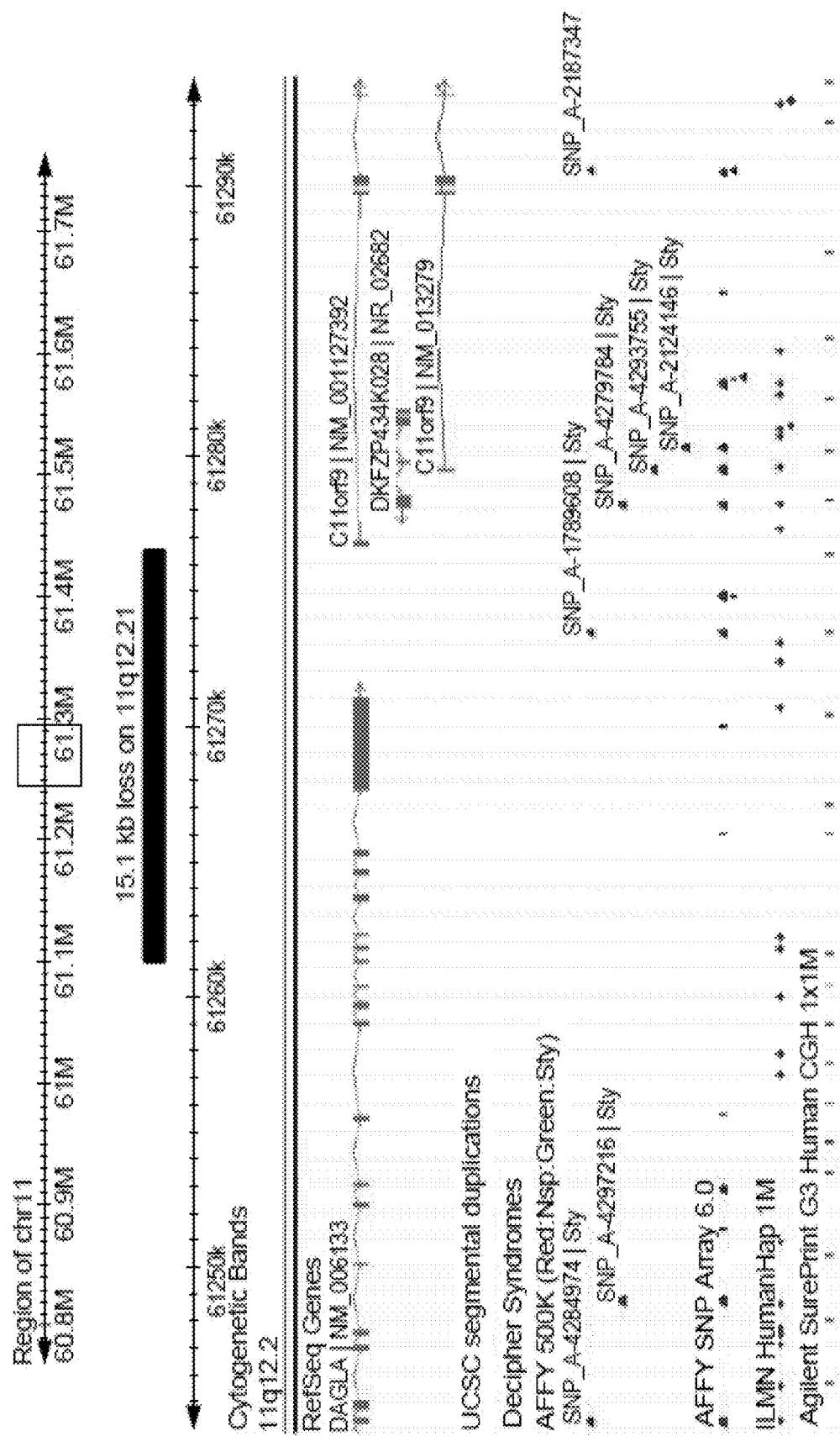
FIG. 9 is an annotated version of rare CN-(s) impacting gene DAGLA.

In another unrelated male ASD proband, a 15.1 kb paternally inherited deletion (FIG. 9) disrupting seven exons of the DAGLA (diacylglycerol lipase, alpha) gene at the 11q12.2 locus was identified and was not found in controls. DAGLA is known to synthesize an endocannabinoid that has been associated with retrograde synaptic signaling and plasticity.

Example 10

Some pathway analysis software will be used to identify whether the candidate gene will be a drug target, which may be FDA-approved or in clinical trials. Such information will assist in the design of clinical trials (e.g., patient stratification for genetic subtypes) or will be used to facilitate clinical trials that are in progress, thereby reducing the attrition rate (failure to receive FDA approval) and reducing the time and cost of drug development. When a candidate ASD gene is identified as a known drug target of an FDA-approved therapeutic, the drug can be repurposed and approved for use in a new indication (e.g., a cancer or anti-inflammatory agent may be beneficial to ASD patients as well). Those skilled in the art will recognize that Phase II and III failures may be rescued with additional clinical trial data that accounts for genetic subtypes, particularly when the drug fails for lack of efficacy. For example, if a drug will be designed or established to target a particular gene defect (e.g., use of an RNAi therapeutic to decrease aberrant overexpression of the gene that is caused by a CNV or other type of genetic variant), it will be expected that only ASD patients with that particular genetic subtype will benefit from the targeted therapy.

Example 11

Creation of Table 2 and Sequence Listing

A subset of the refGene table (hg18 freeze) was downloaded from the UCSC Genome Browser (http://genome.ucsc.edu/) using the Table Browser interface, utilizing the coordinates of the CNVs of interest (i.e., from Table 1) as a filter. The information for those transcripts was extracted, and the transcriptional start and stop sites for each transcript identified. The genomic sequence between, and including, the transcriptional start site and the transcriptional stop site was obtained. A file with the coordinate information, as well as the transcript name and genomic sequence was generated. Individual overlaps between the prioritized list of CNVs of interest and the genomic sequence of the subset of RefGene transcripts was then obtained. The output table listing the coordinates of the transcripts, as well as the CNVs to which they relate, is Table 2. The SEQ ID in Table 2 is the identifier found in the PatentIn software and the text output. The sequence file 121009_ASD_SK.txt contains genomic sequence information for all CNVs listed in Table 1 as well as for the full genomic extent of the transcripts referred to in Table 2.

For example, row 1 of Table 1 contains information related to a CNV whose coordinates are chr14:66,255,943-66,292,122 and was discovered as a 36,180 bp loss in patient NA0174-000. The sequence for this CNV is found in 121009_ASD_SK.txt and is referred to as SEQ ID 1 (sequence truncated for brevity):

```
Sequence entry starts:
<210> 1
<211> 36180
<212> DNA
<213> Homo sapiens
<400> 1
gtcacattat ctcaggtgtc tcctgggtcc tgcaggagcg gtcctctttc ttcagagggt    60

..............................................................
tatggttctg taaaatctta cctcagtgtg tagctagaat tatttagtca catattttta 36180
Sequence entry ends.
```

For an example of a transcript sequence, consider row 1 of Table 2 which relates to the first CNV in Table 1 and which overlaps the gene GPHN. There are two transcripts reported within this CNV and the first of these is dealt with on row 1: NM_001024218. This transcript has start and stop coordinates 66,043,877 and 66,718,278 (on chromosome 14) respectively and spans 674,401 of genomic sequence. This sequence is referred to as SEQ ID 77 and appears as such in 121009_ASD_SK.txt (sequence truncated for brevity):

```
Sequence entry starts:
<210> 77
<211> 674402
<212> DNA
<213> Homo sapiens
<400> 77
aagcagcgct catggcgaag aggcttaagg ccacaaaacc gtgggacagc aggaggaaga     60

.........................................................
tctgtaatga tactgaaact taatgaataa aaaaattcct tgatcattat ttaaaaatgt 674400
aa                                                                 674402
Sequence entry ends.
```

Row 2 of Table 2 relates to the same CNV in the same patients (as in Table 1) but a different transcript (NM_020806). This sequence is identified as SEQ ID 78 and is thus labeled in 121009 _ASD_SK.txt.

SEQUENCE LISTING (209 sequences)

SEQ ID NO: 1 - DNA, 36180 bp, Homo sapiens
gtcacattatctcaggtgtctcctgggtcctgcaggagcggtcctctttcttcagagggtctgtgggtcctctcgggtttcctgatttattcctgcagtcgttctgtagccaaaattcaccgtgtgaacctccacacgctgctctgttcatcccagtcagagctgccatgtagtcctgcctcccatccaccatgacagccaatctccctgctgcacaaatttgtgaaaaacgtatattcccatgtcatggtgaagagattctgattcattaacataaggatgagacccagaaatagatgtttttaggaaacatcatagataacctgataaataacatattttcagaaattttctatgggtttcaaaaagtgtaatagttgcactatggtggtaataactgatacattcaggtactactagtgaccatgtaaatcataaaactttggaaacaaatttgccattttctaaagagttattaaaatgttatataatttgattcaattatcttattttttattgttttttgtaaggcagtaatctagaaggttattttaatttatacattatttccaagattttgatattaaaagtgacatagaatctaaattattgtttatctgctcaatggatcattatataaccattaaattttataattatgaatactgtagtatcagggaaataaaaggtagataaaaagcataaatctcatttatttgtacagtacattttcaattgtctaaagattgtctaaaaataaagagtaaaggaatatgttcaaatttaaagtagttggttttggccaagtgtggcagctcactcctgtaatcccagcaaaatgagaagctgagatgggcagatcacatgagaccaagagttcgagaccagcctggccaacacggcgaaaccccgtctctactgaaaatacaaaaatttgctgggggtggttgtgcacatctaaaatttcagctacttgggaggctaaggcatgagaatcacttgaacatacttcttgaataaagaagtcacttcctggactctaagccaagagtctaagccaaatatcagaccagtttttccagggggccttattagcattcatttgttaaagtcaaccttagtttcttaaagctgaccatcatatctaattttgcacatcatactcactaatggtttccagattctggaggaatcaagtagagagaaaaagtaattatttcaattttatttataaaaatataatctaggccaggcatggtggcttatgcctgtaatctcagcatttttggagtccaacgcaagtggatagcttgagcctaagagttcaaggctgcagtgagctatgatcacaccgctgcactcttgccttattgatggagagagatgctgtctctttgtaaaaaacagaaaaacataacctaccacattgcggtaaactataaatatcctaagagaaaatgcttttcttaaatctggaagccaaagcacaaaagagccagcaaaattttgaagaaaaggttattaaataattataatcacccttttcagtttatttagtcaaatctaattaagtcttattctgctgtatcttggcttggcaattttatgagctcatcagttgctttattagagttgtggaaattcttacccagtccaatggtatgatcttaaagttatcagaaacctttattctgtagcacttttcagagccttttccattagacactttggcctatatcagattgtaaatgctttcagagaagaatcaaagtaaaacaataaattgagaatgacaaaaggcttaaaatcaccataaagatctgatgagagtttatttgctaaggaaatttatttattgctgtggctaatgatattttaacataataattggaattgtgactggtaacattatgccaaacctatcatgaataacatattgacaaatttctatcaactttatataactcctgaaacacttatattaataacatatatctatatacatataacctaaagaagatatagcatcagttcttatttgacagtacttcctctgtaatttaacaaatcaaactaattaacataacatctctcttttacaaggcaagagacaaatcctttgatattttccaggaaccctctgggaactctcaatgttaatttaaagtcaaagatacgttatgtagaatttgatttgggccgggcacagtgcctcatgcctgtaatctcaacactttggaaggccgaggcaggcgaatcacctgaggtcaggagtttgagaccagtctggccaacatgatgaaacctcgtttctatcaaaaatacaaaaattagctgggcatgttagtgcccgcctgtaatcccagctactcgggaggctgaggcaggagaattgcttgaacctgggaggcggagcttgcagtgagctgagattatgccattgtactccagcctgggcagtaagagcgaaactctgtctcaaaaaaaaaaaaaaaaaaaaggaaaaaaaagaatttgatttaatttgggaaagtttgtcaaaaatgtcagaaggttttaaacactagaatcacacatcattataaaacaatacttatatataagtattgtttattactttattacttataaacaaagtaataaaatattttataagcacatatagaagttacatagttgtaaataaaactgagtacttttaacattgaaaggattccgcttttttaagtaatcaaaataactgataaaggtaacatgaaattgttcaaaataactgataaaggtaacatgaaattgttctaacatacaaaaccttgattttctaggcagattacttaaaaactgggggaaaaccctttcacgatatcgttatcaagagcagacaggtaatccaagaaaagtatgtcattttaacagagaacacagaattctaatatggcatgtgttctattaatactaaggctttgtttgtttgttttttgtttttaagagacaaggtctcactctctgttgtccaggctggagtgcagtgtagctatcatagctcactgcagcctcaaactcctgggctcaagtgatcctcccacctcatccttttgagtagctaggactacaaggatatgccgccatgcacagctaatttgcctaatttttgtggagatggggtctcactgtgttgcccagcctggcttgaactcctggcttcaagtgatccccccacctctaatgctcaaattgctgggattacaggagtgagccaccatgcctggccactaaagcttattaaaaaacaacaacaacaaaatacttttgactaaatctgtccaatcttagccaactctaccacacaaaataagatcctgtttccaagattacttttccacaaacctgtagttttaaaaaatatattcagtttttgtcctgttcttttttctctttctctttggcacaaccagtcattcttactttaggacaaagtgacactctttttcccttaacaaacccacatccttcattcttttcctcatcaaaaaacacattctacttcccttgaatactttgcatatagggttttttcctgattagatttttttgtgtgtgtgacagggtctcactctgtcgcccaggcttgattgcagtggcacaatcgtagatcactgtaactttgcactgctgggcttaagcatacctccacaaccaactaattttttaattttttgtaaagagttctctgttgtaaagactcatctacttgtaaagacgagttataaaaagtttataaccttttatgaatataatttataaaagtttataactttataaatataaacttttataaattatatttataaaaggttataaccttttggttataaaaggttaaccttttggttataaccttttataaatattatttatgaaagtttataagttaacgtgctttcatctatttaattcacttttaataattatgcttggattgctcatgaaaatttcatgagacactgctcaaaggtagatattctcttaaattttgttgttgacaaatcagacaagtatctaaaatatcacagaagcaaaaatcctaataaacaaaaaccttgtttttgcctttttaaagtgtatacatcaattcatttttattgtacatttgattcttaggttgcatttatagttttattctcataaatatctggtagagatagcataagtttgtttgatgagtaaacctaagtggaaaacaattatatgtcgtattatgtttaatgctgacaactctgacaacattcctgtttttattttaccaacaatctttaaaccagttttatttaccaaagattatcccagatcacatgaacctaaaataattaggttagttttcatatttttgagagttttaggaatacctagtttatacaagcactgatttttctttacatcaattaaatggagcccttttgtataattttctatctggagatagaaaaatatcacaaatctatgtcatgcatacatacacacacacacacacacacacacacacacacacaaacagattcaaataaagatcttacaggtttcatttgaaaatttctgcaatgagtcaataaaacatagtaatgtgaactcaactggtttatataaaatcttgtcttttcgccagcttatacttttattcaatttgtgattctggcatatgggacaaatcgaggttagctactcaatatgaggaccagtgcttttcaccaatatttggggagggtttttttttaagattttaattgcccttctgataggtaattttttttatttttctttttccacaacaaattcagatcttccaatcataagtagtataatggcagctgtggacaaaacttcagacaagtgactaaggagacatctagcagctgttcagttttctccaaactctgtctgagaaaatacaatacccaatctatttccaattagcctttcttttttatttttcagcagaccccctgaagcccttgagaactgagattcctaaagttcaagttactgaggggctggagtgggaagggaaaatgtctaacaggggtagatagagggatgcaggaggtaggggcttggagagaggaatatcaaggattcaagggatgtgcctttccttcaggtataggtagggtacctcttacatgagagtcttaaaatctgcttcagaggaatgccattaagtccttcctacacgtgatttctcacatgccttcagcttagaatattcagtataccaactgaatattttgtgatagcatgtactgaactcttcattagttaaaagttgctaaagtttaaggaagagagcatttaattctcaccctatcatattaaaaattgtatttgaataccctgaacgtagagaaaaagctgggcccagaactaaaataatatcagggtacctgatattggaattttgaactgaattgtgtctcctccaaatttatatgttgatgcactgattgccagtgtgactgtgtctggtctttaggaggtaattaaggttacatgagatcataaaagtgtggctcttcttatagggccacagtcttaatgcaataggacggtggccttataacaagaatacagactcacctccttctcttcctcatgacaacactgcaagaagatggctgtctttgagccaggaagaaagccctcatcaaaacctggccatgctggcaccctgatattggacttttgttatgtaatccacccagtgtatgtattttattacagcagccctacctgattaacacatctgccaagctgaaatgttggacacctgtcaagtttaaggtgtatgtaattgctttcttcagtcttgatatagataggtctttatttagttctaatctttttttcccttcatatttgttgccctcactggaaaacagtatgttttatgtagcagtaagagccttgtaaataatgtttttcaagtgaggacaggacagatagtgtttttgtttgtttgtttgttttgtttgttttttgacagtgtcttgctctgttgcccagtctggagtgcagtggcacaatctcggctcactgaaacctccgcctcctgggttcaagcaattctcctgcctcagcctcctgagtagctgggattacaggtgcacgccaccacgcctggctaatttttgtatttttcatagagacagggttttaccatgttggtcaagctggtgacagatagttttagttgcccccttcctatgaaaatacagaatactgaatccagtttttgtgtattcaattaaaattccactaatgcttcagcttttttaacaagaaaatatttctgttttgaatgtttaacacagagtcacaagatagtcatgtatgcatgcctggtattgaaaaaatcagtaaaaaactgataacttactgactatccaaattgttactatactttgatgtttgtattgtaccatgatgataaatctggtccttagcatagtaattgttattttcataatctctaaatcagtttcttctgggttctgagatccaaaaagatgaaacaaagactaattgttgactgaaagaaatataagtaacagctactgctaacacattttaaaattagaatgcataaattaacaaatagtgccaaaaagtaaacacttttttgcaaggcaaatcatatgccttatctactcccgttcaaattaataaaaatacactatttataaacatgtactactgtactttccttttagctttatttcagaaaaatgtggaataatttacacttccacctctcaggatgctgtcagcagtagcataatagcaaaagtagaagcattttgaaatttaaaaaaggcagaaattaattaaatttaaaacaaattaaaattaaaatatggtggcattataaagatgtgttctgataaaagtctagtatattttactattttgagaagcaaatcaactcatttatgaatccttttaatatttttctgtatttaattgcatttgctagagcagtcttcttctagggatgtttaagatccctttactattaatagctggaaaatgaatagtcagagtactgattgatgatatgatgattttagactattattattttgcatttatatagcatattgcctcatatgtattcaaatatttcataaaagcagttatcagaataacaaagtctgtatttgcacacaagtattacaaacaatttaaagatacacagattgaccctccctcatctgaaaatctgaaatctgaaattctctaaaatctgaaatttttgagtgctgccatgatgccacaggtgaaaaattgcacacctgacctcatgcagtgaattgcaatcaaaactttatttcaagcacaaaattattttaaaatattgtataaaaatcatctttatgctacgaatataaggtatatatgaaacataaatgaattttgtgtttagactttagtcttatatgatttggctgtgtcccccctcaaatctcatcttgaattgtaactcccacaattcccacatgtcataggaggaacctggtgagacataattgaatcatggtggctggtctctcccatgctgttctagtgaaagtagataagtctcacaagatctgatggtttttaaaacgggaatttccctgcacaagctcactcttggcctgctgccatcttagtaagacgtgacttgctcctccatgccttctaccatgattgtgaggcctccccagccacgtggaactcttaagtccattaaatctctttcttttgtaaattgcccagtctcaggtatgtctttatcaacagcatgaaaatggactaatgcagtaaattggtaccagtagtgtggggtgctgctgaaaagatacccaaaaatgtggaagtgactttggaactgggtaacaggcagaggttggaacagtttggagggctcagaagaagacaggaaaatgtgggaaagtttggaagtccctagagactcgttgagtggctttcaccaaaatactgataatgatatggacaatgaaatccagactgagttggtctcagatggagatgaagtacttgttgggaactggagaaaaggtgacacttgttatgttttagcaaagagacttgcccctgccctagagatttgtggaactttgaacttgagaaagatgattagggtatctggcacaattgatttctaaacagtaaagcattcaagaggtgacttgggtgctgttaaaggcattcagttttaaaagggaaacagaacataaaagtttggaaaatttatagcctgacaatgcgatagaaaagaaaatcccattttctgaggagaaattcaagctggctgcagatacatgcataagtaataaggagccaaatgttaatccccaatacaatggggaaaatgtcaccagggcatgtaggaggtcttcgaggcagcccctttcatcacaggcccagaggcataggaggaaaaatggtttcacgggctaggcccatggtccctgtattgtgtgcagtctagggacttggtgccctgtgttccaaccactttagccatggctaacaggggccaaggtaaagcttgggatgtggcttcagagggtgcaagccccaagccttggcagcttctacatgatgttgagcctgcgagtgcacagaagtcaagaattggggtttgggaacctctgcctagatttcagaggatggatggaaatgcctggatgtccaagcagaagtttgctgcaggggtggggctctcatggagaatctctgctagggcagtgcagaagagaaatgaggggttggagcccccacacagagtccctactggggcacggcctagtggagctgtgagaagaggatcattgtcctccagacttcagaatagtagatccactgatagcttatactgtgcacctggaaaagcagtgcacactcaatgccagcccatggcagcagccaggagggaggctgtaccctgcaaagccacagggtcggagctacccaagaccataggaacccaccttttgcatcagcattacctgaatgtgagacctggagtcaaaggagatcatttgatttgacgtaagatttgactgccttgctggctttcagacttgcgtgggggctttagcccctttgttttggccaatttctcccatttgtaagggctgtatttacctgtaccctcattgtatctaggaagtaactaaattgcttttgattttactggctcataggtaaaagggacttgccttatctcagatgagactttgggctgtgaacttttgagttaatgctgaagtgagttaagactttgggtgactgttgggaaggcatgattagttttgaaatgtgaggacatgagatttaggaggggtcggggtggaatgatatggtttggctgtgtccccacccagatctcatcttgaattttaactccctcaattcccacatattgtgggaggaacctggtgggaggtaattgaataatggggttgagtctttccaatgctgttcttgtgatagtgaataagtctcagctgatctgatggttttaaaaacaggagtttccctgcacaggctctctcttggcctgctcccatccacatataaaacatggcttgctcctccttgccttccaccatgattgtgaggcctccccagccacatcaaactgtaagtccattaaacctctttattttgtaaattgccctgtctcgggtatgtctttatcagcagcgtgaaaatggactaatacatatccccaggatatctcattatatatgtatgcatatattccaaaatccaaaaaaagttgaaatttggaaaaacttctagtccaaagtatttcagataagggatgttcaccctctgtctgtccaaaaatcatgaacgaagatctagtttgtgtgtagaaagttgcagtttcaccctaaaaagcaaaacaagctggataagtcatataattcaaagattatataatcaaaattttggttatagcgatctacgagtagttgcctgaggtagagggaatttactagaaagggaaatttgagatctttcttggatgatggaaatagtctatatgttgcttgggtggcagtttcacaattacataaaattgtcaaaatccatcaaacataacatcagagatcattattttttgtatatatattaacttgatatgaaaatctgaatgtggtttaatatgattcaatttgcatttaatttaaaatagattaatttagcaacagtagcaacagtgaaggtggaatacgttgaaaataaaggttatgacttttgtgggcactgatagtcaatgggttgtcagaaagaagagtagtaattcccattttttgtgtggaaccatggatactggtagaaaattttttcagttacactagttctgatctgatctcccactatgattgtataaagcagtgaaaactcatttaatattcttccaggactttcatttatcaatgcctaccaggcagtgataatcaggatagccatatgctttgtctactcttggttaaattaatggaaacaacaacaactttatataatatggtaactatactgtattgtggtagtcaaagttagattcatttagcttgctgcaatgcatagggaggctgtgcaaggagctaaggtattttggtacaagaagttactaggaattcatcataggattcagggttgtgcttaaacgtggtttccgtggactcagtgtccttagagtctgctaggctccatgtgggttcttccttttgtgtcagcctccaggaaactcactcaagcctttgaaaatcaggctcacctatttgtttcctgtctctctggaatcactatctttactcttgagtttaatcgtttgaataccaagctgttgatatatatatcttctgacttttttaggtgttttagaaaatagggaaaatccagtatctttattccttcttggtcagaaataaaagttctcatattttttttactaaaatgttggggtagggtgatatgtggatagacaaaaaagttaatatgccagtgcttatttgtaaaacataaagcttaaatgaagaaaagtaatattaaaatagttatacatcgttttttaaacactatgttcaaggcatcttgatctgtggaattatgtattttagctaagttgtactaaatagtactgattcagatatacaaatcataatacttatcagctaattgaaagctccttgagaggaatatttaatggtttaattttgaacatactacatattttaagtatcaaatgttcagtaaatatatatgtggaatacatgttttctgtgtcagacactgatatggtttggctctgtgcccctacctaaatcttacctcaaattgtaatccccatgtgtcaagggaaggacctgtaatcttcatgtgtcaagggatggaggtgattggataatgtgggtggtttcccatgctgttctcgtgatagtgagttctcacgagatctgatggtttgataaggcagttttgcctgctcttgctggctctctcttgcctaccgccatgtaagacatgccagcttccccttctgccatgattttaagtttcttgaggcctccccagccacatggacatgtgagtcaattaaacctcttttctttataaattacccagtcttgggtagttctttatagcagtgtgagaacagactaatacagtaaactggtaaagtggtgagtgaggtactgctatagagatacccaaaaaggtggttgtgactttggaactgggtaacaggcagggattggaatagtttgtagggctcaaaagaagacaggaaaatgtgggaaagtttggaacttcccggagacttgctgaatggtttttactaaaatgctgacaatgaggtggccaatgaagtccaggctgaggtgatctcagatggagatgaggaacttcttggtaactggagcaaaggtcactcctgccttgctttagcaaagagactagtggcattttgcccctgccctagaaatctgtggaactttgaacttgagggagatgatctgaaattggaacttatgtttaaaagggaagcagagcataaaagtttggaaaatttgcagcctgacaatgtgatagaaaagaaaaatcaattttatggggagaaattgaagcccattgtagaaattttcataagtaatgaggagtggaatgtgaatagccaagacagtggggaaaaatgtcaccagggcatgtcagagatcttggtggccacccctcccatcacaggcccagtggcctaggaagaaaaaatggtttcgtgggctgggccctgagcccctctgctctgtgcagccttgggacatggtgccttgtgttccagctgcttcagctccagccatggctaaaaggggccaaggtacagtttggtccattgcttcagagggtgcaagccccaagccttagtggcttccatgtggtgttgggcctgagggtgcacagaagtcaagaattgagttttaggaacctccacctagatttcagaggatgtatggaaacacctggatgtccaggcagaagtcgggtttaggggcagagccctcacagagaacttgtacaagggcagtgcagaagggaaatgtggctttggagcccccacacagagtccccactggggcactgcctagtggagctatgtgagaagaggaccaccaccctccagaccccagaatggtagaacactgacaaccagtaccatgagcctagaaaagccacaggtactcaatgccagcccattcaccaaagctgcccaaggctgtgggagcccacccattgcatcagcgtaccctggatatgagacttggagtcagaggagataagctttcaaattgagtgactgccccaatggatttagaacttgcatggggcctgtagcccctttgttttggccagtttctcccatttagaatcggtgtagttaccaaatgcctgtgccaccattgtaacttaaaagtaactagcttgggtcctttttgagatgcagtgttgctctttcgcccaggctggagtgcaatggcacaatctcgactcactgcaacctccgcctccccggttcaagcgattcttctgcctcagcctcccatgtagctggtactacaggcacgcactaccacacctggctaatttttgtatttttagtagagacggggattcaccacattggccaggctgctcttgaactcctgacctcgtgatccacccccctcggcctcccaaattgctggggttacaggaatgagccaccgcatctggccttgttttttattttacctgcttataggcagaagggacttgcctgtctcagatgacactttggactgtagacttttgaattaatgctgaaatgagttaagactttgggggactgttgggaaggcatgattggttttgaaatgtgaaaagagatgagatttgggtgaggccaggggtggaatgatacagttcggctctgggtccccacccatatcacatcttgaattgtgatccccatgagtcaagggagggagctgtaatctccatgtgtccagggaaggagatgattggatcatgggggcagttttcctcatgctattcagtaataatcagtgagttctcatgagatctgatggtttaaggcagttttccctgcttgtgctaggtctctcttgcttgtcgccacataagacatgcctgcctccccctccaccatgattgtaagtttcctgaggcttccccaaccatgcggaaatgtgagttaattaaacctctttttttttttttgtaaattaccctgtctcaagtatatctttataacagtctgaaaacagactaatacagacacctagcatttcttattagaattcataatatttattccttccctgagcttaagagccattttcaggtaagatgagaactaacatctatttatataaatccaataaaatatatgaattttgattacaaatgctaattttcactcagttttaagcttctatttcttatgctagtttctcttcattatgttgctatagatctactgattatccactttatgtctttctaaatattcctttatttactgatatattaaaatttttgaacaattaactttatttatcaaagactaacataattcctgatctcttggtagttaagtggggaaggcacatatctatcaaataagcactctaatttgtatataattaaggctgaaataactataccagaattaaggataaagttttgtaaagactgaaataatctattaagtctcatgcacagaagagacatagttcaggaggtattttggatgaaaattgccaaagatattgtagctgaatcccaaacctgagaaatattcttggttttttagtatttttccttcatcaccaccgccattgccaccatccctcttcagtctagtccattaccaaatcccattagctccttctccaaaataacatcaaatccaactatattatctattctaccatcaccctggtttaagccaacatcatctctaacttgaacttgcagtatttctaaatatctgtttccattcctgtcatcctttaatccattctctatatagcagccagagaaaccttttattaaccgtaaatcagaccatgacatttttcttcttaaaaccttggtggctctctataacattcagaatgaagtccagtttattcaggataggctactagaccctggttcctgaccttctctccaatctcatctcatcaccattttattatttatttatttttctcctcactctcttcctacaagctatgctggctgccttttcattgcaagaataaaccaagctccatactattttggtgcctttcagtttttgctgtcctgtacctagaatgtttttctccagttttttacttatttggctcatcgatgttaaaatcagatcacctcttcagataggccttctccaataaccttgtctaaagtgacctcaagttattgtattaacttattttctccctcatttaattttatctccttaagttctgtgaaagctatgaattcattccatttatctttgttgtagctatctttgttggcacttaggtgctcagtaaaaatactttttatgtggatatttccccagtcttcttagtaaagtctgaactataatgaaggatcataatcatagcaaacatttatgtagtctccatataaattaataattgacagttgatgatttctgaaaaccataatccgtattcactcagtaagtgagtattttatattatagctgaaaatagcttacttttaaaggtataaagtaaaggataaggactcatacacacttataaagtctaaagttgttaattcagttcaacagataatttacatttaatactgaaattcactatttactatgttcagtgttgtgttaggcaagctgtctagcttaaaggacactaatgttcaacatgaattctaaatggagtaagtaattggagatctggtatagaaattgagtgaaatgcattattaaaatccatgaaaaccaacaagtcttagtagttattctttacaaaagccataattaagacccacacctcccaaactgtgcaccagggtaccccagactgccatagaaaactcttagggataccataggctttttttaaattttgagggaaaccagcaacatctgtcagatactatgtaaagtactatctcaaggtagttcgcagtttcagtgttagattgtacctttgatgatgtcacatctttatgaagctgggttttgcacagttaactgtgagaaaaagcaagtactacaggaaaattattgtggaagaggaaaggagggcaacagtatccaatatgattcaaaggtttaggatatgtacagggcccaatagttgtacccatcccattagtaagtaattgtagttactattaataattatttaaaattaatatgtttttactttcaatttgtatctattatttaacagctactaatttgttaggatataaaacttaagttgtttggaccttactacttaataaacagaactattagatacttcttttactgggtgccatgaaaacattattgagacacccagagcaccttgaactgagaaagtttgagaacttctgatatagccaaattttattttattttatttttatgattcaaatatcattttattgttaatagcatctttctggagatctggtcttcaacagactctctagaagaaatttatgtttatgataagtgggagactatactatagaagcatagagaaagagaaataatatttactgggtacctactatgttatagacattatttttatttcttgtttaatacttatagcaatcttaagatatataatgatgatcttcccattttatagacagggaaccaaaggtcaaaaaaattagatattttgctaggttacacagctaactggatggtgcctgaagaagctaaaggctttttatggcaatgactaatgtattattttcaacttaagaaagttagttggatggagtgacaaaggaacaaagatctactatattgtggattttattactgtaaataaacactgaaggttacttttttttttaaattcttagtccctattattcatgcaagtttttcatgtcatttgctggatcattaaatttgagtatatttggtagtcttatttccataatagagaatcagtgaagattgttttagtgtttcacatagttaaaattgtattttggtcacctacaacttgataatctatagaagttaagtactaccgagttagattttcattgaattttttattttaactgttttctttcttttttttttctttttttttttttgagatggagttttgctcttgttgcccgggctggagtgcagtggtgcaatctcggctcactgcagcttccgcctcctgggttcaagtgattctcctgcctcagcctcctgagtagctgggattacaggtgagcaccaccacacccagctaattttttgtatttttagtacagacggggtttcatcatgttgtacaggctgatgataacctgaactcctgacctcaggttatccacccgcctcggcctcctaaagtgcagggattacatacgtgagccactgtgcctggcctattttgactgttttcttgcctgtgtgccttgtaattataaagaaatttctggaacccatacaaagatattttctatttgcacttcattttctgttagcctcttctgaaacttctgcagtgttttgaattatctcaaccattctccacatctcttaacctctgtttcttattttctttctttttatctctctttgctgaattctatatcacttcttgagacctgtcttccagtttatgaattttcctttcatctgtatctgatctcctacagtcttctgagtttgtttctccagtcctaaaattattatatgtttcattcatgggaaccctggttggttattttcaaatctgcctagtaagttttcttacattttgtacttttctaggcatattaaacatattaatgttttctaataattctaatatttacagtatttttaggtctggttctgtagttcgtcgtttctacatatactttttgtggtagtatcccctttcccttccccttcctcttcctgttctcccttcctctttctttttccccttccctttcccctctttcgggcttttgagtgaatggagttcattccttcatggagaaatttgattctcccatgcacatgggatactgtcaatgtgaaaccactttcaattttggggtggtgtggattcaggccataaccctgcacaaatgtggatttgtggttattaattctcagggaagcccctttttctttttttttcttttcatattctacccaatccaaggtagacaggcatgtatctctttcaactccctttttggagttttggttgtttttcttagtttatccttttgggtgttactgactgcatctgaattttatgtgatatgacttcacatccatattgaactctgaaagcctggcttttaagcactgggctctttaataccaaggctgtaggccacacatcagcagataccaccagagtccagcaaatactggccccagaactctttccttttctggatttatgattcttttttgcttacagcctttatgaattcttttagtttccaaccagccaaccgtgtgcttaaataagtctttaaaaatgtgtattatattcacactttttagatgtggtatgctagaagtgaccttaactgaatatgttggtctgctatagtacaaaaaaaagcaattcattaaatattttgaatgacagcacaggattctgtgctgactcaagttagagcaagttacacactttagaactcttctctgaatttgctgtcactttacccaaaagtagaattagaactctttggctgccctcaccatagccaagtgactcctaatcctccagggaacatgtaaaatggtaaaatttgcctgaaaaatacagctgactttcataagactacagcaaattttgaaaggtacattggagcagtagtagtgataggaaaccaattgttaggctttctatattcattcttgaacggttaccccaaaagagtatcctaaaattcaagttaaaaattaaaacactgttaatttaaaactgtcttttctgtttcagtttaaaatgttaaatcaaaacagactttcttcttaccctaaaatagttacataagaacagtctgttgtcacagaagtcattctattataaagttactttattataaagggtatagtctctatttaaaatgttaagctacaaatatttatccttttgagccatctgtactgctaaatacccataagtattttagactaagatctgaaaaatggaaatactttaaaacctttgcattgttgattcttgattttttttatggcgtgtgtcttgctttgagcagaaatagattgatgcagacagcttacttgtaaaacattatgttactgtcatttaaaaaaatagttttaaaccctctgatggaaaggggcatctttagatgaagtaatttcattaaaatatccaattcagaatctaagtaaataaacttaaatatataaaaattcttcacttaatgtatttattcccataataaatatgttaatttcataaatttagagctctgttaggtgaatttattttattattttaaatcattaccttagctaacccagaaagtttctattgagaatgtttgttccccactttctcctcatgaaatcattttaatactgtataataccaggaaattgattaatgtcattaatcaactattattatggatatatattttattggatgcttatttcatatttcctttttgggtggcgttctattgaaacatgtgagaaaatattagtaacttgtctactctgcttacccccatcttatataaaccccatttccagaggactggaaactggaaagaagaatacctcagggctgaacatgacaggggcttaagaaaagtatctgagaaattataaccaaaaactgagcctagaatgaatttgcaattcaaattcatattgtctgcactgtataaaaaaatttacattttttcttacagcttttttttttttttttgagacagagtctcgctctgtcacccaggctggagtgcagtggcacaatctcggcgtactgcaagctctgcctcccaggttcatgccattctcctgcctcagcctcccgagtagctaggacaacaggcacccgccaccacgcccggctaattttttgtatttttagtaaagatggggtttcactgtgttagccagaatggtctcgatctcctgacctcgtgatctgcccgcctcagcctcccaaagtgctgggattacaggcgtgagccaccacccccggcccctgcttttttttttttttttttaaacaaaaccatcaatggaaggaaaaacactttaagtgtatgaatttagtttaaagtagtctatgatggatagtgcgttcggacaactgaccaaaacaaatgcagattctctggtgaattcactttgtcctaaaattcaaagaaataccatacattatttaccactgaacacgaaaagctacaaggaaatgaagtactatgaataagaatcatcagaaacactaagcagctgaatcaaccctacatagacattaaatattggaatgattggatatagagtaaaaaacaactatgcttacttaatatgttaaacaaaataaaactaaaaagcaaaagcctaaaaaaaatcaatagggaacagcaaactgtaaaaatgtcctagcaaatttggaaaataatcaattagaaattctagaattggaaacaaataatctaaatttaaaatcacatggagtataacagcagaacagatacaattgaagagagaaatagcaaagtgaataataggctaaaagaaattattgagaatttatcacaaagagcaaaaattcaaaaacaagaaagaggttcaaaactacactgtttcatgcacactggtgtatttatgatatatctcacaaaaatgtctaaaatataatcaaatatatggtcaaatatgctcattcatctttagagctttctataagaagaaaacaaaaggaaaaacattatgtgcaacagtaggggaaggatcagagagttaatagttcatccattacaaattatgttactataaatacttaacgtcatgagggaaatatttaccttaagagtattacatttatacattgatctcaaattcaaagaatagtaagatatgttatttatttaacgatacatataaaaagaaagaatatcttatttaatagtagagcttacttctgaatactagggatacaggtactttaaaattttctttgtaggctctttgtatttcccagttgttttaaactgaacatttagtacttaaaaaaaaaaaaagccagaaagctgctaataagtattaaaaagtggtacttagtgatgtattctagaacttttctgtgctatatctgtgcttttcctgtggtaagtgcttatcatatttttaaaatgactgatatttggctcttatagattcttaatgtatatttaaatgaagtggatgaataataaaagttagtggaaaatttataaagagtaaggccttgaatatttgcaacacactgaactgttgattactggggatttaagctgagagtcttcatttaggtgcaatttagtaagtgtcttagttccttttgtgctgttataacagaataccagagattaggtaatttataaagaaaaaatttatttcttacagttctggaaagccgggaagtccagtatcaaggtgctagcatctggtgagggccttcttgtggcatctcatggcagaaggaagaagggcaagagagcatgtgtgtgagagaggaagaaattaaacttgcagcttcaagcccttttataattgacattaatccattcatgagggtggagtcctcatgtcctaaacacatcccatcaggtcccagctcccaacattagggattcagtttccaacacatgctttttggggaacacattcaaactatagcagtaagcaactttgaagacgttcttgatttgcttattcaatatgtgtaagatctagcaatatttatgagataaatataatatgcaaataattttgttttaatttattcatatgataaatatttattgaatgtcttttgtgtgctacacgttgcactagattttggagatgacttgtgaaaccatatacagtctttgatgagatttagagcatagtagaggatatatatgtatgtatgttacatgcatatatgatttattcaggagtataaggcaattcaatattaggaagtccattaatataaaaggttgggggaaatgtggagagtaataccagagacaaacaactataaaagacatgtaagttgttgtctttgggcagaatcactatgaaatgatggttggataggtggcagctgttgttacatcatatatattttatcactgtcttatgttttcaagtttgtacatatgttactttactaaaaataaaagttaattttctagctgacatcaaattatttcttcctctcaagtcctttgtagctactgtcaccagcagaatatcccatagcctccttctaatatctcctcaccctggcagcctctgatacagggataaagtcctttgagttggctttggctcagttaccttcagtattgtccaattgattcatgataaaaacccgttgtctttatcatgctaaatgaccaaagtgtaaacttccaccttactgtcctttctccttgccttgctatcttcattggttccagtgagtctttcttttttagtcctcttgagcaaaaacaagcttttccacaattccaagggatacatgtcaaacgctcagaatgctttattgaacgctcttccttgacaccatctccctaaaaatgtcaaaacactctaacaacacttttccaaaaggaactcttttgccttgttagatttcaacattcttatatcccccagggtggtgtcacaagtgtcaaaaacagttttgagtctcattgtttacagttccttcatagacaatataataaatacctcactttggccttaacattctgatacatgttaattgttacactattttatccattataaagcataccacaaaattagaaactaaagagaattagattttttatgtatatatatatgatatcttcttttaatggataattatgcacattcctagtatgtgtgcagtttgatttggagaccattatattgaagattccgtcctgtttgggcaggattgcatatgcccctgagcctatatagctcttgttatagaaatttattgtgttgatttttttcactgttcaatatcccacccccatagtagaattgatttttagaagaaacggtgacagtttttagcagccatgatggtggcctagggttgaagaaatatgtgatgtattgttagagtccaagccatgctgttctattaaaatactatttttcttcctgctctttttgaagttgattttatttctgcttattttctaagcctgaatttctggccttcatttgtttttgttcttcttgtttttgtttttgttttgttttgtttttgagacggagtctcgctctgtcacccaggctggagtgcagtggcgcgatctctgcttactgcaagcccggccttctgggttcacgccattctcctgcctcagcctcccgagtagttgggaccacaggcgcacaccgccatgcttggctaatttttttttgtatttttagtagagacggggtttcaccatgttagccaggatgcatttctttttttttaatacttaagtttctttttcttgtttaagaaagttggagttaggactgttgttcattcacaacaaattgacaccactgccttaatatcataaagactctgtattgtttcagttgtttgctcattgggaaaatactccagggtgaggcctcccttacatctgagggacctgattccctgtgtagagagttctttttttttttaattgttccagtttatacttctggtagacttttaatcttcccccccactttaaagtcccagtatgccccactataaattgaaacattgtgttctagtctttatctacaaacttagagaaaattaattacttttcaaggtaacatattcaattttattttcttttttcttagatcactccagtatatccagcaaactcccttaaactaagcccaaactggtgttgttgcctgttgcaatttccttcactagagcatccagaaaagcttacttgcctttgcatataaaatctcttactttgggaggccgaggcgggcggatcacgaggtgaggagatcgagaccatcctggctaacacggtgaagccccttctctagtaaaaaaaaatacaaaaaaaattagccaggcgtggtggctggtgcctgcagtcccagctacttgggaggctgaggcgggagaatggcgtggaaacgggaggcggtgcttgcagtgagcggagatcgcgccactgcactccagcctggacgacagagcgagactccatctcaaaaaacaacaacaacaacaaaaaaactctttaattgctttaaaacagctaaccaagtcttatttcctttatcttcttgtatttttcttatattaccttggcaaaatgaaaaatttggggatttagtgtttgccaagtcaccatatggataaatcaccactagtgaagaataaactatatccatattatgttactttaaatgaaacgattacatttcatcattaccctcagaattaaacctgttatttacactactacttctcatcctttcttctaataggctccaagctttctcctttttcatctttcatctatcccaataaaaacataacttccaattttaattagaatagctatatataataggttgaccaactgtgtatcttctgtagccttctgcctataacctgattataaaattgctttaactaaagtaagttactgcctattctgagttactctattacacaaaatttaattttattacgctactttcttttccatattattttcctcctagcctcttccaattctttgtcttcttgatctcccttattaatccttttctcagggaaggaagatctgatcagccaattcactccaagatttaagtgactagtggttggaaatctgttcctcttcagcattacctgtaatttaaacaaggaattaagttgtattggctttggtgaggcacaacgtgtgtttgtatatgagaatgagttctttatagcacccattcagtcacacaaggctacctacttgtaagtctaatgtttagagtaaacagtgaattatctaatacattttgcatttcttacaccttgaaagaatgttgataaatttccttatacaagtagtctgatctgatgttagacaaatagtgaatactcagttttattgattaattgagtgcattttcagaatactgaaagattaggaattgtggttgactgagcattttgttaagatgttattagagacaaatacaaaaaaattctggctctctggattggactctgtgtagattgattccatctgtaaaaggtgcctcatctttgacagtagatattttagtcactgttacttgttagagattcaatatagcaatgcaatttttttttatttacttataaggatttatgataccaagttgtatttgacatttggattaaatcctgaggggtaaggaagattcgtccctgtggtagaagtttctaaagtcttaagtcaaatgaattctacttacactttagttagaaggccatttaagacaaacgtgccttaaaagatcaagtttttcagtgttaaaattctacatctcaatataggttatgaatactacattaagttcatttggttatgaattcattattttcaccttttgctgctattgttatacttcaactctcttatttttacaactttttattttgaaaactttcaaactttaaaaaaatgttgggacaacagtataatgaacagctgcactctgcacacctagattctcatgattgagaatacatgctgtatctatttatatctctgtcttgccttctctctatatataacttaaaaactgtttcagacatagtgacactttacccctgaatacttcagcatgtttccctaaaattaaggacattgttcaccgtactcttatcatatgctggaaatgttaacattgagacaataatatcataaaatataacatacaaacctatttttagatttctccaattatctcaaaatattatttatagattttttgattcagtattctgtgagggattataaatgataatttgatagtgatatgtcttcaccattttgttatatattgtcagaaatttgatgtagaataattcatatgttagcaactgtggaaagtgttgccaattatgaaaaaaatgtaaatttagataatttagaaatagtccactaagacttttattatatagttgattatattaattaaagtaacttgaattccttgacagtttacttatgtataatgagtgttcatgatgccctaattgaatttttatttttttaaaatttaatttttaaaaataataataatacagtaaaaaaccctttgtgatctttcttaatagtcacatcatcactctaccctgcctatcacagatctgttttacatcactatagtttgtgtttttaagaatgtcaaataaatagaatcagaaagtatgaccagcttctctcagagtagagtctctgagatatatccaagttgtgtatgtcaataatttattcatttttatggtagatagtattccattgtacatatataccatagtttgtttatctactaacccattgaaagacatttgggttgcttccagcttttggctgtcacaaataaatctactgttaatatttgtatataagttttggtatgaacataagttttcatttctctataaatacccagatgtacaattgctggctcatatgataaatgtatacttaacattataaaaacccgccaaactgttttccaacatctgcatcatttcagtattaggctcaatcaattgtcttatcccatgtgaatttgtatcctgtattactttataagactctgagtcttatttagatcctgtggaaaatattgatatttttgttttggccttctgtggattgtgtggttctaaccttggctctattttacaagactttggtgtgcaatttggatctgtcatgaatgtgtaccctctagtggtcactctgggaccagcttgtagatctgttcttagctaaggcctttaaatatttgatatgctaattagtatcaaatccataaatgggcagatccagggtgagtaaaagttcaaaacaactttatgtagttgctttcctggtctcccttccctaagtactttctacttcccttggggctgttttttttgttattgttgttcttcaaaaaagaaattgtttctttctgcagttttacgacatcctcacaccatttagcactggtgataagatgccaccaaggctacatggtgggaagacagggacatagggaaaaaattctacagggtttggtgctgcccttttggcattgctgcttctctgaaaggtaggtcgacctccctcagagttttgactcctgcagtctctcatttctgtcttcttttattttagctgccatgggactgttcagggtttggggcatagaaaaatgaggaagaggagagggggaaacaaaataacctggagatttctcctactctttctctgtctgcactgtaagtgttcagaaaatttctcctggacctcactcacaccacatagtgctcagttctgggtttctggcttcagaggtagtggaggaaaataaatgttaaactcaacattggtattcttccctcatctgtctactagtgttaacttttcagagttttcagataagtctctagccaggttttttagttgaattagcatgagataaagagagtctggtcttatttcatcttactggaatcaggacccctaattgatttttaaatggtattgttgatacaattgtcaggccatttatttcagtatttcactaagtaacttctaaactgtgaaaaaagtaattataaaataaacatcaggtatttttgttcttatttgtatctttgacatgagataaagtttgtggaagatttaacaagaacatcataagaagttgactataaattagatgttaattcattaatttattcactccacagaaattaaacgagtactgactcttggcctgggattgcagatattataatgaacaagataggcagagctccttctcaggacgggttaatagatttgagacagtcatttatagtacattgtaaaaaaaaaaaacaaaactgccccagagttaatgttaaaaattgttttattattttttctttaagataaaacttttaaggggtcaggactctggtaatgttgaatgtacattaatgcatttatgtatggacatagctgaggattttgttaaaatgtgccttaaatgattacataaattaaataagcaatttgttcagcaggttaaaaggaagatatttcatatttttgtaaatgaacacatgaaattttttcctttaagattttaaatgccaaattatttacttaggtagtgaactatagtgttaacattaaataaaaagagatctacatatctactcctatttctgtattaataaactgtgatgatgtatcaataagtaggatcatgtgccattaggacttgaaataatggaatatggtacgtcctaaagcttattttgtcattcatctagccaataatattaattacttaatatcactgctcaagctatcatctttgagaaatactgatttaacaatagtttacactaaatatgtaaaaaataattttaaagtcaagcaaaccataggttaattaccccattacttgagaatgcaaaaaaaatacttttactatagtacttattaataaactcatttttaaatttaaattgcaaaagttatcacaggctttctatggtatatggaattataataacatacttttaattgatgtttgttggaattcacagcatttatagactttttaaatagactttattttttggcagttttaggttcatagcaaaattgagcagacagctcagagattttcccatataccccctgcacccttacatgcatagcctcccccattatcaacattctttaccagagtggtatatttgttgccattgaagctacattgacgtatcattattacccgatccatactttatagtaggattcactgttggtgttgtatattccatgggtgtggacaaatgtattatggcaccattatacaggttgaatatcccttatccaaaatgtttgagaccaaattgtttctgattttggattttggaatatgtgtatatatgtagtgagagatattagagatgggacccaaatctaaacattaaatttatttatgtttcatctacacatggcctcaaggtaattttatccaatattttaaataattttaggcatgaagcaaagtttgcctaaaacgaactataagaaagcaaagatgtcaagtgtggaattttccacttgtagtgtcatgttggtgcttaaagtttttcaggttttggagcatttcagatttcagattttcagcttcagaatactcaaactgtagtataatctagagtagttccactgccctaaaaatcctctgtattctacctattcatccctttctcctcacaagccaccagcaaccatggatatttttaatgtctctatagttttgctttttccaaaatgtcatatagttggattcttatagtgtgtgtccttttcagataggcttcttttagttagtaatatgtgtttaagtttcctccatgtcttttcatggtttgatagcttatttctttttaccattgagcaaaaagaaatgagttgtttatcatccactcacctactgaaggacatcttcgttgtttacaagttttggccattatgaataaagtctgtataaatatccacatacaggcttttgtgtggacatagttttcaattcctttgagtaaataccatggattatgattgctgcatcatgtggtacagtgtgtttagttttgtaagaaaccaccagactgtcttccaaagtagctataccattttgcattctcaccagcaataaatgagacttcttgttgtttcacattcttgccagcctttggtattatcagtgttctgaatattgaacattctaataggcttatagtcatatctccttgttttattaatttgcattttactgatgatatatgatgtggagtatcttttcacattattatttgtcatctgtgtatcttctttggtgatgtgtttgttaaggtccttggctcatttttcaatagagttgttcattttcttattgttgagttttaaaatctctttgtatattttgtataacaattcattatcagatttgccatttgaaaatattttcttccagtctgtggcttgtcttttcgttcccttcacagtgccttttacaaagcagggttttttttttaatttttaatttttgtgagcatatagtaggtctgtgtatttgtaggattcatgagatatttagatataggcatacaatgcgtaattgtcacatcagggtaaatggagtatccatcacctcatgcatttatcctttctttgtgttacaaacaatccatttatactcttttagttatttttatatgtacaataaattactgttgactatagtcacccagttttgctgtcaacagagttgttaattttaatgaaatctaacctactgtttctttcttccaaggatgttgcctttgctgtcatatctaaaaagttattaccaacccaaggtcatctaaatattcttctattctaggagttttatatttttatgttttacatttaggtctgattcattttgaattaatttttgtgaaggctgtcaggtctgtgtttagattcattttttttgcacatcatgtcttttaagattctgagttctttcggaagacattccttggctgggattccaattttggctctgcaaggacatatcactactctcatactaaaaatcagacttataattgtagtctctgttttccaagtcaggaaataaggaaaggaccaggacaccagtagtagccatggtcttaaggctccaaaaagatgtagagaggaaaatacataaatacattaacttagtggaggtgagggaggaggatgaccttggtgccccctcacttttttaagcacaggtaaagttgattcataataatgtcaacatgtacttctttaattttttggtagcaggaaaaaggtaaattaaagcttaccaatgttttgtaaaattctaagtatcactggccctcttgtattttatcaatgctgaaaatgtgatgcttgaatccaaaaacaaatgaaatcaaggtttgattaaaccggttctaagacttcattactttgctacttctgacttactgccacatattactattactcctaattgtactaggttgctttggtttggattccagcaaacgaggtaagttggcacaagtgacctaaaaataaagtttttgtactgctgggatatcatttggctggttttctaattttgttgggcttggatcagaattaattatgtgttattttcatatcaatgtcaagtctgtatttatagcattctttttttttagaagtcacagaatttttaaaagtagcagaaaaacaataaatgatattgaaaaaattttagtacttacattttcgtcatgatcttctaaagcctcctaaaagaaacattgctcttgtgaatggtgctgcagtgaacctacacattcacgtgtctttataatagaatgatttatattactttggatatatacccaataatgggattgctgggttgaatggtatttctgtctccacgtctttgtggaatcaccacactgtctttcagaatggttgaaccaattatattcccactaacagtctataagcattctgttttctctgcaacctcaccagcatctgttatttttggactttttaatagccattctgatggctatgagatgatatttcattgtggtttttatttgcatttctccaatgatcagtgatgttgagcttttgtttatatgcttgttggctgcatgtatgtcttcttttgagaagtgtctgttcatgtcgtttgcccacttattaatggggttgtttggatttttcttttaaatttgtttaagttccttatagatgctggatactagacttttgtcagatgcatagtttgcaaaaattttctcccgttctgtaggttgtctgtttattctgttgatagtttcttttgctgtgcagaaactctccatttgtagagccctgcaggatagatttagcataattcttgaagaccctagtattttcagaatggtcaatgagcattggcttcaacttaaagtcactagctgcactagtccctaccaagagagtcaacctgtcctgtgaagctttgaagccaggcattgacttttcctctctctatgtgaaagtcctagatggtatcttcttccagtatttaaggttgtcttatctacattgaaattctgttatatagaatagccaccttcatcaatgatcttagctagatcttctggataacttactgcagcttctacactagcacttgctgctttacctcgtatgtttttgttacagatatagcttcttaaacctcatgaagcaacttctgctagcttccaacttttcttctgcagtttcctcacctctctcagccttcatagaatcgaagagaattagggccttgttctgaattaggctttggcttaaggaaatgttgtggcttctatcaagaccactcagactttctccatattagcaataaggctttctctctcttgtcatttgtgtattcactggagtagcacttttaatttttttcaaaaactttccctttgtatgcactacttggctttttgccataagagaaggttatctcagcttttgacatgctttcttctctagcttattcatttctagcttttgatttaaagtgagagatatgtgactcttcctttcacttgaatagaaaccactgtagggttattaattggcctaacgatgttgtttctcaaggaataaggagacccaagaagagggagagagacaggaaaatggccagctggtcgagcagtcagaacacacacatttactgattaagtcccctgtcttatatgggctcaattgatgttgactccaaacaattacaagagtaatatcaaaggttaattattacagtttacaatagcagacatgatattaatgaaaaagttttaaatactacgagaattactaaaacgtgacacagacgtgaagtgagcacatgcacttggaaaaatggccccagcagacttccttgacatgggttgccagaaaccttcaggttgtgaaaagcacaataaagcgaagcacaataaaaaaatgtgtttcttaaacaacaagactataatggacaagaaagagctgagactagagacaggagaccaacatgttaatcttaagtcaggaatcctaaagtgaagcaataggagtggttaaaaaaaaaaaaaaaagagaagagagattgatttaataaataattgtaatatagaattagtagcattgaatcctgatacacccacagaaaatatatacaaacgtgtttaaataatgaaaatttatggtagattctgttattggccctgattttcaaccatgtccgtcaaagccctttgccatataattttttaggaacccactgttgggggtggagtggacttccttgccttatgaatttgtatttgaccacttaacttgttgttaccaatggatagagcccctgggtatatacttactctcttgtacatccaccatgcaataagaatatgtgtgacagtattttggtgtcaggagaaggatgagagatacatgggggagagctactcccaggcctggaccagataattcttcagttagccatgtactcatgaatgaacccagctgagcccagcctggagcagccattttttaagcagtgcacagatttaggataaataataagttatgattgttttaagcccctgagttttagggtggcagtcatagctaactgatataaagtttctattctgccaaaaaaaaaaaattttaaagaaagttatattctattctattttcacacatcaattgatgtgaaaacaaaatataatctactgatccaacaggaaaactgcttgcattattggttttatttattagactgccttaatgcagcaatcacgcagctagaaagggaaaaataaaacgaatataatttataaaaatagctttattgagatataccttatatatcataaaatttacttattttaagtgcacaattcagtgatttttagtatacttatttttgccactgtcaccacaatgtaatttcaaacatttccatcatcccaaaagaaatctctgtgcccattaccagtcactttttttctctcccacctccagcttaagactatgtaaccacaaatctacttcctatcactatagatttgcctattctagacttttcatagcaatagaattatacaacatatagggatttttgtgtttagcttttttcactgagcattttttaaggtgcttctatattgaagcatgttttagtagttcttttttatttctggatagtaatccattatctgagtttatcacattttgtttatttattcatcagttaatggatatttgagttttccactttttgtctattatcaataatggtatgaacattcatttacaagtgtttgtacaaacattatgtttttatttctcttagataagtacttagttgtagtagaatttctgggtcatatggtgactctgtcttcagcattctgagaaacttaaagttttccaaagtgactgtgccattttacactcccaccagaaatttatgagggaaaactgatagtaatttaattatactgaatattcaatttatactactagtgactttcatatcataatacagaatgataactatatataaaagataataatcagataatctgaaaataataaaactgtgaaatgtacttctctctatagtgagtcatatgtgtaagttatgcagcaggtgaagaaatgtgtaagataggccttttaaaacacaatcttaaatcttattaaggttttctagagtaatataaataatgcgataatagaaataagatctacttattttctactattctgtaaaattattaaataattaaattttctttctatagtaatcttgttacaccaagctcactttgtactattgtgcctatacagaaattacactaatttttcctccattaaaacattaaaatagccttttgacttttatagacttcagagaagttgtcattatatctcaagtgctatgaatgtgaactgtgggaatgtgaactttactaagaatcaattatatagcctaagttggtgttttatatttgtttttcctgcactgttatggaaacctgtaaaatatgttaacattgaactatttggtcttatttagacagtattttatcttacaatgctgtatgatgaaatcctgcactcaaataaaacattaatcagcagaacttaaataaaaatatatgactgttaattttgtagtcttcctacttgcttagaaattaaatttctaataaatctttgtctctgattttgtgcaaaacaatgctattggctggtgacttcactgtctaagaatatggatttataaaggtatagagagtatcggttatatagaggtatcaggtaaagttcatgcaagccaaatatttttaagcattcaatggtgttttcttgtaggaattaaatgtatttattagcttgactttactgactatgtttgcttaatattaatctattagagcataactgcataacatgggttttaaatgaagcttgctgttactctaaatttatgtcacaaatgtggctctgggaaatttttcaagtttgtctcagtgctttaagccttataaaaatgagcaagtaactcataaataatagacagttcctcagaagtcatttaaagtgcactccttttattggcaaaatttccatatgttctttggctctttgagatgtagactctgtagagctatttaactaccattattttctggtgatttttttcaggtacctttctttatgatttatggttctgtaaaatcttacctcagtgtgtagctagaattatttagtcacatattttta

SEQ ID NO: 2 - DNA, 1881 bp, Homo sapiens
cttttccctcatgcttctttttgccttcttcctctatccaacagaggtggtgggaagaattagaattaaagcaggaggaagggaaaagaaatcttagctttttgtagatgggtgaaaaattggttagacttcagcttttaatgatctttcagtttagtaggtctcatatttttcaccatatgttattttctgattcacagtttctggtatatagttgatgcttaacaaatttttggatgattgttttccatttgttttgtggaatcgatctttccaaacatagcaggtcttttctattgattaaaataagtaaaagagtctgaaaactagaggtttagttcagaatgctgagcaaaatctggtattgtcatatgacgcatgggccaaggggagaaaatatagttacacagtgaatcagaaatagacaagttttggcaaggacaaggtatttgaaaaagtatagccctttaggttttataaagctttttctgttgttgttttattcttataaaactcttttgttatgccagtattataatgggaagctgaggctcggtgtggtgatatatcctgtacaaggtcaaacagtaagtatcagttcgtcttaacagacaaatttcgtgttcattctggtaagacaaggaaacaggacaacaacaacaataacgaaacaatgttctgaggcatttatgctgggttcatgtactggtgtgcataccatacatcatatcctttctctgatcctgataacctttcacagggtgatggttatgatacttaaaaatgagataataaatataaaagtgccataaaacattgtgttgttggtattattattccatcataggatagcaagtaataatacaggcatactttgttttagttcacctcatggatattgcatttttcacaaattgaaggtttgtggcaaccttttatccagcagacttgttggtatcattttttttttaacaacgtgtactcacttcgtgtttctgtgtcatgtttttgtaattctcctagtatttcagcctttttcattatcatatctgttatggtgatctgtgatcagtgatttttgatgttactattgtaattttttttttttttttttttgagatggagtctcgctctgtcgcccagtctggagtgcaatggcacgatctcggctcactgcaacctcttcctcccaggttcaagagattcttctgcctcagcctcccatgtagctgggattacgggcgcccactaccatgcctggctaatttttgtatttttagtagagatggggtttcaccatgttggccaggctggtttcgaactcctgacctcagatgatccacctgcctcagcctcccaaagtgctgggattacaggcgtgagccattgcacccagcctactattgtaattgttttggggagccatgaactgtgtccatataatatggtgaacataatatgtgaattctgactcttccaccgacgagcagtttccccatctctctcgctgtctcctcaggcttccctattccctgagatacaaaatattccctgagtattgaaattaggccagataataatcctacagtggcctctaggtgttcaagatctagagatcctgatttaatgtgagacacatccctcagattaaatcaaaagctagaaatggttaagcttagtgaggaaggaatactaaaaactgagacaggtggaaaggtaggcctcttgtgccaaatagccaagttgtgaatacaaaggaaaaattattttaaaaaatagcagagaacatttattctgagagatttgtatattatacttctgaggatctaagagaaaataacaaattttcatatttcagttaaatttatggaaatacaaatg

SEQ ID NO: 3 - DNA, 92496 bp, Homo sapiens
aggacgaatgagatttcactatggacagaattgtgactaaattttaccatatggcctacaatgtctctcccagtcaaggttatatataatgcctctgtactcttctatttcccagtatcatatctggaaccaagacacttggacaggaatcctattttagacagaggactgaaagtagtaaatgtaaatatttttaagacattgcatttgataaggaataaaggaagagtgaatctctgactcatttctcctcaaattattattttgttgtgatttatgaaaattaacaatctgaacaagagaaggaagttatgattaattttggaagattgtaaattgcataccagttttccaatgttagccatttttaatcaactcagtttttaaacaaaaatttataaatatggctgaaccgaagatatctatagagagcttcaacataagatttgatcaagcagaagaaaggatcagtaagctcacagactggttattagaaattacccagtcagaagaacaaaatgaaaaaagaatttaagagtgagaaagtctgtgagaattatggggcagtgaagcaaaccaatctttgcattataggagttccagaaggaacacagagagagaaaggagtagtgaatgtatttaaagaaataatgacagaaaacattcataaactagggacagatataaatgtccacacataggaagctcaaaggtctccagttatgttcagctgaaacaatgctacaataagacttagtaaaactctcagaagcgttaagacaaagagaggatcctgaaagcagcaagagaaaagaagcaaatctcatacgagagaactccattatggctatcattagatttttcaacagaaaccctgcaggtcagggatagagtgaaaaaaaaaaaaaaaaaaagcaaacaaaaatttcttgctcaaagaaagaaaaaaaaaaacaccaggaaccataaagttgtccctcagaaatgaaggagagataaggactttcccagacaaataagaactgaggaagttcactagacttgccttataagaaatgcaaaagggaattctttaagctgaaagaaaaggatggtaattggtaatatgaaaacatataaatgtaaaaaattcactggtgaaagtaagtatgtagtcagattcagaatgctgtatgtaaagctacaatggtggtgtgtaaatcaattatatctttagtaagaaggttaaatataaagtagttaaaataggtatatttacaataattaagtgatatacaatatataaaatgtaaattttgacatcagtaacaatatgttggtgggtaataaaattgtagaattcttgtgtgttattgaagttatcagcttaaaaatagcctgttacaaccgtaatatgttttatgtaagcctcatggtaaccacaaaagaaagagctacagtagatacataggagataagtaagaaatcaaagcataccacaacagagaatcattaaattacaaaggaagacaggtagagtggaagaaaggaacaaaaaatctgcaaagctaccagaaaacaatgaacaaaatggcagttgtatgtctttatctatcaaacaagtagtttaaatgtcaatggattaaattctcccatcaaaagatacagagcagctgaatggattaaaaaaaaaaaagtccaaactatatgctgttaataagagactcatttcatctttaaggacacaaatagactgaaagtgaagaaatgggaaaagatagtctatgaaaatggaaacgaaaagagagcagaggttgttatacttagatgaaatagacattaaataaaaaattgtgagaagaggcacagaagattattatataatgataaaagtgttggttaatcaagaagatacagcaattgtaaacagatatgcacccaatatcagaacacctaaatacataaagcaaatattaatagatctgaagggagagacaagactgcaagacaataatagtataggacttcaatatttcacattcatcaataaacacatcatcgacttagaaaatcaatatggaatttgatttataatttgatatgtggacttcaatcacacagtaaagcaactgtacctaacaaacgtatatcagaatagttcatccaacaacattggaacacacatccttcttaagcatatgctaaacattctccagggtataccacgttagtctagaaaacaaatcgtaacacatttaagaggatttaagtgatatcaagtatcttttttaaccacagtggtatgaaattataaatcattaataggaagaatttcaaaaaattgcaaatatatggaaattaaacaacatgcttctcaataatcagtgggtcaaagaagaaatttaaaggacaataaaacaataccttgacactaatgaaagtggacactcaacatatcaatttgtataggatgcagcaaatcataagagagaagtttatagcaacagatgcctacacataaaagaagaaaaatctcaatctagtgttacacttcaaggaactagaaaaataacacactaagcccatagttagttgaatgaatgaaatattaaaaatcagagcagaaataaatgaagtagaaattataaaagcaatagaagagatcaacaaagctaagagttgtttttttaaaagataaaattgacaaacctttagctagactgaaaaaatagtgaagagttaaagaaaatcagaaatgaaagaggagacattacatcttatatcactggaatatgaaggatcataagagacaactatgagcaatcatatgccaacaaattagataacctaaattcctggaaacatacatcttatcaagactgaatcatgaagaagttgaaaatctgtataaactactaattaaggaagttgaatcagcagtcatagactgcccaaaaaacaacccaggacctgatgcctttactggtgaattctaccaaatatttaaagaataaacaccagtgtttctcaagctctctcaaaaaattgaaaattgatgagagaaaacttcaaactcattttaagaggccatcattaccatgataccgaagtcaaagacactacaagaaaaaaaaatgcaggccaatattgttgatgaagatagatgcagaaattctcaatgaaatactagcaaaccaatacatgaaaaacatcatacaccatgatcaagcaggatttattcctgggatgcatttatgtctgtggttcaacatttacaagttgataaatgtcatacattaatagaataaattacaaaaaccatgtgattatctcaataaatgcagaaaaagcattagagaaactttaacattttttatgataaaaacccgcagcaagttaggtatagagggaatgtacctgaacacaataaaggtcatatatgataggcccaaaattaacgtcatactcaacagtaggaaggtgaagatgtaaaaaaaaaaaaaagatgtaaattactacatgaaatcataaaatattattgggtgatggaataacagtgtagagttactttatgcaatcaaaccaaagttatcagcttaaaatagtctaactgtaagatgtttcatgtaaacctcttgatcactataacgaaaaactatgctagatacacttaagataaaaagtgggaatcagagcatagcactagagaaaatcctctaaccataaaggaagacagcaagaaaggaagaaagaattacaaaacaaccggaaaacaatgaacaatatagcaatagtaaatccttacctataaataattaccttgaatattaatagattaaattcttcaaagaaaagatagtgactgaatcaatcagaaaataagacccaagtatgttctgcctataagagaatcactctcacctttaagggcacatacagattgaatgtgacaggatagaagtagataatccatgctgatggaaaccaaaagaaagcaggagtagctatacttatatcagatgaaatagaatttaaataaaaattataaaaagagacacagaaaaggtcatataatgtaaaggggtcaatttatgaagaagatataacaattgtaaatatatctgcacccaacatcagagtacctaaatatataaagtaaatgttaataaatctgaagaatgagatagactgcaatatagtgtagtagactttagtatgcctctttaaataatgaacagatcatccagacaaaaaatgatatagaacttgaactacatcttagaccaaatgtaacagacgtatatagagcatttcagccttctatccaacagtagcagaatccacatttttctcgagcattttggaaacttccccaggatagatcgtaagtcagaccagaaaataaatctcaacaaatttaagaagattgaaattatgccaaatatcatctccagtcacaatggtatgaaaatagaattcataacagaaggaatattgcaacatttataaatttgcacaaacttacttggccctaaacaaccaagagtaaaactgaaatgggaaattaaagggaaattaaaaatatcttgagacaaatgaaaatactacataacaaaaattatgggatgcaacaaaagcattttattttattttattttattttactttaagttttagggtacatgtgcacaatgtgcaggtttgtgacatatgtatacatgtgccatgttggtgtgctgcacccattaactcatcatttagcattaggtatatctcctaatgctatccctcccctctccccccaccccacaacagtccccagtgtgtgatgttccccttcctgtgtctatgtgttctcattgttcaattcccacctatgagtgagaacatgcagtgtttggttttttgtccttgcgatagtttgctgagaatgatggtttccagcttcatccatgtccctacaaaggacatgaactcatcattttttatggcagcatggtattccatggtgtatatgtgccacattttcttaatccagtctatcattgttggatatttgggttggttccaagtctttgctattgtgaatagtgccgcaataaacatacatgtgcatgtgtctttatagcagcatgatttataatcctttgggtatatacccagtaacgggatggctgggtcaaatggtatttctagttctaaatccctgaggaatcgccacactgacttccacaatggtggaactagtttacaatcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatattctttgcccactttttgatgtggttgtttgtttttttcttgtaaatttgtttgagttcattgaagattctggatattaaccctttgtcagataagcaggttgcaaaaattttctcccaatctgtaggttgcctgttcactctgatggtagtttcttttgctgtgcagaagctctttagtttaattagatcccatttgtcaattttggcttttgttgccattgcttttggtgttttagacatgaagtccttgcccatgtctgtgtcctgaatggtaatgcctaggtttttttctagggtttttacggttttaggtctaacatgtaagtctttaatccatcttgaattaatttttgtataaggtgtaaggaagggatccagtttcagctttctccatatggctagccagttttcccagcagcatttattaaatagggaatcctttccccattgcttgtttttgtcaggtttgtcaaagatcagatagttgtagatatgcggcattatttctgagggctgtgttctgttccagtggtctatatctctgttttggtaccagtaccatgctgttttggttactgtgtccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatactgattcttcctacccatgagcatggaatgttcttccatttgtttgtaacctcttttatttcattgagcagtggtttgtagttctccttgaagaggtccttcacatcccttgtaagttggattcctaggtattttattctctttgtagcaattgtgaatgggagttcactcatgatttggctctctgtttgtctgttattggtgtataagaatgcttgtgattttttgcacattgagtttgtatcctgagactttgctgaagttgcttatcagcttaaggagattttgggctgagacgatggggttttctagttatacaatcttgtcatctgcaaacagggacaatttgacttcctcttttcctaattgaataccctttatttccttctcctgcctgattgttctggccagaacttccaacactatgttgaataggagtggtgagagagggcatccctgtcttgtgccagttttcaaagggaatgcttccagtttctgtccattcagtataatattggctgtgggtttgtcatagatagctcttattattttgagatatgtcccatcaatatctaatttattgagagtttttagcatgaagggttgttgaattttgtggaaggccttttctgcatctattgagatgatcatgtggttttcgtctttggttttgtttatatgctggattacatttattgattttcgtatgttgagccagccttgcatccccgggatgaagcccacttgatcatggtggataagctttttgatgtgctgctggattcggtttgccagtattttattgaggatttttgcatcaatgttcatcaaggatattggtctgaaattctcttttttggttgtgtctctgcccggctttggtatcaggatgatgctggcctcttaaaatgaggtagggaggattccctctttttctattgattggaatagtttcagaaggaatggtaccagttcctccttgtacctctggtggaatttggctgtgaatccatctggtcctggactttttttggttggtaagctattaattattgcctcagtttcagagcctgttattggtctattcagagattcaacttcttcttgatttagtcttgggagggtgtatgtgtccaggaatttatccatttcttctagattttctagtttatttgtgtagaggtgtttatagtattctctgatggtagtttgtatttctgtgggatcggtgatgatatcccctttgttattttttgtcacgtctatttgattcttctctcttttcttctttattagtcttgctagcggtctatcaattttgttgatcttttcaaaaaaccagctcctggattcattgattttttgaagcgttttttgtgtctctatttccttcagttctgctctgatcttatttatttcttgcattctgctagcgtttgaatgtgtttgctcttgcttctctaggtcttttaattgtgatgttagggtgtcaattttagatctttcctgctttctcttgtgggcatttagtgctataaatttccctctacacactgctttaaatgtgtcccagagattctggtatgttttgtctttgttctcgttggtttcaaagaacatctttatttctgcctccatttcgttatgtacccagtagtcattcaggagcaggttgttcagtttccatgtagttgagcagttttgagtgaggttcttaatcctgagttctagtttgattgcactgtggtctgagagacagtttgttataatttctgttcttttacatttgctgaggagtgctttacttccaactatgtggtcaattttggaataggtgtggtgtggtgctgagaagaatatatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggattctaagtctctttgtaggtcactaagaacttgctttatgaatctgggtgctcctgtattgggtgcatatatatttagggtagttagctcttcttgttgaattgatccctttaccattatgtaatggccttctttgtctcttttgctctttgttggtttaaagtctgttttatcagagactaggattgcaaccccttcctttttttgttttccattggtttggtagatcttcctccatccctttattttgagcctatgtgtgtctgcatgtgagatggatttcctgaatacagcacactgatgggtcttgactctgtatccagtttaccagtctgtgtcttttaattggagcatttagcccatttacatttaaggttagtattgttatgtgtgaatttgatcctgtcattatgatgttagctggttattttgctcgttagttgatgcagtttcttcctagccttgatggtctttacagtttggcatgtgtttgcagtgggtggtaccagttgttcctttccatatttagtgcttccttcaggagctcttgtagggcaggcttggtggtgacaacatatctcagcatttgcttatctgtaaaggattttatttctccttcacttatgaagcttagtttggctggatatgaaattctgggttgaaaattcttttctttaagaatattgaatattggcccccactctcttctggcttgtagagtttctgcaacgaaagcatttctaagagaagtttatagcaataaacacacagatcaaaaataagaaagatcccactaaaacagtctaatgctgaacctcaaaggactagaaaaaacaacaatataaatccctagtttatagtagcaaagaaaaaaacaaaggtcagaacagaaataagtgaaatagagactgtaaaacaataggaaagatgaacaaaacagaattgattttttcagaagataaacagttgacaaacttttaactaagaaaaatgacagaagactgaaatatataaaataaaaaatgaaagagtaggcaatacaggagataccacagaaatacagatgacaagagactactgtgaacagttatacacaaacaaattacataacctaaaacacatggatgagatcctggaaatgtacaactaccaagaatgaatcatgaagaaatagaaaagctttacataataacaagtaaggagattaagtcaataataaaaaatagctcttatgtgaaaaagttcaggacttgatggtttcacatctgaactttacaaacatttaaagaagaagtaataccaatgcttctgaaattcttccaaaaaattgaggagtagataaatctttcaaactattttaagaggcctgtatgaccctgataccatagacaaacaagtatattataagaaaaaattaccagccaatattcctgataaacagatgcagatattctcaataaaatactagcaaattaaattcagtaacacattataaggatctgttgtcatgatcaagttggatttatttctgggatgcaagtttggttcaacttatgcaaatcagtggaggtcatacactacattaacaaaaagaaggacaaaaatatggctatctgaatagatgcagaagaggcatttgacaaaatctaaaatattaagtaaagaagattatattagtccattctgacattactataaagaactgtaggagagcagccccagtgcttatagataaaactcccatctccctaggacagagcacctgggggaatgggcggctctgggtgcagcttcggcagacttaaatgttcctgcctgccagctctgaagagagcagcagatcccccagcacagcattcgagctctgctaagggatggactgcctcctcaagtgggtccctgaccctcatgcctcctgactgggagacacctcccagcaagggttgacagacacctcatacaggagagctccgggtggcatctgccaggtgcccctctgggacgaagcttccagaggaaggaacaggtagcaatctttgctgttctgcagcctccgctggtgatacctaggcaaacagggtctggagtggacctccagcaaactagagcagaccttcagcagaggggcctgactgttagaaggaaaactaatgaacagaaaggaatagcatcaacatcaacaaaaaggatgtccaccaagagaccccatcctaaggtcaccaacatcaaagaacaaagatagagaaatccacgaagttgaggaggaaccagcacaaaagactgaaaattccaaaaaccagaatgcctcttctcctccaaagtatcacaactccttgccagcaagggaacaaaactggaatgagaattagtttgatgaattgacaaaattaggcttcagaaggtgggtaataacaaacttctctgagctaaaagagctgttctaacccaatgcaagaagctaagaaccttgaaaaaaagttagatgaattgctaactagagtaaccagtttagagaagaacataagtgaccttatggagctgaaaaacagcacaacaactttgtgaagcatacacaagtatcaataggcgaatcgatcaagcggaagaaatgatatcagagattgaagatcaacttaatgaaataaagtgtgaagacaagattagagaaaaaagaatgaaaaggaaacaagcctccaagaaatatgggactatgtgaaaagaccaaacctatgtttgattggtgtacctgaaagtgacagggagaatggaaccacactggaaatcactcttcaggatattatccaggagaactttcccaacctagcaagacaggccaacattcaaattcagggaatacagagaacaccacaaagatactactagagaagagcaaccccaagacacataatcgtcagattcatcaaggttgaaatgaaggagaaaatgttaagggcagccagagagaaaggtcaggttacccacaaagggaaggccatcagactaacagtggatctctcagtagaaatcctacaagccagaagagagtgggggccaatattcaaccttctgaaaaaaaagaagtttcaacccagaattgcatatccagccaaattaagcttcataagcaaaggagaaataaaatcctttacagacaagcaaatgctgagagattttgtcaccaccaggccttcctcacaagagctcctgatggaagcactaaatatgggaagaaaaaaccggtaccagccactgcaaaaacataccaaattgtaaagtctttcgacactatgaagaaaccgcatcagctaatgggcaaaataaccagctagcatcataatgacaggatcaaattcacacataatatttatataaccttaaatgtaaacaggctaaatgccccaattaaaatacacagactggtaaattggataaagagtcaggacccattgatgtgctgtatttaggagactgatctcaatcctagtctctgaaaaaacagactttaaaccaacaaagataaaaaaaaaagacaaagaagggctttttacatttttacaaagaagggctttaccattacataatggtaaagggatcaatgcaacaagagctaactatcctaaatacatatgcacccaatacaggagcacccagattcataaagcaagttcttagagacctacaaagagacttagactcccacacaataatagtgggagactttaacaccccactgtcaatattagacagctcaatgagacagaaaattaataaggatattcaggatttgaactcagctctggaccaagcggacctaatagacatctacagaactctccacccgaaaccaacagaatatacattcttctcagcaccacatttcacttattctaaaattgaccacatagtggaagtaaaacactcttcagcaaatgcaaaagaatggaaatcataatagtctctcagaccacagtacaatcaaattagaactcaggactaagaaactcactcaaaaccgcgtaactacgtggaaactgagcaacctgctcctgaatgactactgggtaaataacaaaattaaggcagaaatcagtaagttctttgattcctatgaaaacagacacaacatagaggaatctctgggacacagctaaagcagtgtttagagggaaatttatagcactaaatgcccacaggagaaagcgggcaagatctaacatcgacaccctaacatcacaataaaagaactagagaagcaagagcaaacaaattcgaaagctagcagaagacaagaaataactaagatgagagctagagacacaaaaatcccttcaaaaaatcaatgaatcaggagttgcttttttgaaaagattaacaaaatagatcgaaagccagactaataaagaagaaaagagagaagaattaaacagacattataaaaatgataaaggggatatcaccactgatcccacagaaatacaaactaccatcagagaatgatataaacatctctactcaaataaactgcaaaatctagaagaaatggataaattcctggacgcatacaccctcccaagactaaacctggaagaagttgaatccctgaatagaccaataacaagttctgaaattgaggcagtaattaatagcctaccaaccaaaaaatacccaggaccagacagattcacagccaaattctaccagaagtacaaagaggagctggtaccattccttctgaaactgttccaaacaagagaaagagaaggaatcctccctaactcattttttgagaccagtatcatcctgataccaaaacttggcagagacacaacaaaaaaagaaaatttcaggccaatatccctgatatgaacatcaatgcaaaaatcctcaataaaatactggcaaaccgaatccagcagcacatcaaaaatcttatccaccataatcaagtcggctttatctctgggatgcaaggctggtttaacctatgcaaatcaataaacacaatccattatgtaaaccgaagcaacgatgaaaaccacatgattatctcaatagatgcagaaaaggcctccgataaaattcaagagccttcatgctaaaaactctcaataaacttggtattgatgaaacatatctcaaaataataagtgctatttatgacaaacccgcagccaatataatactgaatgggcaaaagctggaagcattccctttgaaaactggcacaaggcaaggatgccctctctcaccactcctattcaacatagtattggaagttctggccagggcaatcaggcaagagaaagaaataaagggtattcaaataggaatagaagacgtcagattgtctctctttgcagataacatgactgtatattttgaaaaccccatcgtctcagcccaaaatctccttaagctgataagcaacttcagcaaactctcaggatacaaaatcaatgtgcaaaaatcacaagaatttctatacatcaataatagagaaacagagagtgaaatcttgagtgaactcccattcacaattgctacaaagagaataaaacactaagaatacaacttacaagggatgtgaaggacctcttcaagtacaactacaaaccactgctcaaggaaataagagaggacacaaagaaatggaaaaacattccaagctcatggataagaagaatcaatatcgtgaaaatgaccatactgcccaaagtaatttatagattaagtgctatcccaatcaagctaccattaactttcttcacagaattagaaaaaactactttaaatttcatatggaaccagaaaagaggctatatagccaagacaatcctaagcaaaaagaacaaagctggaggcatcatgctacctgaattcaaactgtactacaaaggctacagtaactaaaacagcatgttactggtaccaaaacagatatataggctaatggaacagaatggagtccttagacatatcaccacacatctacagccatcttatctttggcaaacttgacaaaagcaatggggaaacgattccctatttaataaatggtgttgggaaaactggctagccatatgcataaaagtgaaactagactccttccttacacctcatacaaaaattaactcaagatggattaaatacttaaatgtaagacctaaaaccataaaaactctagaagaaaacctaggcaataccattcaggacataggcatgggcaaggacttcatgtctaaaacaccaaaagcaatggcagcaaaagccaaaattgataaatgggatctaattaaagtaaagagcttctgcacagcaaaagaaactatcatcacagtgaacaggcagactacagaatgggagaaaatttttgcaatccatccatctgacaaagggccaatatccagaatctagaagaaacttaaacaaatatacaagaaaaaaaaaaaaaccccgtcaagaagtgggcgaaggatagaacagatatttcccagaagaagacatttgtgtggccaaaaaacatatgaaaaaagctcatcatctttcgtcactagagaaatgcaaatcaaaaccacaatgtgataccatctcatgccagttaaaatggctatcattaaaatgtcaggaaactacagatgctggagtggatgtggaacaataggaccacttttacactgttggtcagagtgtgaattagttcaaccattgtggaagacactggtgattcctcaaggatctagaaccagaaataccacttgacccagcagtcccattactgggtatatacccaaaggattataaatcattctactataaggacacatgcacacatacgtttattgcagcaatattcacaatagcaaagacttagaaccaacccaagtgtccatcagtgaaagactggataaatcaaatttggcacatgtacatcatggaatactatggagccataaaaacgatgagttcatgtcctttgcagggacgtggatgaagctggaaactatcattctcagataactaacacagaaagagaaaaccaaacactgcatgttctcactcataaatgggagtcaaacaatgagagcacatggacacagggcgtggaatatcacacactggggcctgtctgggggttgtgggctagggaaaggatagcattaggagaaatacctaatgtagatgacaggttgatgggtgcagcaaaccaccatagcatgtgtatgtatacctatgtaacaaacctgcacgttttgcacatgtatcccagaacttaaagtatttaaaaaaaaaaaaaaacaaacaactgtccgatactgggcaatttatcaataaaagaggtttagttgactcacagttctgcatgcttgtggagccctcaggaaacttacaattatggcagaaggggaagcaggcatgtcttacatggcatcaggcaagagagcatgtaatggaagcaaagggggaagagccccttataaaaccataagatcttatgagaactcactatcatgagaacagcataggggaatccatgcccaagatccagtcacctcccaccaggtctctttctcaacacccagggattacagggattacaatttgagatgagatttgggtggggacacaaagccaaatcatatcaaagatttacctctaaacataataaagacaatataccacaagcccatagtgagtattatgctcagcactgaaaagttgaaggcctttttcctaagatgaggaacaagacatgggtactcaccctcacttttgttcaacacagtactgaaagtactaaccagaacagttaggcaagtcaaagaaataaaaaggattcaaattggaaaggaagaagtaaaattgtctttccttatagataacataaccttatatatagaaaagcttaaagactccaccaaaaacctgttaaaattgattaataaattccataaagttgtagattacaaaatcaacatacaatttttagtagcatttctatacagtaacatcaaattgcctcaaaaggaaattgagaacacaatcctatttacagtagtttcaaaaataaattaggtataaatttacccaaagaggtaaaaactctgtaagcagaaaactataaaccatttatgaaagaaatttagggagataaaataaaaggaaagatatcccatgttcatgaattgaaaggatgaacattgttaaagtgtctctacttcccaaagttatctacagattccatgcaacccccgtcaaaaactccaatgacatattccccagaaatagaaaaaaaaaatcctaaaatttgtatgacatcacaaacacttcaaaatagctagagcaatgttgagtaaaaaggataaaactggaggcctcatagtgcgtgctttgaaaatctactacaaagctgtgttaatcaaaacagcatggtgctggcataaaagcagacacacagacttacaggatagaatggaaaagccagaaaaaaatccacacatttatcgccaattgattgttgataaaaacgccaagatcacacaatgggggaagggcagtctcatcaataaatggtcgtagggaaactgggtgttcacttgcagaagaataatattagactcccatctcacatcatatatatataaatcatctcaaaatggattaaatgcttaaatgtaagacctaaaactgtgaaagtagtaaataaatcataggagaaaagctctctgtcattggtatgatcacacgtactttggatataacccccaaagcacagacgacaaaagtacaaatagacaaataggatgacatcaaactaaaaagcttctgcacagcaaaggaaacagaatgaagagaaaacctgtggaaaaggagaaagtatgtgagaccatatgtctgataaggaattaatatccagaatatatgaggaacttgaaagtaagaaaacaatctgatataaaaacatgcaaaggacctatataaacatttttgaaaataagacatataattggccaacaggtttatgaaaaagtgatgaacattactgatcatcaggaaaatgcaaattataactctaatgagatactgtcttatagctgttagagtggctactttaaaaaagaccgaaggtaagtattagcaaggttatggagaaaagagaacccttgaagactgttggttgggttgtaaattagtattacagccataattgtaaacagtatggaggtatctcaaaaataagaagtagaactatcatgtcatccaacaattttactatttagtgtatgtccaaaggaaatcatatcagtatctcaaagagatgcctgtatttctgtcacggcatccttggagtgttacttttctagctgggaacctctgtggctggtattgcctttgtctgaattttgcttgggcctgcttggcttgttctgcctactctgcctggcaggatacactctgctcgcactaacagcctgccaagggtgagccaggtacggagtggtgaggggtgtgtgagttagcgtgtgatctggccactgcacacagccaggcacactagttgtggtgtggtggacagctccaggtgccggcaccctgcaaggctgtggctcaatgaggcttactgcaagcagcttccatggctgccactggggtaggcagtggtgcctggaagcttggagacttcaggaactgcagagccccattgagggtgtcacagctctggcttggggagctcttaagtctgggctccctgaagtgctacagctcttctctccttcttgtcacctgcaacgtggcaagcaaggggcgtgtttcagccctgtttgtgttactgctctttcagtcgtgccgttccgcaggtcctgagttcttgtcctgtgtccaggaagaatgagttatgtggacaagtggagggtgaacaaggtgaagagatcctttattgagtgacagaacagcttaaaggagacccacagtgggtagctcctctctgcaggcagggcatcctgacaagtgttcagctctcagcagagaggagacccatagtgggtagcttctctccacaggcaggttgtcccatcatctgctcagctctcagcagagaggagaccctcagtgggtggctcttttctgctggcagattgtcctgtcatctgcttgagtttggctgagtccagggtttctatgggcttcagaggggaggaagtgcatgctgattggtccatggaaagccatgggcaggcccagaaaaagcaccagaagttctccctccagtccatggcactggcagtccagtccccaaacctcaggctgtctctgacctgaagatgaggtttcaccaggtacctgcccctttccatctaggcctgtctgcctcctgctgccattaacctgccatccacggtgcccatggtgcccaggctgtttgtgctgaatgttgcctgcaggcctgcatcaagccactcttagccccctgtcagcctttctcccatcctctttggtacccaaagtctggagggggccaaggcatgagggggctggtgtgtcatagctgccctgaatgtgtgcacacctggctgattcatgacagtgcccaggcttggccacaactttgcttcaaaattggagcgggtgtttgtagtgggtgcttggagtggggagaggctaggcagcaggagcagtcacttacaagcttgtgggtcagcagggcttcctgggtccccaagagtgtagagatgcccgggtttgcagccacagcttgacggctacaactgcgcccggggggcggggctcccacctgtttaacttggaatgggctgggagcttccacctgttcttggttcctgctggctccgtggagtgcacagccccagctgtgcctcccccactgcatctggtgtcattgatgatgccagggattgattgacaccattccagacaggctgccgctgccttcagtccctgctctgaagaggtacatctgctgccattaggatagggacaatgactgctcttaactgcttcatgctgacagggggcattgtttatggggaaaatggcagttatgtcttcttagaggccctatctaagggtccctagtaaaagtaaaagggagccatcagccaagtttccatttgcatgaccatttggagtttgatggcccgaaggcgagaagagacaaaccgggttattggaagacatggatcaaaacaaaacaaaggggtaaggacagctcaaaaaccctgaggctactcacatgctcaaaattagaatattgatccagattttttatattacgcatcccttttgtctcttctgagccgtagtcagaaatcactggttggttcacaagagcaagctgggttagtctaaaatgcagaccaaaacttaaaaacaaagtccggagggggctgaggcagcatggagctggcgtatcagcactgccccaagcgtgcacatacccagctatgtcatgacagtgcccaggcttggccacaacgttgctccaaaattagagtgggtgccaggagtggggagaggccaggcagcaggagcagactcttgcgagactgcaggagtgtcttcctaggcccttgagagtgcagaaatgcctgggtctgcagctgtggctgggtggctgcagctgcacccaggagggtagggctcctgccccttcaacttggaagtgggcagggcttccacctgttcctggctcttgcagctttgtggagtccacaagctccagccttacctcccacactgcagctggcatcatggcagtggccactccagatgccccactactaccatcacttccatgttcattgtggcgttatttccaatagccaagatgtggaatcaatctaagtgtccattaatgggtgaatggatgaagaaaacatgttatatatacacagtgaaatatcattcacccttaacaaaagaaggaaatcctgtcattctcaacatcatggatcaacctgtaggacattatgttaagtgaaataagtcaggcacagaaagacatactcatgatcttacttattataagtgtagtgtaaaaatgttgacctcatagaaacagtgaaatgttgattatcagaggctagggtgtgggaggaattagggagatgttggttaaaagacagaaaaatttatttaaagtggaggaataaattcaaagacttgtaaatcatggtgactgcagttaataacaatatgttgtatatttgaaaattgctaagacagtagattttaagtgttcgtaccagaagaaatgataagtatgtaaggtaatgtatatgttaaatagcttgatttagccattctacaggtatcaaagcatcatgttttatattataaatatatataatcagttaaaaaaaagtactgagactctgagaaaggcattagttaatttgcccatagttttatatttagtgaatccagtggtcttacttcagatgtgtattcttagccaaaagatgcacttgctttcacctccacttctgtccctaaaaactgaaaagcaaaataaagaggtggaaagaggctgggtgcggtggctcatgcctgcaatcccagcactttgggaggccaacatgggcagatcacgaggtcaggagttcaagaccagcctgaccaacatggtgaaaccccatctctactaaaaatacaaaaattagctgggcgtggtggcgcatgcgtgtaatcccagctactcaggtggctgaggcaggagaatcgcttgaccacggaggttgcagtgagctgagatcagcgccactgcactccagcctgggctacagagtgagactctgtctcaaaaaaaaaaaaaaaaaggaaagaaattcagtagccatttcattcagccttgcagttgatgcagtctttagctaaacactgggatagtttgggagggaaggccgtagtttgggagggaaggccgttagtacaatttttttatacgttgtgcataagaagcttttgagtcatggatctttgataattactttcagtagtaacgtatcctcggtaattttttttactttcagtaataacatatcctagacaaattttatgcatttttttccatacttgaaagaaactttttattaaaaaatagtattaataacggagcataatctggtaggagtgttcattactactgttttattgtttttaagttttttccatgggtagagtaggaaacacgcatttttggagagaaaaacatgaatcccaaatttatcctcattccaatttaagataaagattttgagggattttatttaccactttggtcttaccctttttgtatatctttttcttttattatccttttacctctgttctctgattttacatttttttttgcattttttttttttttttgctagatgcaggcctaggtattttattttacttttcgttatacagtcttctcgattattttaactaagcaggtttttttggatggtgggaggagaaggagaaaacattaagttgtctgcttcttatttattttacatattgcttataattctcttgtgaattattttagggtttttattggttgtttttgtttttgccttcctgatataaaaattatattgcttgcaaataaagattactttccttctttttcttccatttttggcctctaatgttttctttacttgtgttgtttaagatattaaataatagaagagatagtggacatccttgtcttattccttattttaatgagaaagtacctaacatttccaatttagtaagttgctggctaattgggaagtacagacacatgtgtatatctatatatctgtatatctatatctatatctatatgtattcaggctaaaaaatacctcttaatttctatgtaaacgttaaaatttttattttggtaattatgtatgatgttgaattatgtcacttgaatttttagcagttatgaaaatgaacatataatcttctgttaatataatggattttattaatgcatttttaatattagaaacctttgaatttctggcatgtacccctctttcaaatgttttttagtgttttggattcttttgcatattatctcatttaaagtttttgcatcattattcttcagtgtgtttgatttgtacagttttctgtgcagttttgtgaagttttggggccaatgttatatatctgttatataaaaataatttggaaattttcttcctttttaaaacctagtccttatttttattttattcaggcactgttttaacagatgatcaagtacctaccatgtgctattaacaataaaattgtaatggtagttaatagttccttagctcttaactatatatttgtcagtattctaagtacagttgattctcactgcttgaagtagatttgttctgtgacgtagcagtgaataataaattagctcttactggaattacaatgttaggttcctgtaagcctctggtcacaacatttttgttcacctatcaatacgtaacttttaaaaaatgtgtatttctgtttaaagacaacttatttaaaatatgtattgttgattcattaatattgaactcatgtcccacagcagtatgactcatgcctgaaggaagcttttgtaacacacatattttctccttaaggcatatcacaggcgtcttgtgcttaggaacactagatagcacttgggcattctaaatagccaaatcatcaacaaaaagcacaaaaatgagaacattgttgcacttaatagactgtgaaaagaataatcctttatagtatgagagcagaaacaaagcagagcatttgttcagtttcagctgataggatgcaaatcaggtgactcaaaattctcctcctcctgcacatttccacaaattattgccaaagtgctacgaatattgatgttgggatacaaataaattttattgagtagacaaattcataaatgcggaatctgtggatgaggattgatcgtatttctttgtatttaatatgtgttcatttattggtcatagcaatcctatgaggtaggtattataacacatactatacaataaagaggttaagttccttgtacagtgttgaacaatcaatgagtgtttgaggacaccaccaaagtagtataactgataccaagacatgttgtttacccttaggagctatttctatctaaaagcgttaaaggtgttttgctcaaataactaaatttaaggtagtttgaaataagtagcataagtgtagtgctaccaagatgtagtggatattcagagggaagattattttggagaccacggaaaggctttaggtgatggtttctaaatggaggcttttagaatcaataagatttcatcaagttggcttatgaggatgtaggagatgaactatttcagaaggtactcattttttacatcaaatacgttcaatgattctagtcttttgggaataggaaagtgatggtgaaggggcaacctctttagttttcagttttcgggattcatatactcactctatgaccattttttccagtactatttaaaaatttattctgcctttgtaatactgggaactaaagcatagcaccattaattggaagtcttaaagatgaacaaggcaatgttttaatgtaaatgtatgattttcttattatggaagaagaaaaaccaataatagattgacatttgtgcaataggactgcaaatagtgggtgttttgtgggagaaaaaattgtttcccaattttttgggaaaaattcaagtaaatattaaaaattgctgaaatacaaagattttcccccatatacaatacttttgtaatatactcatcatgtttttcaatgcatctcattagccatacctcttaactgcattgtaaaaaccaaaaaattaagagggaatattttaaaccaaatattctaacttcaataggcatcatagtgattatcatttcagatttggtgtccttgtaactgggctgatttatcataggtggtggatgtgtaaacttacctgtgtatgatcttgttgagggcaagaattgtggcttttcattttttgcgtttctgataaccagcaaagttcctatcacatagaaagccctcaggaaatgttactgcctacctaaatgaatactccaaaaccctttatgactaataatttctatgtaaatattgtagattgtgttgatcagtgttcttccattctatgtattaatgttttattttcagtgcaacactgtgagagtgatcaaagtgcaaaaatcctgtccttatatttagctttataatcagaaaacaccatactaatccataattttttttcacaccattggcctgcttttctttttattgttagttttgtttttattgtcagagaatgttaggtaatttcccagcataactttctcaagaatatatttcctcattactgcagtgaataactcagtgatgtgaaattagaagataacctattctgtttcagcaccagtgctttgacacatataacttgaaatgtgaatacgaattttgttttttcatgttaaaggattcaatttttcatcagttacttagatcttcataaaatctgaagttaggaaggaactttactaattattaagtcctattccattttaatgcctgcaatagtaaatgtttatttatgataaaactctgattaggtagtagggaaaattcaaggtcaaaagtacaaatttctaccaaactaaagaaagaatatgttaatatgacttgcaagcttggattcatatatattaaggaggggggtggaagatgacagttttaagaatcacatagtgttcaacaaaaagccaataaaaagtcctctctgtgccaagagttattgaacattttgaaataagagttataaattaattcatatatttcaatattatcaacatttgctcttggtcaagttcccctcctctcccaagaagagattgttttttgatccagtgttcaattttggttctctccgttaaacatatcaagcttacaagactaagataggtgtcactgagaatgtattttattaaaaacaattgaaaaaattgtattcttaaacatgggatcatatttggagtcttggtgtctatgaaatcctcctggtacaaaatttatatatggataaaaactaaaacagtaggattttgaaatcttttaacttttagattacaaaaagaatatgggaaatacagaaacacacaagaagcaagttttaaaatccctgtaatccctctatccagaaatagtaatattttgatgtatacattttcagggtttttttgtgtgtgtgtggtgtatgcacacacatctatactattttacaaactttgaatcataccgtacgaacacttttgttccttgcttttttcaactttgtgaacattttcctatgccaccaaaaatttagttcaaagtcatttaaaatggttatataattttccactgaatgcctgtatcataagtgatcttcagcagtaggacattagatatatagatatatccagttttcaattatgaactgttatgctaagtatttttatgtagctttttatacacaattcctatttttgtatggtgaagggaatgggattttaattcttatattgaatgtaccttgcaactatacttctgttttatcttagatattatcaaatgatatatttaaatatttatcttggtaaataaatacttgataagttaggtcacttttgtcacaaacaaaatttttaattttttattctatttctacataggtcagttgtagttgtaatgaaggaatcataattcctcaaatctaaaaattagaaagatggaaactgatatttcttcacatttaatagtttgattatacatcttatgattaatgttagtattatctgagacaaatatttcactgtcctttatgtaaagttctttatgtacattgtccactatgacaaaatatgtctcttaatttaggtcttggggaatgaacacttgtttttaatattagcctatcagagtaagcactttaattggattagctcatttaattctcataacattgcatgaactataggtagcattttatcctattttatacatgaggaattctgactcatagagtcctcatgtgtcatagagtcctttgtagagctgcaaagtataggcagtaatataggtggtagtatcatgattgatttgtaggaactctgttactggcacctgcatttgtaaacatctacagcaggaatgtatgccatttaatgcttttgttttttttcttctactctaattgaagattattttccaaagttattctcttaacaaaaattgaaaaatatactatatagaatatgtatatagatatttgtatgcatatgtatgtgtacgcattcgggtatgaatagaaatccacaaacctaactgaatagttgctttgcagacacttggttatgaaacactatccactgaccgaaatattttttctggctataattttggagtataattaaaatataaacttgtaagttcctctttttaaaaagatactttagaaaaacagattttactcttttcattagaaaaatattccaatatgtaacagtatatatactcagaaatgcatatgtctgatttaaaatgatttattctttagttttaagcctatgtatatattttaaaaataatttcttattttaggttcgggggtacatgtacagatttgttacatgggtatattgcatgatgctgaggtttgggatatagatgatcctgtcacccaggtactgagcataatatctgataggtagtttttcagcccatttccccctccctcccccctccctcctttagacaactctaaatgtctattgttctcatctttctgtccatatgtattccgttatttaggtcacgcttacaagtgagaacatacagtatttggttttctgttcctgtgttaattaggataatggcctccagccacatccatgttgctgcaaaggacacatttcagtctttttatggctgcgtagtattccatggtgtatatgtgccacatttgctttatcgactctaccatcgatgggcacctaggttgattccatatctttgcgatcgtgaatagtgatgcagtgaacatatcggtgcatatgtctttttttaggataatttatttgcctttgggtatatacccagtaatgggatggctgggtcaaacagtagtcctgttgtaagtttttgagacatctctcaactgctttccacagtggctgaactaacttgcattcccaccaagagtgtatatgtgttcccttttctccccaggcttgtcagcatttattattttttgactttttaataatcaccattctgactggtgtaagatggtatattgttgtagttttgatttgcatttctctgatgattagtgatgatgaacatttttcatttatttcttggccacttacaatgtcttcttttgataagtgtctatatcctttgccgattttttttttttttttttttgagacggagtctcactctgtcgcccagactggagtgcagtggcaggatctcagcttactgcaatctctgccccccaggttaacaccattttcctgcctcagcctcccgagtagctgggagtataggtgcctgccaccaagcccggctaattttttctattttgtttagtagagacggggtttcactgtgttagccaggatggtctcgatctcctgacctcttgatctgcccgcctcggcctcccaaagtgctgggattacaggtgtgagccaccgcacctggccccattttttaaaggagttatttgttttttgcttgttgatttaagtttcttatagattctggatattagacctttgtcagatgcatagtttgtgaatattttctcccattctctaggctgtttactgttgataatttatttttctgtgcagagctatttagtttaattaggtcccacttgtcaattttcatttttgttgcaattgcttttggggacttagtcataaattctttgccaaacctgatgtcaagaagtgcatttcctaggttttcttgtaggatttttgtagtttgaggtcttatctttacatctttaatccatcttgggttaatttttgtatgcggtgaaaggtagagactagcttcattcttctgcatgtggctagacagttatcccagcaccatttattgaacagggagtcctttcctcattgcttccttttgttgactttgttgaaaatcagatggttatgggtgtatggctttatttctgggttctttgttctgttccattggtctatgtgtctgtttttgtaccagtcccgtgctattttggttactatagccttatagtatagtttgaagtcaggtagtgttctttttgcttagtattgccttggcgatttgggatctgcttttgttccatgtgaatattagaataggcttttctaattttgcaaaaaatgatgttggtagtttgatagaaatagcattgaatttataaattgctttgaccagtatggccattttaacaatattgattcttccaattcatgggcatggaatatatttccatttatttgtcttgtctctcatttatttcagcagtgttttgtagttcttgtagagatctttcacctctttggttagatgtatgcataggtttttgctattggaaattggtgtgtgttcttgatttggctctcaggtagaatgtttttggtgtatagaagtgctattgatttttgtacattgattttgtatccttatttatcagttccaggagccttttggcagcatctttaatgttttctaggtatggaatcatatcatcactgaagagaggtaatatgacttcctttcctatttgaatgtattttatttctttcttttgtctgattattctgactagcactttcagtactatgttgaataggagtgttgagagtgggcagccttgtctcattctagttctcaaggagaatgactccggcttttgcccattcagtatgatgttggctgtgggtttttcattgtgagaatgaataataagaatgaataaggtttttcattcttattattgtgaggtatgttccttcgaagccttgtttgttgagggtttttatcataaagagatgttggattttgtagaaagctttttcttgtctattgagatgatcatatgctttttgtttttgattctgtttatgtggtgaatcacatttattgatgtgcatatgttgaaccaaccctgcatccaagaatacagcctactcgatcatggtgaattaactttttaatgtgctgctggattcatttcgctagtttttttttgtatttttgtgtttttttttgtttttttagggttttgtgtttgtgttcatttgggatattggcctgaagttttcttttttgttgtgtctttgccagattttggtatcaggataattctggccttgtagaatgagttagggagcagggggagtccctcctcctcaatttttttgaatattttcagtaggattggtgccagttcttatttgtatgcctggtagaattcagtgtgaatccttctagtccatggctttttttttgttggtaggtttttaattactgactcaaatttggaacttgttattggtcttttcaggttttcactttcttcctggttcaatctttggaggttgtgtgttcccataaatttatttcctctagatttcttatttgtgttcatagagatgttcataatagtctctgaggatgttttgtatttctgtgggatcagttgtaatgtcatctttgtcatttctgtttgtgcttatttggatcttccctttttctcctttgttaatctaatgagaagtctgtcaatcttttttattcttccgataaacctactcttctttccattgatcttttgtatggatttttgtgtcttaatttaattcagttctgatcttaattatttcttttcttttattagctttgtggttttttttttttttctagttcctctaggtacaaagttagattgttaatttgagatctttctaatttttgatgaatgcatttggcaccgtaaactttcctcttaacatgctgtagttccatcccaaagattttgttaatatgtggttctgtttttgtgaatttcgaatagttttttggtttctgccttcatttcattatttccccaaaacttattcaagagcaaattccttccttttcatgtatatgtgtagctttgagagatcttcttggtgttggtttttgtttttattgcactgtgatgtgagaacgtgcttaatatgattttgatttttttgaatttattgagacttgctttatgaccaaaacatttggttgatcttagaatatgtttcttatgcagatgagagaaatgtatattatgtgattttgggtggactattctatagatgtctattaggtcccattggtggactgtcaagattaagtctggaatttctttgttagttttcttcctcagtgatctgtctaatcctgtcactggggagttgacatctcccagtattattatgtggctattgaggtctttttctaggtcaaaaaggacttgttttatgaatctggatgctccaatgttgggtgtgtatagacttaaggtagttaagtcttcttgttgaatggaaccctttgccactatgtaatacccttgtttgcccttcttaattgttttcagtttaaagtctgccttatctgatattagaattgcaactcctgctctttattgttttccatttgtatggcagttctttttccctttaattttgaggctttcggtattgttacatgtgagatgcatcttcttgaagacagcagacagttggatcttgtctttttgtccagcttgccatcctatgccttttaagtgggtctttattccattcacattctgggttggcattgatatgtgaagttttgatacagaaattgtgtttttagctggttgttttgtagagttgtttgcatagctgctttatagtgtctatgggctatatgcttaattgtgtttttgtggtatcagatactgttcttttactttcatgtttagcactcccttatggactttttataaggctggtctagtggttacaaattcttagcatttgaagcttactttggtgggatatgaaattcttcattggaatttattctttttaaggctactgaaaattggtttccgatctcttctggcttgtaagtttctgctgagtagcccgctactatcctgatggggtttcctttataagtgacctgactcatctctctagctgcctttaagattttttctttaacatcggccttggtgaatctgatgtctgtgtgtcttggggatggtcatcttgtataaaactcacaagagttttctgtatttcttgaatttgcatgttgatatctctagtgagattggggtatttttcataaactgtatcttcaaatatgttttcaaagttgttttctctctcaggaatgccaatgaatcctaggtttggtctctatataatcccatatttttcagaaatttttttcatttttaaaatattcttttttccttatttttgtctaagttgaattgaaagaactaaactggtcttcaagctctgagcttcttttctcagcttagtctattctgctgtaaatgcttctgattgtactatgaagttcttgtagtgaatttttcaattttagaagttcagttcggttctttttaaaaatggctattttgtctttcagctcttggatagttctactggattcctttgattccttgaattggtttcacctttctcgtaaagccattgaacttccttgttatctagattctgaattgtctgtcatttcagtcatttcaatctggttaagatctattgctggggagcttctgcactcttttggaaagaagaggacagtgactttttgaattgttagagttcttttgctgattctttttcatctgagtgggctggtgttcctttaactgtggtataagttgagtatactcaattggcttcttttctaagtgttttcagagggccaagactctgtacaggatttttatttgtgagtagattctttccctgggtttcacagatgatgtatattggcagaatatttttggtgttgtaatttggtctgtcaaccagtagatggtgcttaagtataatggccgatagataggctttggctctgacttgtcgctcttttgtatttcagcaagtttagagcaccgctgtcttccctaggagccattcagtggcaggaactagccctcacattcggaaaccccacacaggtttcccagtttcctctctcttcaccctcagtgtctatgttgcctttgaactcttggtgtttcctctctgaagatttgttcaaagtatgtttgtttacttgatattttggtctctcttggtggcataggcacttcctggctgtgtctagtcagccatcttgtcttctgtgccctctcaaatccttcttcaagccagtatttttgttattgccattgaaatagacaataattgtcctaatgttaaggaaaaatttattcagtgatacttgttaaagtacattaaggaagactttatttagggtcattgcgatagatgtaaggaccactgacatgggattttacagtgagggagagagactcacaatacaacatgggcaagtgggaatttatagccaatgagaagggatggagagttagtagatagaaaattactaaaaggaaatatcagacttaaaaggtgattctggctaaactcacctagaaggatttttttctgaagacaggccaagataatcagacatctcctggggatggtggggaatgaagaatgcaattagatatccagggtgatcagttatcaatgtttttgctgtactgacttagcagagttttttgctaaaactgaattttacaagaaagtgcacagatgggcctaggagaaggcttggtcaagcaaataatcttcatcagttataaagcccttcacataataaaagcggctttaataattgtgaatttaaccttgcatagaaatttttcaaataagaaactaatatacttcaagaatatgcaggggattttttactagtaatttagttacatgtttccctctttttgttcgttagaagttacatgagggcagttatgacttctgttcactaaggttaattccattgaatacatacaaagcattattttcaaggccaaggccattggtagtggtggtaggggctggaacaaagaaatttattagataagatacccttaacactgatatacgtccattttgttttaagagcatttctgtagagacaaaaaagcatagaaaatatactcattgctatttggagtactttgtggtaaatctggaatccttgcttttgcttttatagtagttccataacaaggttatttttaaaacatcatccaaaactgaaatttcaacattaattggattggcacttctagttgtaaatcagcacttccagtcataaatcttgaggaaattggtatcagacctcatgatattctgttttcagtaggttagttttctcagcattattttgtgctaaggagaagaatctctgtgttttaaaccttttcaaagctatgtaacttgatatttgctcttttaaaatcttagccatcaaataccagctctactgcctgtgtccgtggctttccattctccctatcattgccctgttagggcatcattatcagttagagagacttgtattgcttccatactattcttcactgctagatgaaagtttctaaagtttagctcttatcctgtcattacaaacttgaatatgtagaataattccccattgactaatgtgttttctgtggcctaacatttctatcctttttgtgtgatttcatcccccatctacttttttagttttatattccatcgttcttttttcttcgcctaatacttaaactgttctctaaatagcccaacaccaatatgtgtatttatcattttctttacattgttttatttctctgaaatggcctttcttcagttttgcatgcctaaactctaccaaatgagcccaattgtaatgacttttccatgaaggccttcaaaccaagttatcacttgtttttctttgcttttattattttttttaacttttaaaaatgttttcttctaacttctttttaatttttttgtatttatttatttattgccctcaaacattctcctatccagttattgttcttttataaagctcatctctccttccctcccacatagttgctctgcatactttctactcctcttatttaattttttgttttggaaaatttagggactatacaaaataaacacaatgaagtttatagtatgatgtatcaccatgtacccatcactcagaaacaagttatcgttatgacattcttgtttcgtttttgcattcctccacttctcaccatccactcagtcattggtaattctttaagataaaatttacataattcaaattcacaaatctgagctggacaattacgacaattaagtaaacacatgaaacccaatccccctttcaaagtatagatagaatgtttctttctctccagaaactttctattgcctctttccagtcagtcttcccaccctcataggacggctttaacttttcttcaccttttgttttacctttcttgttctttccatgtaaatggaattacactctgtgtaagtcttcttttgctcaacatgtttctgagatttatctcttattattgcttggaacaatagtccattccattttattacttagtactattccattctgtgactgttttataatttgtatatccatttggtttatggactttttgattattttcagtttttagctattatgagtaaagctgctgtgaatatatacatgtaagcctttttgtggatattactgattcttgttattcactctagttatgttctgtaaagtcaccgtggacactgaattattgaatactgaaccattgcttctaggggaaatatagggttaggttcttgtgatcctctggtcacaacatttttgtgaactgatcaacatataattttgttttatgtgtgtttctgtttaaaggcaccttatttactatatattgttgtttcattaacattgaattcacagccaacagcactagaactgatgtctgaataaactttatctaaaatgtattttctccttaaggcacaccacagccttcttgcactcaggaatactacacagcacttcagtattcttcatggcaccattctacacaacaaaatcaccaacaaaatgcatcacaacttgaaaaacatggcaaaaaatagatcatgaaaaggacgcttgtttacagtatgattgccaaaacaagagagagtattggtatgttccacatcagctgagaatgtacctgtctgctgactcaaatttttgctgctccgtacacatctacaaattattgtgaaagagcttcaagtattgattttggggttactaacaaattttagttaggaggtgaattcacaaatgtgcaatctgtgaataatgaagattgtatatgttcttatttttcttggatagatattagtattcacaaatgtgcaatctgtgaataatgaagattgtatatgttcttatttttcttggataaatattagtataattgatgggttaaatagcatccatactttataagatactgccaagcctttttctaattgtagttgcaccattttaaattcttattattaatgcataagcattccagttgtttcatatattcatcaacatttgatattatcagtctttcattttactcattgtagcactcatttgatttttccttgctgtagttatgtgtttatgtcttatctctcccggctggaaattttttggcggcagtatataatttgtatttgtatttgccaaactaatattttggagagatactatacctttgttgttatgtgcacaaacgttggagctagaatgcctgtggtcaaagctcaactctcccacttacaaattttgaggccgtagataatgaaaataacataacagtaaaataactttttataactatattaatttgggtctctcaacaaacaattattattagtagtttggaaatcaagcctttttgaggttagatagcttgtcccagatcaaacgagtaagaggtaccagaacaagatttcaaattcaggtctaacttactccaaagccagtgctcttaactactgcacaatacagtattgccgcctaaatcccactttaaaacctaccatatgtcattaaattaatgctcatcatcctctattaagatgtaaatgatattgaattaatttaaaacttattcacttattgtaatagattatatactttttgcttttctacatgcaaaatgatgttatttgatattaatagtaattatattctttcactccaaaactttagcttttttttttttttgcctattgtgatgtctagcaccaccagttcaaatttgaatagaaatgataatagtgcatattttttgtctcgtttccaatttaaaagggaaagtttttaatatttcatgattaaacttcaagatgttttatgtattcttttttatgatttttttctttatttcttgtaaaaaaatgggatacatatgcagaacctgcagatttgttacataggtatacatgtgccatggtggtttgctgcacatattgacccatcctctaagttccttcccctaaccgctcatcacccaacaggtcctggtgtttgttattctcctctctgggtccatgtgttctcactgttcaactcccacttatgagtgagaacgtgcagtgtttggtttctgttcctgtgttagtttgctgataattatggcttccagcttcattcatgtccctgcaaaagacatgatctcattcttttttatggctgcatagtgttccatggtgtatacgtatcacattttctttatccagtctatcattggcatttgggttggttccgtgtctttgctattgtaaatagtgctgcaataaacatacctgtgcatgtgtctttatagtagaatgatttataatcctttgggtatatacccagtgatgggattgctgggtcaaatggtatttctggttctagatccttgagaaatggccatactgccttccacaatggttgaactgatttacattcccaccagcagagtaaaagcgttcctatttctccacagcctcgccagcatctattgtttcttgactttttaataattgccgttctgactggcatgagatggtatctcattgtggttttgatttgcatttctctgatggtcagtggtgttgagcttttttttttttttttgtatgtttgttggccatgtaaatgtcttcttttgagaagtgtctgttcatatcttttgcctactttttgatggggttatttttttcttgtaaatttgtttaagttccttgtagattctggatattagacctttgtccaatgtgtagattgcaaaaattttctcccattctgtaggttgcctattcattctgatgatagtttcttttgctgtgcagaagctctttagtttaattagatcccatttgtcaattttgatttttgttgcagttgcttttggcattttcatcatgaagtctttgcccatgcctgtgtcctgaatgatattgcctaggttttcttgtaggttttttttttatggttttgggttttacatttaagtctttaatccatcttgagttaatttttgtgtaaggtgtaaggaagggtccagtttcagttttctgcatatggctagcctttttcccaggaccatttattgaatagggaatcctttccccattgcttgtttttgtcaggtttgttgaagatcagatggttgtagatgtgtggtgttatttctgagatctctgttctgttccatatatgcctgttttggtaccagtaccatgctgttttgattactgtagtatagcttgaactcaagtagtatgatgcctccagctttgttctttttgctcaggattgtcttggctatatgggttcttctttgattccatatgaaatttaaagattttctaattctatgaagaatgtcaatgatagtttgatgggaataacattgaatctataaattacttcgggcagtctgtcctttcgggttttcagcattttttcattgattctttctcatctttgtgagtttgtccagtttgatctttgaggctgctgacccatggatgggtcagctgttgttgttgctttctgtttctttgtgttttgttgttgttgttgttgttgttgtttcagttgtcaggtccctcttctgtagggccactgcaatttgctgggggttcacttcaggccctatacatgtggtttgctcccgtgcctggagatgtcactcaaggaggctgcagaacagcaaagatgggtgcctgctccttcttctgggatctctgaccttgaggggcaccagcctatgccagtaggattgctcctgtatagggtgtctgacaacccctgttggagggtctcacccagttaggggcatggggaacaggaccccttttttttttagacggagtctcgctatgttgtcaccaggctggagtgcagtggtgccatcttggctcactgcaacctctgcctcccaggttcaagcaattcttctgccgcagtctcccaagtagctgggattacaagcgtgtgccaccacgcccagctaatttttgtatttttagtagagacagggtttcaccatgttggccagaatggtcttgatctcctgacctcgtgatctgcctgcctcggcctcccaaagtgctgggattacaggcgtgagccaccatctgcgcccggctgaacaggacccatttaacgaagcactttgactgtccattggtggaggggttatgctttacttgggggaagcacgttgtctgggcttcccggattcctcagaaccaccaggaggaaaggctaagtttgctggtctgcagagactgctgccacccttttctctaggggctcaggcccctaccccaaggagctgaaatggcttagacagcagacagctgtagctgtggtgctggttgcccctcctgtagggagctcagtaggcttcagcagattccagctgaaaggctattgagaatctgcagagctctggggttgggacgctagggcccagtggcatgggttcgcaagttggatcttctgatccatgggttgcgcagttctgtggaaaaaccacggtttccccagctgggtggaatgctcactcactgcctcccttggctatggggagggtgttcccctgcccctgtggctctcaggtgggctgccataccacactgttcttccttcctcttcatggaccacacaagctttctggtcagttctgatgagataacctggataccttaattgctggtgagggattcacagtcttattatgattcttttcaatgggagcctccgaacatggctgtttctactctgccatctagatagtcttaatcagattaaggaatttccctttttcctaggtcgctgagagttttttttcataaatggatattgaattttattatttttttaattattgaaattatagtttattttcttctttgaaagagaaatacatgtgtagtgaattacattgattgcattcttgaaatattaaaccttccatgtattcatttcaatcacttagctgagatatattttgtaataactggctttaatgtgctaattttgtgcttgggactttcacataagtgattatgaaagagattatcttctaattttgtttttggcttgtgttgatatcaaggttattttgggagggctaacatttttctgttttctggaagagtttctaaaagcttggttttatttcttcagtatatataactggtggtatttttattcttttcaatcttacatttttttcttgtgttattgtagtggctaggatctctagtacaatattgaatagaagtggtttgagtgaatatccttggttagttgagaattattaggatgatagccttcagtactgtaatgtcataagcattttaagtgctaggtgttatttattggctacttttattcataaaagttccacatgttgtccaggctggtctcgaactcctgacctcaggtgatccacctgtgtctacctcccaaagtgctaggattactggtgtgagctactgcgcccggccgagtttattttttaatcatacatttgtgttgaatttttaaatcaaatttatctattgaaaaggttatatagttttatccatcagtctgtgtagagatggtaaaatgttaatccaatattgcatttgagggatagtatcctttctgtatattgctgtattcattttctgtttttaaaaggatttttgcatctctactcatggaaaatactggtcagggtctatacttctgttttcatttaatgtccttggtcatttggtttcaggattagctcacttcataaagtaagttgagaatttaaatagttgacagagtttaccagtcatattatctgtggctagaatcctgggttggagtgtgttatttatgtttctgttggtggtgggagggtagacatgacatgcaataaacggcacattttaaatttatggttttatgtattattcattgtgaaattgtaactacatggaagatggtgaacctatccatcacactctacaagtttcccctcaatttttttgtgattctgggtaatctttcccttttgttctcccttatctccatctatcaccaaactgtattttctttttcccataatgatcagtttgcattttctagagctttatgtaaatagatagttacaagagaaagtcatttttttctggcttccttcactcagcgtaagtatttggaggtttttcatataaagtttattcttttttgttgttcattcatattccattatatgaatatattcacttgatcatagacatttggttgtttctagcttttggctattacaaataaaatgtacatgtgtaagtctttgtatagacatttacttttttattcatttcagtaaatacctgtgaatgaaatggctagatcattgggtagctgtatgtttaactttttaagaaactgctaaattgtttcccaaagtggttgttctcattaacagtgtaggaaggttcagttttttcagatccttacccacatttgttatgtttggtcttttaaattttaaccactgtaaaaggtatctagttgtatcttattataattttaatttgcattttcctgttgactagtaatgttgaagatattctcaggtttttttttttttaccatatgtatatcttttttttggtgaactgtctattcaaacgttttatccttttatgaaattgagttttttccttattgttgagatttgagagttctttatatattcagaatgcaagtaagacatatgcttgtaaatatttacacacagtctttgacatcttttcattctcatagcagtgtctttcacatctatcttgagacttattcctaagcatttttatattttacatgttattttaattggcattttaaaatgtttcatttaattttattttccatttgttcattggtagtatgtagaaatacaattgatttttgtatattgacctggtattctgcaactatgctaaacatacttatagttctagcagcttttgtgtagttttggggagcaaatagggtcctgatagagagatggctttatggaagaagtacaaggacccttacgggccaggttaggagatgtaaggagattcctcaggatttgatcgccagtgtttttgtctaagtgttggatatatggagtgggtgtggagggaattaccccactgccctacctgttaatgaatgtttagaggttaggcagagggttcaggcaagctgcctaaatggttctcggttgttgttcacacttacccatgtgatagaaaaagtgaaggttatcctgacagtgtggtaataagtcctgtgcctctactcaaaaggcagtattgctatggctgcataaaggatccctgaggctgaagtaacatatgtcagcaatgaggatacaggcctttaggtaaactaatgtattagtccattttcaaactgctgataaagacatacctgagactgggcaatttacaaaagaaagagatttaatggacttacagtttgatatggctggagaggcctcacaatgatggcagaaggcaaggaggagcaagtcacatggatcatggcaggcaaagagtgaacctgtgtagaaaaactcccatttttaaaaccatcagacctcatgagaactcattcattatcatgagaacagcacgggaaataccttcctccccaataattctgtcacctcccaccaggttcttcccatgacacgtgggaattgtaggagttacaattcaagatgagatttggcagaggggacacagccaaaccatatcagtctatctctgaccgctctcaaatctcatatcctcacatttcaaaaccagtcatgccttcccaacagtcccccaaagttttaactcatttcagctttaactcaaaagtccacagtccaaagtctcacctgagacaaggcaagtcccttctgcctataagcctgtaaaatcagaagcaacttagttacttcctagatacaatggaggtacaggcattgggtaaatacaaccattccaaatgggagaaattggccaaaacaaaggggctacaggccccatgccagtcccaaatccagcagggctatcaaatctttttttttgagagagagagtctaactctgtcgcccaggctggagtgcactggcgtgatcttggctcactgcaagctctgcctcccgggttcacgccattctcctgcctcagcctcctgagcagctgggactacaagcatccaccaccaagcccagccaatttttttttttttttttgtatttttagtagagatggggtttcactgtgttagccagggtggtctcgatttcctgacctcatgatccgcctgcctcggcctcccaaagtgctgggattacaggcatgagccactgcacccagccaatttttttttttcgtatttgtagtagagatgggatttcaccatgttagccaggatggtctctatctcctgacctcgtgatccacctgcctcggcctcccaaagtgctgggattacagatgtgagccacagtgcctggccagggctgtcaaatcttttttttttttttgagacagagtctccctctgtcgcccaggctagagtgcaatggcacgatctcagctcactgccagctccaccccctgggttcacaccattctcctgcctcagtctcctgagtagctgggactacaggcacccgccaccatgcccagctaattttttgtattttagtagagacggggtttcaccatgttagccaggatggtctcgatctcctgaccttgtgatccaccgcctcggcctcccaaaatgctgggattacaggcgtgagccaccgcacccagccggctgtgaaatcttaaagctccaaaatgatctcctttgactccatatctcatgtccgggtcatgctgatgcaagaggtgggttctcatggtctgggcagctccacccctgtgtctctgcaggatacagcctccatcccagctgctttcattggctagtagtgactgtctgtggcttttccaggcacacagtgctgtcggtggatctgccattatggggtctggaggatggtggccctttctcacagttccactaggttggagccccagtaggaactccatgtgggtgattcaaccccacatttcttttctgcactgccctagcagaggttcttcatgagcgccccacccctgcagcaaacttctgcctggacatccaggtatttacgtacatcctgtgaaatccaggtggaggctcccaaacctcagttcttgacttctatgcacttgcaggctcaacaccacatgaaagctgccaaggcctggggcttgaaccctctgaacgcatggcctgagcttatactggcccctttcagtcatggctggagcagctgggatgcagggcaccacctttctggactgcacacaccatggggacccttggcccggcccacaaaaccatgttttcctcctaggcctttgagcctgtgatgggaggggctgccatgaagacctgtgacatgtcctggagacattttccccattgtctaggggattaacattcagctcctcattacttttgcaaatttctgcatccggcttgaatttctcctcagaaaatgggattttcttttctttcgcattgtcaggctacaagttttccaaacttttatgctctgtttcccttttaaaactgaatgcctttaacagcacccaagtcatgtcttgaatgctttactgcttagaaatttcttccatcagataccctaaatcatctctctcaagttcaaagttccacagatctctggggcaggggcaaaaagctgccagtctctttgccaaaacatagcaagagtcacctttgctccagtttccaacaagttcctcatctccttgtgagaccacctcagcctgtacctttttgttcatatcactatcagcatttttgtcaaagccattcaacaaatctctaggaagttccaaactttcccagattttcctgtcttcttctgagccctccaaactgtcccaatctctgcctgttatccagttccaaactcgcttccacattttcatgtatgttttcagcagcaccccattctactggtaccaatttactgtattaatccattttcatgctgctgataaagacatacctgagactgggcaatttataaaagaaagaggtttaatggacttacagttcttcatgactggggaggcctcacaatcatggcagaaggcaaagaggagcttgtatggcagtggacaaagtcacctcttatatggcagtggacaaagagagaacttgtgcagggaaactcccatttttaaaacaatcagatttcatgagactcattcactataatgaggacagcacacgaaagacccacccccataattcaatcacctccgaccaggttcctcccaagacatgtgggaattgtaggagttacaattgaggatgagatttgggtggggacacagccaaaccatatcagccagcaaccttggaagttagtttgcttgatcatgtgactggctgctcaaagctgaaagcaaatacaaagcctactaaaaatacaaaaattggctgggtgtggtgatgtgcacctgtagtcccagttacttgggatgctgaggcacgagaatcacttgaacccaggagatggaggttgcaataagctgagattgtgccactgtgctccagcctgtgtgttggagtgagactctgtttcaaaaaaaaaaaaaaaaaaaaagcaaagtcatgcttattggtgtatgtgccactttctcagtttgtgtcctctcatcctgccatcccccctttaccctgacatcagctgcctcaaggagaaaactaagtgccctggagaaattttaaagaagaggagggacctgaactttcatggctttattggatacgggttaccagatcaccatccttggtcccatgtgggaagggaaagctgaacccagggcttgccaaaagggctgaagatgaaggggaagagctaccgtaatatttcacctccttgagcgaggttgctttccaaatatcagaagctacatgagggaggaaacaactgcagggtttggacaccaaccctggagcgagcagccaaaggagagaaaaagtctacacagtgctcctcatgtccttatcgtccttttccactcccagtactctctgctccccagattttcagcctggagatattacaggcattttgtggccattgtaagctgtcacataccaacactctgtagattgtcaaatttatgaatgtaccatttcataatttctggaaacatgttttctcttagtacagttcattaatatggcataagacatgtttactggcagactcaaatatctttatttcctctgtaataagaagaactaaattactatagcccttgacatgtgcctgtgagacaccttggtccgtgttttagtataggatctgtatctgaattcaactgctagatttgaggaaagtttaccaagggatatgatgttaaattgaccttgtgggtaaagcccttgggctgatttcatgtacaaagtttactctattaaataaacggttgggtctggttctctgatagcttaagtgaaaagctaatggtgtccactgggtggcagccaccctccagctccaaggacagtctaaaagattaactggtaagggctgatccagcacaatgggctgaattaaaagccattttcttggaccaggggttgagagacttcagtctgtgtgccaaatttggctacaatctgtttttctattgctcttagcttgggaggatttttacattttttaaagcattgggggaaaaagaatacacacttgagactgtatggggcttgcaaagccaaaactatttactatctgctcttttcagaaaacaagttttctaactcctaccttagacagtattcctaaggattaagttatgatatctttttcctgagtgttgggctcttgccagttacttcacttgggtagtaatagtagattacagagacacccctccatggagacataagctatgaactgccatttggaagggctgggtcactcatgttgatgcctagagtaagtgcctgtttttacaattagtctgaatggaatcaagctgctggtcaagcctgcacttgttagtgcctttcaatctggaaacttgtctttttttttcttcttcttctttttgaggcagggtcttgccctgtcaccaggttgcagtgccgtggtacgagatggtcactatagccttgacctcccagtctcaagcaatcctctctccttagcctcccatgtaactggaactacaaacacgcaccaccacacctaattttataatttttttgtagagacagggtctcactatgttgccaagggtctcgaactcctgggctcaagtgatcctcctgccttggtctcccagagtgctaggattacactcatgggccaccatgcccggccattgtctttcatttttggaaaattttcatatattatttacttgatcagcccctcccttcttttttcttgttttgtttttctggaatttctgtttggatgttagagtttctcaatttcccccccaattttcttaacttttctttcctattgtctgccttttgtcctacttcttggtagtttcttttccctacctttgttttcaaaccttctaatacagtttatgtttcatttacatttttaaattccaagaattcttcctccaatgcctgtttgtaataataccctgttcttatgtcaagtacacaatttgtcagtctccatctaataaaatcacagtgtggttttttaaagactattctgtttcttgcattgtttattcccaaatcctttttgtttgttactgcgtttagtttaatctgtgctatttatgatgcaagctttcttcacatatcttgtgattcttatatgcagatttatatttaatagggaggcaataaatatgagttggcttttctatgtaataggacaggccttataacccagtggacttcattgtagggttattaggtaggtatccagaggtactcataaatgtcactatcatagggcattttctcttgggctgtttagttccttctgagaaaaacttttaacttcctacctgaatggtgtaaacttgtctggcagtgttattttagccatgtgatggagaagtctgggattctcaccatttagtatgttaactttcaattaatacccctgtttttcataaggtgcttctcctctaccatctattatgcttagataattatagagaaccagaatctgtttagcaagggctgaaatttatgttctatcttatagataggaaaagtaaatggagcctaaaatgcagatataagtgcataaaagttattctgttaattcttttctctatattaaatatgatgtttctccaaattttgatgttttatttgaagccataataaactttgttctaaggcattcacattcatttaagtaattggatttattttatgaaacattctcattctgatcaaaattttcaccgaaggatgaagatttaacagaagtgctaatagtaatatatttgagttgaactttaggtaacatgttagaaagaagataacttaatattttgaggatattttccatttaaataaaaacagcaagaaccaatgtattaaattgaatgctgtggttctagttattgttttttggatgtatttaataatttctaatgtctttttggcttaacactggacctcacagttaggtaatgaggatggaagtagtatatttgcctttctatgaatgccataccataagatttttcaggatatttttgtagttaagaagatagcatatgagtagaatgatagataattcaatttgaggtacttgtaactgaattggattcatgtctactggagatgagattctcatggaaaatcaacagctgataatgtaaatgaagaactttgtgatcctacaaattataaaacagtgcagttatcatttaggttttaggttttgactgccagagatttgctttatagagatttgctttattgagatttgctttattgggaatgcctatatttcagtgttagaattattataattgactatagatcttttatataaaatattctcatttgggggaatagaggatagatagcaatatatgactcttaccttaaaattggtataaatctaatgaatacccatataattactattgaacttaagaaataaaacattacagataaaatggaagtcatctgtgaatctcttacctataccattcacctttatcattctcttcccagtagtaacccttattctgaatttgttgttttatattccctgcttgtttcacaattttactctttttctcacatccagaataaatgtagtcttgttttacgtatcttaaactatatttgaatagtatcaaactggaacatgcttccccccgcccccaacattgtttctcagatacattcgttgatggatctagttctttatttcaactgttgaagagtatttcattgcatgaatgtatcataatttattattaattcctctattgcttgtttcataatttttactcttgtgaacagtgcttcaaagaatcatgaataggtgaaaatttccttgaggtatgtatctaggtatagaatggccagcatatagtatataaacttttaaacattttactaatttttttgaatcgttctttaaagtagtcccatcagtttactgtttcatgagaaatgtatgaggtttcacaaagacttgatattgttagacttaaagtactgataatctgatgtacgtagattatattacagtgaattattttgcgttttttggtattaggatatttttaaaatgaagagcaaattatttgttctctctttgtctgctttcactaataatggtgtgcttctaattacctagtctgttttcccattagttcatagttttattaaagaaatctctcttctacctactgttagatacaccaccccattatataaagttcatttggttaggtttattttgtgctaagcaactaaatagaaaatggaatgtttttattgtctttttgtgccctaaaaagagtcagtcagctcttggtaggggaaagaattaagcctgttgtctaggtgataacagtagaataatgcagtgagggagtgaaaaatcagggatctaagttgcagaaaattcagttactaacagcaattaattgaataaagaaaatgcaaagttatgaaaaacaccagtactttgattatattatccttgtagaatacagtcattcattgcttaatgatggggatgtgttctgagaaatgcattgttaggcaattttgtcatttacaaacatcatgaaatatgcttacacaaacctaggtggtatagcctactacccacctaggctgtatggcataggctattgctgtcaggctacaaactatacaggatgttactgtactgaatgaatattgtaggcagttataacacaatggcaaatatttatatatctaaacatagaaaaatgctgtaaatatgtggtataaaagataaaaagtgatataaggcacttaccatgaatggagcttgcaggactggaggttgcttcgggtaggtgagtgagtgaatggtgaaggcctaggactttaccatacaccactgtagagtttttaaacaatgtatacttaactacactaattatattaaaagatatttttctttcttcaataataaatttactttagcttactttaatttttttagtttataaacttcttgactcttttgtaataatgcttagcttaaaacataaacatattgtacaaaaatgttttatttctggcaggcatgtggctcacagctgcaatcccagtgctttgggagggtgaagcaggaagattgcttaatcccaggagtttaaaaccagcatggggaagataattacaccttatctatacaaaaaaataatttaaaaaatgagccaggtgtgttggtgtacccctatagtcccagccactctggaggctaaggaggaaagattgcttgagcacaggagtttcaggttgcagtgaactctgatctcaccactgcactccatccagcctgggagacagagtaagaccccatctcaaaaaaaaatacatatatatatatataaatatatatttatatacatatataaatatgtatataaatatatatttatatacatatataaatatgtatataaatatatatatacatatataaatatgtatataaatatatatttatatacatatataaatatgtatataaatataaaacacacgtgtgtgtttcttatcttcagtctgtaagtttcttttctattttatccttttactttgtaaacttctttgttaaaaattaagacacaaacattcattagtctaggcctacacagggtcaggatcatcagtatcactgtcttccacctccttatcttgtctcactaaataacacctgtggagctgtcatcttctatgttaacaacacctttttctgaaatactgcctgaaggaactgcctgaggctgttttagtgtcaacttttttttaataagtaggggtacaccctaaaataatgatgtaaagcatagtatagtaaatgcaaaaaccagtaacataatcatttattatcattatcaagtgttatgtagtgtacataattgtgctatagtttttttatatgattgccactgcagtaggtttgtttatcccagcatcaccacagtcatgtaggaatgccttttactgctactttatgatggctatgacatcactatttgataggaatttttcagctccattataatgttatggactcaccatcatatatgcagtttattattgactgaaatatcattatgcagtgcatgacttcaattatactctatttaatctcccttctaggtcctgatttttaaggtaatttgaaatcattttttctgcctttctctgttactatctgaattgcttcctaagaagattaaataagagtaaggactttttcctggatgttaaccgtaacattagcatgttattttaattaaattggtttattaaatataatgacatagttaaatattgatgggggaagggagtagtctgtattacatccagaggagggatggttctactggaacttactggacagctagatgacaatatgaagatctaaggaatggggaagagaagaaagggataagataagagatgctgaaaggtattcttaatagacttaagtattttacttgggttatgctcttttctataattttcactggctcattagaagtagaaaagtttataagtagagaatttaatagaagaaaggcaggtaatgttgttgagatgtgtggggtcagatctatcctgaaataaaaagaatctgatcacatttccttagtgatttaaaatagaaaaacagggtgatagaaataaatgtcagaagcagaaattggaagaaataaagaatggcaagtttaatgttggcaattggtcatcagaatcctattgttgttgttgttattttttttttaagatggagtcgcccaggctgtggtgcagtggcgcgatctcagctcactggaagctccacctccctggttcatgccattctcctgcatcagtctcctgagtagctgggactacaggtgcccatcaccacacctggctaattttttgtattttttagtggaaacggagtttcactgtgttagccaggatggtctcgatctcctgacctcgtgatccgcctgcctcggcctcccaaagtgctgagattacaggcgtgagccactgcgcccagccatcagaatcctattttaacttatatttgtagattttcttgtcatgccagttaattacatagtctgtttctggtatttcctatgttgacttgatcatagctgtcactaacaaatacttttatcttcgacctatttaatgtgttttttttttcttacattttatggagtgtttacatgatcccctcttacttaactttagtggactgtcaggattattgtcccatgcccattttgcctgtagtttttctttaattgcagtcgttctttttttttgtttttgtttttgtttgttttttttgagacggagtcttgctctgtcgcccaggctggagtgcagtggtgctgtcggctcactgtaacctccacctcttgggttcaagcgagtcttcgtcctcagcctcctgagtagctgggataacaggcactcaccaccatgcctggctaatttttgtattttcaatagagacgaggtttcaccatgttggtcgggctggtcttgaactcctgacctcatgatccacccacctcggcctcccaaagtgctgggattacaggcatgagccactgcgcccggccggcacagtcgtcctttttaacagtgtttattttagctcaaaacaaatgtatttattattcttgagtttcctttattattgctgaataacttcaagtaatttttgttttttcctcactaggtctttctttgcaaatattacttttagataagtttgtatgagtcttaaaaagctctttctatgtataattaaaacaagatagcacctttattttgactatgtaaataattgtatctcatagattcaaagctagcttgtgtttgcagaagacagtattgccatagtgaagtaattttaaagtaaaatttgacaacaactagactaggtctgtaggaggattttttattgtattaaggctcatactgtgctaagtataatattttttattttttgatgaattatattagaaactaatttttatttgtagttctactttatatattttctatattagagaaatttcccactaaagaatcttcattaacatttttctgcaagtgatttccgaatgtttctaaccctaaacagtttcctatcattgcttctaaacatttttttctttttaaatcttgctattgcttcgaattcaggttgtttgaactctttattatccttctcttctgctaccttgttcccaatccaactaccctacctaatttcctattcgtatcattggtattattatttttctggtcaataaaataaatgtttgttgaaatttacattttaatcctgctagctctgagatctttgggaaataatgtcttcaagtttcattatcttgtctataaagaggggagagcaatgtttcatgacatgagattggcaaaatgattagattaaatgagatagtgtaagtgatgcacttggtacagtgcctgtctcttagcaaatgatagttcccctgtaggtatatgggatcaaaagctcatagttgtttttgacacctttcttctctaaaccctctgtattgcattttccatcaaattttgataatcccagctttataatgttcacatatatttgattttattgtattctcttagctgaaatattgatccaggcgcagatttgctgtacattaatgtaaaggttgacttccttacagatttgtctccatactttcctttcttacaatacattcttttttttttttttttttttttgggatggagttttgccctgtcacccaggcagagtgcagtggtgtgctctcggctcactgcaacctcctcctcccaggttcaagtgattcttctgcctcagcctcctgagtagctgggactgcaggtctgcgccaccacaccctgctaatttttgtatttttagtagagacggggtttcaccttgttggccaggctggtctccaacttctgacctcgtgatccgcctgcctgggcctaccaaagtgctggaattacaggtgtgagccaccgcacccggccccttataatacattctgcgtattccagtcagatgactttttctaacattccacgtttgttatgccatgtatctgctaagaaagaacaacaacaaaaaaggaattgttccttattgtcttacttcacttagtggaaccatccattccatccagtttggtctgcttactcaaagactattaccattcttctttctgtgcccttgctcaggccaggccttcttcacaacgtcattcgaagtgtacaatgtttcttgcacttatttccaatttaattgtgtactgccttgtgtagttcttatattactgtcttctgtcaatattaaatttaatcatatactgtcacatcatagttttgttttattttctactgtaatttaactttctgattaggccattttcttttctaaggtataaattctcctatacttcttatcttctttgaattcattctgttattctatgtatgtacttcaatttcttataagaaaaacagcacaatttgagtttgaaatttacttttaaaattataattaatgaacatagtactttattaaggaatcaacaaaaagtgttttattcaactggcaggcaaacttttctatttccataaattagttttaccaaacttcaaccttatataaatggaattttgcattttactgtatactctttctgtttggcttcattttagttttttgagatttatctatattgtgctgtataaaataagtactgcattcttttttattgctgaatagtattccagtgtatgaggattttacaattttatacattctcagtttaagggacagctagatttttaatgattttttgctgttattaatagggttgcagtgaatatgcctgtacatatatttttgggtacgtatgttttcatttcttttgaataaatacttaagtgtgacttgctggattgtatggtaagttaaacgtctttgtccagactgtcacaaaggtggtgctgtactcttcccattgtatcccatcagattgcttattattttgggtttctctcattactaatgatgtttaaagatttaaatgtatgacttgagactgtcaaactactaaaagaaaacattgcaggatgctttaagacattggtttgggaaaagatttagtttctgggttttctttctgttttttttttttttaataatatctatctctgtttaatttctcattcaggtcatgaattgttttcctggttttaaaattatttatatgtgttcttttgtatcttgtagagtttccttaggatcattattataaactcattttcaggcatttgacatattttcttttctttggggtctgttactggagaattattgtgttgttttggaggtgtcatgtttccctgccttttcatatttcttgttcccttacattgatatttgcacatctggtgtaactgtcacttctaattttatggagtagcttctgtaaggaaagactttttcctgtagatgtagctgtaatgtttgttgggtagaatgttttcgcattggttctcggtgattgcaatggtgtagtttttgtatgatacttcacctgtaatcaacaactgcagtgtctgtgattcccttaatggcttagcctgcagttgtttgtggagattgtggtgagactttggtggggaaggggtcatcagccagactgatcctcaggcctctaggtgtcacgtgggggcaccaacagtggtggttgtgtgtcctgggtgagccaatcttaaggtcctaggtggggagccagtggtagcagtgtcaggcccttcctgattggccctcgcatccctgggccgggctacacagattctggtagtggcactggtgggttggtcttcaggtgcccaggcatcagtgtgtgttggtgactggccagtctggctggtccccaggctcctgggtgaggcgcacaggaaccagctataagattgctttttttaaaattaaatattaagagcctttcttaagctgtgtggtgtggctttcttcactcctgctgctgatttaccaccattgtttattagattgggacaagatcactaactactattagacatgtaccccatttttactgtatattgctgtataacaatggtggcttaaaatagcaaaagtttattatctctttcagttatgtaggtggactggatgtaggttgatagatttgtttccatctctgatgtggtgtctgctggatagctggggcatctaaaatagccttactcacatggttagcagttggtgcttgttgccagctagaactcagctggagctgttgacaatgttcacatgttctcttgaacatggactttgtatgattgtttgggctgtctcactgcatgggacctagattctaaacagaagtgttataggtgaccaattggtagctgcagttttcttaagacaaatccttagatgttacactgccacattccattggtcaaaagaggtcatagagccaattcagatttaacagataggggaaagtcatgctgaaaaagaacacgtgggatgagataatgttgtggcccttttaagaaatataatttacttaatttgaaatttcctgtgaaattttgaaacttactttgaaactttgaaagattattagcaattttccaaatagtttaacttcattattaagtgtattcaaacttcacagaagccagtatacaaagggaaatcccagatttaagtgatgagtttatataccattgtttaactggtcctctgagtgatcctgcatgattgataatccacactactgtctctctagacagaagacagactcagtaaggaaatgttttaagtgggtgtaattctgatatctgccattacaaaaacaacgacgaaaaagcaaatatttcttcttatttcttatcagcaaaagaaaggaatgaggtgtactggaattcctagcactgtgatactcaaaatgtcagtttttaaggcttttgtgttttagggaaacactcaaagaaaaaatttatgtgagttttcaggctgtttacttacattcttaagaaaaagtgattttaggccgggcacggtggctcacacctgtaatcccagcactttgggaggctgaggcaggcagatcataaggtcaggagatcgagaccatcctggctaacacggtgaaactccgtctctactaaagaaaaaaaaagaaaaagaaaaagtgattttagatcttttcaaagatttgtttaatgtgtatttgttcatattttaatttttaaatgtaatttctcactggtaaattttccttaaaatataaattgctccctggatatttgttcattattttgcaaagtacaaaactccattagagtttcatttaataaatattaagtacaatattgggaccccttattggcttatataaatcatataaacaggtgactgtttataggattcctttattttagctgccagtaagaagcctgccatgatttttttatgtctttggattccccatcttacctgccagctctagtatctattattggtagccataaaaaatactgacaatatagaccagtttgaattttcttaaatttatcacataggtataccatatcacctaaaaaagttaatgtgattacaaagatagctaatttatactcagtcagcagattcctttatttggctgtgtctccaagataaattaaaaataaaataataaaaataaaaaactatagttgagttataatattttactgactgaaatttaacttcagccaagctttaaaaaaattacacagtttatatcagtacatctttattttatgttctatacatgactccatgataagtgttcaatgtggatttcagaggatcccaaatgacacacacacatacacaatattgtattaaaaagtcagattggtaaggaccctgtagaaatcaggatgcttgcaacatggatttcagcaaagtttctgaaaagataattaacaagcaggctggtttatagaatatataataaggctctaaaaacacaattgggttttaacatggcaagttgatgtagcccaaacagtaaataatctggataatctattatcttgatttttaactgttttgattcagatatttctttgtaatgaaatttttggcaaattaaaatttcacaacgctactcttagaacaggatataggaatctcctcagttaacacccggactcctttgtcagatctaactgtagttgtaagtatttgccttgcttactttgatgctgcagtccttggtatgtatgatttccaaagaattgaagagtaagtttaataatcttgtcactttatttagcttggctcttcaattcattggttattgatattaagattttggtctttagaatatagggtgtgatttgacttatagttaataggttatacatggccatacttaaatctctaatgatatgcctttgcacttaggataaaatacaaaatctttgcagttatgtaacccggatttttaaatttcaagttagttatctttacaaatttttatatctttccaccttataataaacatgaaacattaatagattcagggaatgaaatccttttcttaagaagataagattaaaattttatgtcatcagaaaatataattttagggtactaaccagtaagatatagataaggaatgagacaacctatagataagctttacctgctttattaagtctaatgcatactagagacttttttattctttgagtttcaggaagttaaatttgttcctctgtctcataagatagtattatagtttgtgagaaagttctaatttaacaaacacttaaaaggactaccatgtttaaggcattttcttaagttccagaaatatagtctagctgaaaaatcaaaatcatgtgtattatatattatgaatatgtataatacagtgtaatgggtagaataatgggagcatgtttaaatacagtggggaaactggtaagtatgaggttaattttgtttgttgctctctgacaaaaatcttagaaagtcagtggcctttaaccctcagtacaacaccaaggtccattggattctgttttacttttgagtttctgtttttgagcaattctgagaatttataaggattgatattttatgacttttattattttctagggctcttccaaagagcaaagagaaaaagtgtttatttctgtacatatatatatatttaaattttatatttaccacctggatctattgggcctttttataaatctgtgatatatttttgtatcatagtgttcttgtatttcctccatcttgaaacattttgctgttctattattattagaattatttcatcattacttatcagctagctttcttcaactgcccttaaatagggggctgaggtgggtgaatcacttgagatcgggagttcgagaccagcctggccaacatagtggaaccctatctctactaaaaatacaaaaattagctgggcatggtggcacatgcctgtaatcttagctactcaggaggctgaggcagaagaattgcttgaaccagggaggcagatgttgcagtgagctgagatggcaccattgcaatccagcctgggggataagagggaaacactatctcaaaacaacaagaacaacaacgacaacaacaacaacaaacaaacaatgaaataaaaggaaaatgggagaatgatgaagtcatctagaagagtagtgcagtagttgaataaatggtcactattgctttatcctttagttttatcaagttgtccaaaatattgcatgatctttcatgaatatataaataaaagaagatcagagaccccatctttgtagtctccttttccagttgagaattcagaatttttaatttttttttcaaactttttttttgcttgggggtaaattttccctttaattcttcttttccataatgaaaaagttatgaaaattgagaagagactttaatatttactagtcaaatcagatatcagggctctaatgttaatggcaaaattggtcttagaagcagatcctcatactgagtcatcagatgacacattccaagatgcatttcttcagacaactatcaatgtgtgaataatgcatttctcaaaacaaaaagcagataacgtattcacattcagttagtgaagaacaggaaggaccttatcacacagtattttgcagcaagaacctggaccatctcattttgctaaaaggataggtaacatattctttaatcttttatgatttcgtgctcagattcattatatatggttcctaagtggacaaatactgaaggtaaatatatatatatatatgcataggtgactagaaggaaacagataatgtagaaatgaaaaaattattaattggtaattataagtggtgttataagtgtaaaaatgaaacttttgcaattatcgaacaaagaagatggccattttctcttcatcaaaactataagctaaaggtttaaaaaaaattcatcaggtgtgctgtattttgatgatgtcagttcaagaagaacaagaataatgataagttagatccaattagagatgtatttgacatctggaatcaatatgtacaagatggatgtgtctctggttcatacatgacaattgatgaagcgttagttgcatttagaagacattgaatacatatacattcaaaaccaaaactttctgatgaaatttcactgctcctttatttttacttctgcaatataaaatgacttgaacataaaaataaaattacatagtccatctgacccagctggtgaatggtgatgattatttttttttttggcatttgaaaagttaagctagaccttgaagcttattttaaagtttggcaaataaaaggcagaggcaagagaatagctagaaatatgtatgtgtgtacccccacatacacatatatatgtgtatatatgtaacatataaactatagatgatattttataaaatttatatatctaaattgatttataagtttatacatctacaaattttaacagatatatacatatgaaattttgtctgaaattaaagcttgccattgggagattttatatgtaaatgtaagtagtgcttatcgtatttctgtttagaaagtaactgggtattcattggagattaggttagagaagatattaaatgtagggatttaatgaaggatcacagatgacatagactggagttaaggcatttataataaagaagctgaaacacctaggtgcaatggatcatattcttttgttcattcctgaattgatttgtgtgtgagataattttttgtggcctaagaaatggttttgggctgagcatggtggctcatgcctgtaatcccagcactttgggaggctgagacacgcggatcacttgaggtcgtgagttcaagaccagcctggccaacatggtgaaactccattcctactaaaaatacaaaaaattggctgggcgtggtggcacgtgcctgtaatcccagctgttcaggaggctgaggcaggagcatcacttgaaccttggaggcaaaggttgcagtgagccaagactgcaccattgcactccagcccaggcagcagaatgagactctgcctcaacaaaacaacaacaaaaaaatgaaatggttttggaagacatttacaatagtttatttcctaggtcacattaaaaatgaacatgaaatgatattaattacttaacagtttttttatcctttggggttttttaactataccactctcttattgttatactatgaaatgtccaaagtgctactagtacttttgtttgaggcaaatattattcagagactaagtttgaccttgaacatcaccttggatttaatacaggctttcaagtaaatatttgattttaggaaaacctatgtgttgaggctttccttccaagtagaatggagtagctggtagcaaattagtacttctgcttagagcaatgagaaaatcaagataaaatatacatgtaaccattctgtatcagagttgaccttggggatgtatttcaagtctcagttgtatctgtagtaaagcttattcttcctctgttttgtcctaattatattggtaatcacattcaatataaattgactaattattaaaattgaatcactaagcttgtcaggctgtataaaacaagtaaaccccaattatatgctgcattcaagagccacatcttaaattaaatgggaggatgaagctaaaaggatgaatagatacactgtcctaacactgaaaggcaaactggtgtagctactatatccaataaggtagactataagataaagactaaatataggtggtccataacgtatgatggttcaacttacaattgtttgacgtaacggtggtgcaaaaatgatacacattcagtagaagctatgctttgaattttgatctttctctaggctagtgatatgtaatagaatactctattgcagtgttgggcagtagcagcaagctgcagtttccactcagccaagcagtcatgagggtaaataaccaacactctatagtatatgaaatgtatttttgacttaacaatatttttcacttacagtgggtttctcaggatatagcctcattataaagttaggagaatttgtataaaagatggatgttttataataataaaagggtaattgtatcaggaagttttcactatcctaaatctgcatgcacatagtgagatagtatatataaagcaaaaattgatagaagcaaaagaactggacaaatccccaaatatactgggagaatttatgatgctgtcagtagtaccaaccatcaatagctgatagaacaagtagatgacaaaaaaaaaaaaagagagaggtagagcacatttttacagcaagagtaataagtgacttaatttacaactatataacatttcactggaaaatatgagagtacacattcttttgaagttcagatggaagattaatcaaaattggccaaataggggatatagatcaataggtataaagatttagtgcaattaaaatgtcaaataggttttgggttttttaaagtaaaaaaatgactatctcttctgaaatttgtttagaaattcaaaggatcaaggataatcaaggcaatcttaaggagtaacaaaataagtgtaagagagagtaccaattgtcatcattttctgtaacacaatactagagttattaaaaacagtggtattgatgcaagaataggctggtgcaagaataggctagtgtaacaggagagagtatccagtgtggtaggcagaataatggccttcaaagatatccagccctaattcgtggtacctgtgaatatgtcacattataaggcaaaaggaactttgcaaatacagttaaggttacagacaattaagatagtaaaatgatcctgggttttctgagtgggcccagtctaatcacatgaacccttaagagcagagaagtttttccagctgaaagcagaatagagatgcagcagaagggggagtcattgattccaagcatgagaaagattctgtgcactattattgatgagatttaagggcctatgtaaaagactggagagaggcctctggttgctaaacatagcctctagcttaagtcagcaaggaaatagggacatcaatcctgtaaccaaaggaactgaaggaactggactgtgtgaagtagaatctttactgagccttaagagtacgagctcagcaggcagacattttgatttttgttttttttttttttgaaactgggagtagaaaaattagctgagctaacctggatttctgacttgtaaattgtgaatagtaaaattgtgttgttttgagctgcaaagtttgttctaatttgttacagaagtaaaagaaaactattacttccaggaacaggtctgcatatatgcttctacctgatttatgactgatttttttaagtataatggagaaaagaattttatttcaattcaatatccttatagaaaatatgcttattgacatacataaaaatccattttaggtacatcatagatccaactatgaaagatttaaaaaataaagcttttagatggaaacatggcagaatatcttcgtgatcttgggttagggaaagatttcttaataataggaaaaattgatacattggatcacattaaaaataagaactttagaaatctaaaaactgaaaggtaaatcatagaatgaaagaagatacttgtaatacatatatccaacaaaggactcatattccataacccaattttaaaaatgaataaaagacttgaaaaggcacttcacaaatagtatatgttcaatatgaacatgaaaagatactcaacataaaaaatcattagggaaatgcaagctaaaaccacagcaaaatatttctacacacccaccagagtggctaagtaaaaaagatgccttttccaagtgtttgtaaggaagttgtatagttggatatctgatacacaaattggtactaccactttgggaaactgggagtgtttactaaacctgaacatatatgttatctattacccaggaattttagttgtaggtatatatctaaaaggaaagtttgcttaagtttaccaaaggacatgtgcaggaatgttgatactatttgtaatgacctaaattggaaacaatccaaatgtctacttatagtagaatggataactaaatcatggtacattcatagcatggtatactgtacaatgagaatgaacagcatacaattaaatttaaacatagatgaatctcataaacttaatgttctgcagaggcatcagatacaaaaggaatgcctatggtatgattcatttttataaagttcagaaacagacaaaattaatatatagtgttagaagtcagtatttccttctgttgtgggtagagcaatgactgggagaaagtatgaggggagttttttttttttttaatcaaagatttagacactgctttcaagctctatatgtgtttgaggaattggtgttttcactctttttattctttttcttatgtagataataactatagttaattcactgttttacttcgatcagtttaataatactgattatgttcacgtttatttgagtcttgtacctgtaccaaccaggtagataggagaagtatatgcataatcaaagacagccaactgagccagctgagatttatttacaagtgatagcttaattatttgggggctttacattagttctttcaattaatcagttttttgctttcttgtctattcattggagtttacttctaaagctacctgtcctttgttgacatttggatttctctgtttaattatttagatttgggattagttctgtaaaattcacagaacgccttgggttacacttgagtttgggaacaagtaattacaagttatattaagattgtaaatgatctgtatactgcagacatcattcttctcaaatttctctttaagtatgtctaaattataacataaaccagtggtttagtatgcttttttagatactgatgatgctttgtgagactaattttattctctacccacatcagtatcttttctgattgccttgatgaaattagataaacctttatctatgccacccactaccaaagatgtttcacttttccttctatccttttaagggtatttatcacaatgtcaaagcaggaaaaatagtaataaacatagttatagaaataataacagcaaatggttataacatgtcaatcagtatttaaagcactttattgacttatttaacatatgaaacaactgagagaggtgtgattgttagcttaattttaaacatgagaaagaaagtctcagaccacaggttaactaacttgctgaaggtcacacatctattaaatgtatgtgtcagaattaaatccagattacctagtctttgtccttaaccactgtgccagtaaaagacagataaggagattttcaaagttaaaattcagtcactaactaaacaaatctgggattataagtttttcaaagttttgaataagctaatgattatatttaaatagtaataatttttaggtaaatttttttataattgcatatttaaaatactaatttaaattttgtagtaaggcatgtaaatgttgtttgccatactgtttcatgtttggaagtctgtttatgtttatcctttctttcccaatatataggaaaaggtaattcatgggccatcctaaaggagtgtgttaggttgttctgtagctttttgtagtagtatatttgtatgtaatgaagtgcatttttaaattgcacttgtaatttttaattgcttcttagaaattcctgaatatttaggaacttcataaaaatattctggaagcaagcattacctggataacatggtacttaaaaacctttcattatcaaggaaataaaaaatagaaaagaatgttggtatgaattataagaatggaaataatctaacagatatttatctaattacatttatccagatgagtttttctgatttgcttataatacatcacaacaacatctcagcctgtctccaggttggtacatctttatttaaaaatttgggccaggtgctgtggctcacgtgtgtaatcccagcgctttgggaggctgaggcagatgtattacctgaggtaaggagttcaagaccagcctggccaacaaggcgaaatccctcctcagtatactaaaaatacaaaaagttagccagccgtggtggtgggcacttgcaatcccagctacttgagaggctgaggcacaagaattgcttgaatctgggaggcggaggttgcagtgagccaagatcatgccattatactccagcttgggcgacagagtgagactccatttcaaaaaaaaaaaaaaagaaaattttttttaaagttatttaaactgattttatatgcaccatttatttataacaattttattttattttataatgttttacatttgtgtctctcattagatactcagactaaccctatgatctcataggggagatataattgtcccattgtttttacaaggggcctgatgaccagaggttaaaatgtatgtacagagtcactctacaaatatgccatataattatcatttgaaaccacatcttccgttctctgatacaatgcttttcccattgctccaggtcacttctcatatgatttgaaaaccaaccaaccaataacaactttacctatgattagaatcccatcatttaaagagtgacaatttagttacaaaagattaaaaagaattcaacagcaacaaaaaaaaactagattaaaattgggcaaggacttgaatacacatttgtattatacaaagaagatactcaatggccaacaagtatttgaaaagatgctcaacatctctaatcattaggcaaatgcaaatcaaaaccacagtgagatattacctcacacacctaagaatggctgctgtaaaaaaagaaaacaaaaccagaagaatcctgaaataacaaatgttggtgaggatatatagaaattggaacctttgtgtattgttggtggggatgtaaaatggtacatccattatgaaaaacagtataatggttcctcaaaaagttaaaaatagaattatgattgtacaattccaagaattgaaggtagggtctcaaagagatactgatatgcccatgttcatagcagcattatgcagaacagccaaaaggtggaaggaatgaatagataaaacaatatatatataaaatagataaaacaatatatatcttgagggcgttattctaaatgaaataagccagcaagaagaagacaaatattgtataattccacttacatgagatatttattgttgtcaaattcataaaaacagaatgtagaatggtggttaccaggggttcagtggagtaggaaatggggagctgttgtttaatgggtatagagtttcagttttacaagatggtgtttggtcacacaacagggtaattatatttaacagtaccaaactgtattcttaagagggattaaggtggtgaattttattttgtgtgtcttttaccacaattattatttttaaaattttatttttacagtgacacggtctcactctgtcacccaggctggagtgcaatggctctatcatggctcactgtagccttgagctcccaggctgaagcaatcctctttccacagcctcccaagcaactgggaccacaggcacatgccaccatacctggctttttttttttttttaatatttttttttaaagtcagggtctcactatgttgcccaggctggtcttgaattcctggtctcaggtcatcttcctgccttggccccccaaagttctgggattacaggcataagccaccacacccagccaaatgttttttaattttaaaaataaaataaattgtataggtagaattaaaaatacataaatcagatcatgccaaccctttaaagtcatctagtgtgcttaagataaaatttaaaatccttttaaaaaagatttaaaaatgtatagtaaatgcccacatgattctcacagttaggtgtgcttctttcattgtattaaggatgtataaattttataagactaaatatcgtgagatatttattattgaatatatagcaattcaaaatacagtagtccctccttttctgcaagggatacattccaagaaccctagttgatccctgaaatcacagatgttactgagccctgtatataccttgttttttcatttatatacatacctatgataaagtttaacttataagttaggcacagtatgagattaacaataactaataataaaatagaataattataataatataagttatgtgaatgtgttctctgtcaccctctctcataatattatattgtacagtactcacctggttttagacatcagttgatcataagtaactgaaactctgtaaagagaaaccacacataagggagactactgtattttatgaaatatgtatgtgcatattaaatggaaaatgttttaaaaatattcaaatgttaaaacattgcaaactgatttaaagatccactcacaaaggcaatcagcttgcaaattcaaaggaagttgctattacctgtattttctcagttataccacagtggagctattcataatgtatcagaaagctaggcgtcacagttggatattatgtatataaatcagttgatttttgactcaaataactgaagtgtgttttggagataagttttatgattggaattggaaatgactgaattttgtggagcaaagcttttaactgtgttcacttggagatattctatagtgctttgactctggtttactactgtgcccagtggggtagatatttttttaaaaagacacgtattcaggaaaaaattttatttataaagattacaatatttgctcttgaaaataagaaataatgttagtcaaagaagccctgaatattactgtaaatcattgtacatgtattagtccttatggatttctttgcactagtaaaaatataattattcattttatttatataaggtctttgtgctgctgtaagaaaataccaccaatggtaatttacagtcaggcactgcatatttcaatcagtggtggacaacatgtgcaaaggtggttgtagaagattataatacagtgtatttactgtattttctgtgtttagataggtatttaccactgtgttacagctgcctacagtaacatcttctataggtttgtagcctaggatcaataggctatactatatagcctagctgtgtagtaggctatactatttagatttgtgtaagaatagactgtgaggttcacacaatgatgagatcacctaatgtcatatttctgagaacatatccctgttgttaagcaatgcatgactgtataagaaacactcaataaataatgtatggtagaaggtgattaaataccaaaataaatgaaaaccattaaagtgggcttaaaaacaaagtctcataattttagttactcatcacataaaaatgctttagttgttgcctgttccctaacagataagtgaatgttcacctaaggagactcaggagaaatccccaatactgagacaaacccagagattgagggataactgttctgattcagagggttttgtttgatcttacccctaaactttacaatgaaagtatgtttggtaatacagttaatataaaaatcagggttggctgggtgtggtggctcacgcctgtaatcctagcactttgggaggccgaggccggtggattgcctgagctcaggagttcgagaccagcctaggcaacatggtgaaaccctgtgtctactaaaatacaatcgaaattagcagggcgtggtggcgtgcgcctgtagtcccagctactcgggaggatgaggcaggagaatcgcttgaacctgggaggtggaggttgcagtgagccaagatcacgccactgcactccaacctgagcaacagagtgagactccatctcttaaaaaaaaaaacaaaaacaagcaggggtccccgacccccggaccatggaccagtagcagtccgtgacctgttgagaactgggctgcacagcaagaggtgagcagcagatgagcaagtgaagcttcatctgtatttacagccactccccactgctcacattagcacctgagccctgccttctgttagatcagaggcagcattagattcttattggagtgtgaaccctattgtgaactacacatgtgagagatctaggttgtgcactccttatgagaatgtaatgcctgatgatctgaagtggagctgaggcaatgatgctagcgctggggaacagctgcaaatacagattaacattagcagagaggtttgactgcacagagaccatagtaaatcaattacttgcagactcatttcaaaacccaatcagtgagtggcaggtggcaagctgcatctgacgtcaagctttatagtggcaagtgaggtgatgtacttcaattgtacagctgcatctggtggtaacgctttaagtcagaatccagcacttcttttaattcatgagtggcctgcttattattttatttaccactttcatctgcttctctttcctgcattacacacttttcttagtcagagttttggtaaacccaccagctaaccctacccaaaataagtaaaagccaaacatcactggagagcttctttgaaaagggagacagacccaatgatgagatagcagaagactctaagactgccaaccaaaaaaaaaaaaaagctgcatttaaaagaaaataccgagagtcttacataagttatgggttcattgcagtaggtgatttcacattctcagagcctgctttgtgtaatatgtggtgactggctgtccaaagccatgaaaccttcaaaactgcttcaccacatggagactacacgccctgcattagaagacaagcctttggagtttttcaaaagaaaagaacatgaacataaagaacagaagcaattactaaaggccactatttcatcaaatgtgtctccactgagaccatcattcttagtggctaaccacattgctaaagctaaggagccctttacatgaagagttgatcctgcctgctgctaaggacatatttcatgaacttttaggagaggctgcaattcaaaaggtggcatatcttcccctttgagctagcaccctaactagacgaatcaatgaaatagcagagtacatggaggcacaactgttagagaggattaatgaatcactgtggtatgcaatccaggttgatgggtctaccagtgttgacaacaagggaacaatgcttgtttttgtatgatgtatttttcaggaggatatacatgaggaaatgttttgtgtgcttttgttgccaaccagcaccacagctgcagaactattcaagtctttgaatgattacatatcaggaaaacgaaactggtcattttctgtcagcatatgcacagatggagcagctaccattacttgacagctttttggtttcactacttgggtcaaagaggtcgcttctgaatgtgagcctacacaccctgttatccttagagaaatgctggctagccaaaaaatgtcacctgaacttaacagcattttacaggatgtgattaaaattatcaaccacattaaaatacatgcccttaactcacatctgtttgcgcagctctgtgaggagatggacacagagcacacacatcttctctaatacacaggagtgagatggttttctaaaggtagatcactggccagagtttgagttacaagagccgcttcagagatttcttttaggagaatagttcttttcttttagaaaaacaatcaccactggcagcacatttcagtgacacagaaagggtcccaaaacttgcttacttgtgtgacctattcaacctgcacagagaactcgatctgtcgcttcaggggagaacaacaagtgtgttcaagtcggcagataaaatggctccattcaaaaccaaactggaattatgggggtgatgaaggaacattgggatttctgacatgtttcaagcattagcagagattttgagagactgagccagggctgcctttctctcagctagtgtatgatcacctatctcggctttcaaaagagttgagtattacctcccaaccacaaaagacccccgaactggaaggaatggatttgtgacccattcctgaataagtcaggtgaattgcctttgtccttgctagaagaggatccactgcttgacttcaaattatggtggccttaaaagtatgtttgagacaacttcaaatctccatatgttctagactaaagtcaaggcggaatatcctgagattgccacaaaagcactaaaaagcctgcttccattgccaacatcctgtctttgtgaagcagggtttcctgcagtgacagcaaccaaaatgagattatggagcagactgaatataagcaacacattttgggcgtcactatctcccatcaccccgagatgggaccatctagttgcaggaaaacaagctcagggctctcactgattcaacattatggtgagttgtataattatttcataatatattacaatgtaataatagaaataaagtacacaataaatataatgtgcttgaatcatcctgaaaccacttccccacccccagttcacggaaacattgtcttccatgaaactagtccctggcgccaaaaaggttggggaatgctgaaaaatgaaatccatctttctttgcattctttcaaaagattgagtctttcagaatatagaggggggcctataatgggatatattcattaactcatgcaacaaatatttattaaacacctatcatatgccaaacattgtggttaccagggagatagagtgataaacaatatagacatttgcaaaatattcacttcattcccctattgataagcattgatgcatcctgtgtcatatagaaaaggaggaaaattattattcggtaatattatagaacttaatgcaatttaagcaaatgcgtgtatacaaatgtgtatattttgtatatatttgatataatataccatatatatataatatcattctatgtaacctaccacatgttcagaatctgctgcagagattttttctgtgacacaaagaaacattaaatgcttatgcttcttttgttttttgtgggtttttttttctgtttttaaactagggatttggttatcctgcaaattatgaatttacttttgttttaatattctaaagctatacattaatattatttgccacatattggctgagagctattgaatcctttatagtgtaacattcttggcctaacagtctgcatttcccaggctgccagcaaagcaattcggtggggcaattgtggtcatgcaggggccttgtgagcggttggcagagagagaagcatacagatcagacagactcctatcctgcaggaaaggtagccctcctttctcccatcccagcagtcagcaggaggtagagccgctcagagctatatgaagagcctttgggaataggtgcctatggttatgttttgctgcagctgccctatattcacaacctcctgcattccatgcaggcttgacctctgcctctgcctattctctgggcagttctccctgtcaattcagctgtctgggggtcatgggatcccagaggtagctaggatgccagtgtgtttctctgcagttccttcacttacacctttcttaggaactgttgagggctgggagctggtcctggtactcggcaatgttttgcagtgttcccagcatcctccctcttctacctcagtgtcagtagtacctttctatcaactttcagtgttttctttaaaaagaaagtgtgatggtttactggatattttgggttcagtgaagtgggagaggcactttctggctgcatttagtcagccatcctgctccatagtcattggaattatctttctaaattttattttctgattgttgttcctggtatataaaattataattgattttttaattaaactttttagatagttgtagaattacatgtggttaaaatattttctaaagagagatcctctgtaccctctatccagtttcctcaaatggtaatatttagcaaaacagtacagtgtcacaatcaggagtttgacactgacccagtgaagataaaggacattttcatcaacacaaggatccctcaatttgcctatttgtaaaatacccacttccctttccccatctcccacctgaactccttgtaaacactaatttgttctccatttctataatattgttaaatcaagaaacttatataagtggaatcacaccacatgtaatcttttggggttgtgtactttctattagcataattatctagatatttatccatactgtatatcaggcgttggccacattgtatgacagagaagtattccatggtatggatgtgccacagtctaacattcactgattaagggaaatctaggttgctttcaattgtgggtaaatacaaaactactgtaaccccctatacaggttttgggtattaacacagttttcttttctctgggataaatgtccaggggtgcaatagcagagttggcatggtaattgcctatttaattcttaaaataactgctaaaatgtatgcagaatgactgtaaaattgtgcattccaaccagtgaactatgaatgatccaattctttccatcttcaccagcattttttagtcactattttaaaaaatgtagctattgttatagatgtgtgatgatatctcattacatttttttgtttgtttttgtttttttgagacagtcttgctctgtcacccaggctggagtgcagtggcacgtgtgactcagtctcccaagtagctgggattacagatgtgcgccaccatgcccagctaattttcatattttaagtagaggtgaggtttcagcatctatggtctcgaacccctggcctcaagtgatccgcctgcctcagcctcccaaagtgctggaattacaggtgtgagccaccacgcctgttcttattatgattttaatttacattttcctaatgcctaagatgttgaatgtattttccatctgcaaatcctcttgaatgaaatgtctctttataccttttgctcattttctgctttttttgttattgtcatgttcgagggttctttatattgtctgcatgccagtgttttcttggatacattgtttgcaaaatgttcttgtttcgtagcctcttctttcactttcttaccagggtttttcacacggtgaaagttttaaattttgataaagtacagtttatctatacttccttttatggatggtgctttttgtgtcaagtataaaaattccttgtctagcactactccagaagattttctcctatttttcctaaaacttttatagttttacacttcatatttaagtacaatgtccattttgagttattttttatgtaaggcatgagataggtcgaggtttttgcctatggatatgcacttgctccagcaccatttgttgagttgcttttttacttatgtgtaaaatcggttgggcatatttgtgtggggtctattcctggtttctctattctgtttcactgatttatatgtttatctttctggctaataccacacagtctttattattatatctgtatatgtcttgacattgagaagactgatacctcacacttaattctttttcaaaattgttttagctattataattcctttgcctttccatgtaagttgtagaataatattgtctatgtatactaaaaatactcactgtaattttgattggtaacaagctaagcttttgttattaatttggggagaattaatatttttaaatgttgagtctaacaatctgttattctgtatatttatttattagatctttgatacctttcaccaacattttgtagttttcagcacgcaagccctacaacgttttgtagatgtacacctacctatttcattttttttaagcaatgataagtggcattatattttaatttaaagattcatgtgtccatggctaatatatacaaatgtaattgattttcatatatcagtcttgtatcttgtggccttgaagaactcccttattctaggagttttttctaggttccttgggattttctatgttgacaaatgtgccatttgcaaatagggacagtttatctccttctttccagtctgtttgcttcttatttccttttattgccttactgcacttgctaaatattatttacttcattgaataagagtagtgagagcatatatctttttttttttgttcctggtctttggggaaagcattcagtctttttatcattaagaatgatgttagtagatttttaaacaatgctattttttaccaagttgaggaatttcctttttcttctcatctttttgagaatttttatcatgaattggttgaattttgtgaaatgctttcccgcattgattctataatcatgtgattgtgtttcttcaaactgttaatatgatgttttacattgattgatttttgaatattgaaccagccttgcatacatggaataagcaccatttagtcacgatatatagttctttttatatgtaattctgaattcttttactaatattttgttaaggatcttttggatatatattcacatgagaaatatttgtctttgggttttgttttattatactgtctttgtttgctttttgcatctgcgtaatattcccttcataatatccatttggatattccctcctttgattttctgatagagatggtttagaattggtgtaaattttgtgagtatttgtttggattttccagtgaaagaattattgcctagacagtttttggaggagttttaaaatacaaatccaatgatcttaatagttgtaggtctattcaaattactgatttcacattgggtgagtatttggtagcctgttgttcttttgaggaattgcctgtgtctcttaggttaacaaactgatgtgtgtagagtggtttgtagtatttccttactatccttttgattcctacagagtcggtagtgatatctctcctgtttctttcgtgatgtgggaataggtgtactttattttattgggctttacattttgactctgctcaaagattgtgctttttacatatcaaaggtttatggcaatcctgcatcaagcgagtctgtcagtgccattttttcaacagcatgttttcattttgtctctgtgtcacattttggtaattctcacaatattttaaactttttaataatgactgtatctatgatggtgatctctgatcagtgatgtttgatgttactcatacaattgttttggcttaccatgaaccacatccatagaacatggtgaacttaatcaataaatgttgtgtgtgttctgtttgttccacttaatgaccatttccccatctctttctctctccatgggttttcttattcactgagacacatcaatactgaaattaggccaaataattaccctacagtgccctttaagtgttaaagtgaaaggaagagctacatatctctcactttaagtgaaaagctaaaagtgagcaaatttactgagaaaggcatgtcacaagccaaaacaggtcaaaagctaggcctctcgcaccaaacacttagccaaggtgtgaatggaaactaaaagtttttgaaaaaaggtaaaagtgctgtttcagataacacatgaatgataagaaagtaaaacagcttaattgctaataaagagataattttagcagtctggctagattggactagccacaaaattttcttcagccaaaacctaatccagggcaaggcccgaattctcttcagccctacaaaggctaagtgaggtgcagaagttgcacaagaaaagttggaagctagcagaggttgcttcctgaggtttgaggaaataagtcatctctgtaacataaaagtacaaggtaaagctgcaagtggtgatttaaaagttgcagcaagtcatccataatctagctaaaatcattgatgaatctttagtggctacactcaacaacaggttatcaatatagatgaaatagccttctgctgtaagaagatgccatctaagactttcatagctagagataagatatcaatgcctggcttcaaagcttaggctgactcatgagttagtggctaatgcagctggtaactttaaattgaagccattgctcatttaccattttgtaaatcataggtcccttaagaattatgctgaatttactcttcctatgctctataaatgaaacaacaaagctaaatcacaatacatctgtttacagcatgatttactaaatactttaagtccactgttgagacctactgctcagaaaaatagattaaaaaaaatactgctgctcactgacagtgcccctcgtcagccaagagctctgatgaaaatgtacaaagagaataatgttgttttcatggctgctaacacaacatccattctgcagcctatggattagggagtaattttgagtttcaagtcttattatttaagaaatacattttgtcaggctatagctgccatagatagggattgctgtgatagacctgggcaaagtaatttgaaaacattttggaaaggctcaccattctagatgccattcataacattaatgattcatggagggagttcaaaataccagcattaataaaactttagaaattgattcgaccctttatggatcagttcgaggggtttatgacttcattggtggaaagtagctgcagatgtggtaaaaatagcaagagaaatagaattagaaggagagccggaagatgtgactgaatttctgcaatctcatgataaaattttcacagatgaggagctttttcttatggataatcaaagaaaggtgttccttgaggtggaatctactcctggtgaagatgctgtgaatattattggaatgacaaaaaaggatttagaatatgacataaacttacttgataaaacagtggcaggatctgtgaggattgactcttccaattttgaaaaaaattctgtgaataaaatgctattaaatagcattacatggtacagagaagtattttgtcaaaggaagagtcaacctgtggggcaacttcattgttatctttctgttgcaaccaccaccatgatgagttagcagccatcagcatcaaagtaggaccctccactaacaaaaactttacatctcattgaagggttagatggtcattagcattttttgcaataagatcttttaaaatcaaggtatgtacattttgaaaacgtaatcctattgtacatttaataaactgtagtatagcataaacataactttatatatgcactggaaaaccaaaaagttgtgagacttattttgtcataatattcattgtattgtggtggcctagtactgaacatgcagtacctccaaggtgtgcttgtaatttgtttcttttctgtttttctctttgtcagtcttagaggcagctttttttttttaagatccagctttttgtttcattgttttattattttgctgtttttaatgttattggtttgtgctctttattatttccttctttctgcttgatttagttttattatgcttgtcaatttctagattttatgcttatattattgatttgagacttttactgttttcaaaaaaatgcacttattgctatattgtccgtatagcactacttttcctctattccaaaatttttgatatatcttattttcatattttttttcagtttacagagtgtgtgtgtgtgtttgtgtgcacgcgtttaatttctcttgagatgtgctttttgtttcatggattatttagaagtctcttgtttagatttcaaatctgtgccttgtctggtatgtttctgttgtttccattctggtcaaataatattttgggtattatttcaattattttacaataattgatttttcttttaagatacagaacatggtctatattgaaataagttctgcaggcatgtatttgctggttttgactagagtgttctttaaatgtcagttatgtcctggtggttgatactgttgagttcttctgtatctttgttgattatataactagttctttctaattttgtgaggcttcttgatgtctccaactatgtttatgtcttttctttcattttttcaggtatatcagttttgcatcacatgttttgcagctttgttgtttgttatatacacctttaggattgttttgtcttcccgatggattaatttttttatcattatgtattgtgcctctctgtctctggtaatttcttttcttttgaagcctactttacctggtattaatacagccactcctgctttcttatgtctacttggtagatctttttccatgtttttatagtcaacattcttgtatctttatatttttagtgagtttcagatggagagcatatttttgagtctgcctttaaattcactctgctaatctctttcagttggtgtatttacaccatttacatttatataattaattatctgtaggagcttaagtctcccactgtatttcttgtattttgtttgttctcacttgtttctctttttcctttttcctttcttcttgggagttatttgaatatttttaggagtttcatttttatttataaatatttttaatgatatctcttttctagtggttgtttattggttactctagtgtatgtgtgtgtgtgtgtataaaattttatcaattttatcaattcatgtgaagtgtaggaaacttaaatttatatctcattaccctctcaatacaattgcctgaaatatttcttgtacgtacatatagactcacattagacagtgagtctgtgagagtctataatagtttcctgaaatattttgtacatacatatagactcacattagacaatgttacagtttttgcttcagcattcaaacataaaagcccaagatgagaattttgtctgttgtatttacccatatatttgcctactattataatgtttttcttcctgatgttccaagagttcttatttttttgcttactttatgtttagaaatctttcattgaccattatattagggttggtatgctggtaaaaagttttcttagtttttcttcatcaaagaatgtcgtaattttttttttcatgtctgaagagtatttttactggatataggatgtgggttcacagttcttttatttaagcacttcaaaaagtacttccagtggggcgccaagatggccaactaaaagcagctatggtgtgtggctcttacagagaggaacgaaagggacgagtaaatgcagcacctttaactgaaacatccaggtacttgcattgggactgatcagggaaacaactcaacccacagagaatggagaagagcaggacagggcagggcagggcaacagcttacctgggagcaacatggatacaagagaacctacccctgcccagggaagcagtgagtgaatatgtgaccctgggaaaccatgcccctcccacagatctttacaagtccggtcaggagatccccttgtgaatccattccaccagggccttcggtctgacacacagaactgtgtatagtctcaacagaaaagctgctcaggcatgcatggagacccgggaactttacatactctggctctagtatccctaacaaaggtgattgcaacttaggcagggcgggagcttggacatccatatttacccctaggaagggatctgaatccagggggctaagaagcattgatctgtgggccccatttccacagcttctcacaggataagacccactggcttggaatttcagccagcccccagcaacagagttgtacctacctgggacaaaacagagttgctggcgggaggggcagactaccatctttgctgcttggataactcagccattccagcctgtgggcttaggcgagtccaaaccaactgggcatggaagggatcacctagcacagcaaagctgctctaccaaaatgtggccagactgcttctttaagagggaccctcaatccaaatcctcttcttgggtgttacctcccaactgacagagttttgatttctctttgggactgagtgcctgcggggaggggcaggctaccatctctgctgtttggacagctcaacctttccagcctgtgggctttggagagtccaaaccgaccagggcagaagggatcccccaacacaacacagctgctctaatacaacatggccgactacttctttaagcagaaccctgatccgttcttcatctctgagcaggacctcccgactggaccctccagccaccctcacttgtattctctggttcacaatgttttgatttcaccctgggactgagttcgagggggaggtgggcgggcgccatcgttgctgtttgggcaactcagcattctgtcctgtgggctttggagagcccacgcccaccagggcagaagcagtaccccagcacggcacagctgctctatgaaaccatggccatcctgcttccttaagcagtccccgatctattcctccttgcagggcgggacttcccaactgtgtcctccagtcactcccatggatgttctgtggctaagaggtttgaaaacttcctgggacagagctcctagagggaggagtgggctgccattttttctgtctcagcaacttccgtagtttacagactttggagagcccaagctaactaggggcagaagtggtacacccacacagcacagctgctttataaaagtgtggctagactgcttctttaagcagatccctgatcccactcttcctgactgggtgacacctcccaaccagtgtctccagccaccacctaccacctggttgtttgggccagcaaccaggtctgtacccctctgggacagagctcccagaggaaggggcaggctgccatctttgcagttttgcagccttcactggtgataccctcaggtactggaaaacctaaggcgactagggactagagcagatgcccagcaaaccacagcagccctgtgaaaagtggccagactgtaaaaaggaaaaaaaaaaaatccaaagatcagcctcaaagattgaaggtagatgtgcccacaaagataaagaatcagcacaagaacgctgaaaactcaaaaagccacagtgccctcttctgttcagatgaccacatcacctctccagcaagggtttggaattgggcagaggctgagatggccgaaatgacagaagtagacttcggaatgtggataaaattgatgttcattctgctacagctgcaccttctaactcaatgcaggaagctacagatcatgataaaacatttcagcaactgacaaggtaaaatagccagtatggagaataacgtaagcaacctgatagcgctgaagaaaacaacagaagaagttcataatgtaattccaagtattaatagcagaatagaccaagtggaggaaagaatcccagagcttgaagactgtctttctgaaataagacaggcatacaggaatagagaaaaaagaatgaaaaagaatggacaaaacctctgagaaatatgagattatgtaaagagactgaatatatgactgattggtgtacctgaaagagatgagaagaatggaaccaacttggaaaatatatttcaggatatcttccatgaggacttccccaacctagctagacagaccaacattcgatttcaggaaatgggagaacccctgtaaaatattccacaagaagatcatccccaagacacataatcatcagattctccaaggtcaaaatgaaagaaaaaatgttaaggacagccagagagaaaggccaggcaacctacaaagggaagaccatctgactaacagcagacctctcagcggaaaccctacatgtcagaagagattggaggccaatattcaacatgctgaaaaaagaaaaattccagcccagaatttcatatgtgcccaatctaagcttcataagcaaaggagaaataagatactttccagacaagcaaatgttgaggaaatttgttaccaccacacctgccttacaatagctcccaaaagaagcactaaatatggaaaggaaaaatcgttaccagccactacaaaagcacactggagtacacagacaaatgacactataaagtaaccacaagttattttaaacaagtctccaaaataaccagctaacatcataatgacaggatcaaatctgcacataacaatactaacctcaaatgaaaatgggataaatgccccaattaaaagacacagagtggccagctggataaagaaacaagacccaatggtctgctgtcttcaagagacccatctcatgtggaatgacacacataggctcaaaaaaggatggaggaaaatttacaaagcaaatggaaaacagaaaaaagcaggggttgcaatcctgttctgacaaaacagactttaaccaacaaagatcaataaagacaaagaagaagggcattacataatggtaaagggttcaattcaacaagaagaactagctatcgtaaatatatatgcacccaacactggagcacccagattcataaaccaagttattagagaccttcaaagagacttagactcccacacaataatagtgggagactttaacaccgcactgacaatattagacagactgagacagaaaattaacaaagatattcaggatctgaactcagatctggattaaatggacctgatatatatctacagaactctccactcaaaaacaacagactatacattcttctcatcaccatgtggcacttactctaaaaaagatcacataatcggaagtaaaacactgctcagctcagcaaatacaaaagaactgaaatcataaccaacagtctcttggaccagagcacaatcaaattagaactaaagtctgaagaaattcactcaaaaccacacgattgcatgaaaattaaataacctgcccctgaatgacttttgggtaaataatgaaattaagatggaaatcaagttctttcaaactaataaggacaaagatacaatgtaccagattctcagggacacagctaaagtagtgttaagaaggaaatctatagcagtaaatgcccacatcagaaagctagcaagatctcaagttaacaacctaatgtcacaatgaaaagaactagaaaatcaaaatcaaacaaatcccaaagctagaagaagacaagaaataaccagaatcagagctgaactgaaggaggtagagacaagaaaagccattaaaaacatcagtaaatccaggagttgtttttttgaaaagattaataaaataggccactagatagactcatgaagagagaatcaaataaacacaatcagaaatgataaggtggatattacgattgtccccacaggaatacaagcaaccatcagagaatattataaacacctctatctgtatcaactagaaaatctagaataaatggataaattcctggacatatacaccctaccaaaagtgaaccaggaagaaattgaatccctgaacagaccaataacaagttctgaaattgaggcagcaataaatagcctaccaaccaaaaaaaaaaaaaaaaaaaaaagcccaggaccagacggcttcacagctgaattctaccaaatgtacaaagaagagctggtaccattcctactgaaactattccaacaaattgaagaggagaaactcctccctaactcattctatgaggctaacatcatcctgacaccaaaactttgcagagatacaaaaacaaaagaaaacttcaggccaatatccttgatgaatactgatgcaaaaatcctctgcaaaattctagcaaactgaatccagcttatccaaaaagataaatcgagctttatctcaaaaaactgagtgaacaggcaacctacagaatgggagaaaatttttgcaatctactcatctgacaaagggctaatatccagaatctacaaagaactcaaacaaatttacaagaagaaaacaaacagcaccatcaacaagtgagcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaagagtcaggaaacaacaagtgctggaggggatgtggagaaataggaacacttttacactgttggtgggactgtagactagttcaaccattgtggaagacagtgtggcgattcctcagggatctagaactagaaataccatgtgacccagccatcccattactgggtatatacccaaaggattataaatcatgctgctataaagacacatggcacacatatgtttattgtggcactattcacaatagtaaagacttggaacctccccaaatgtccatcagtgatagactggattgagaaaatgtggcacatgtacatcatggaatactatgcagccataaaaaaggatgagttcacgtcctttgtaggggcatggatgaagctggaaaccatcattctcagtaaactatcgcaaggacaaaaaaccaaacaccgcatgttctcactcataggtgggaattgaacaataacaacacttgaacacaggaagggggacatcacacaccggggcctgtcgtggggtagggggaggggggagggatagccttaggagatatacctaatgtaaatgacgagttaatgggtgcagcacagcaacatggcacacgtatacatatgtaacaaacctgcacgttgtgcacatgtaccctagaacttaaagtataataaaaatatatatatataaaatattaataaatattgaatcttccaaccacccaaaaaaggaaaagaatgcacaatatcttattaataattttatatggtttacattttgaaatgataacattatgaacttactgtattggattaaataaaaacattttttaataaaaaaaaaagcttgtccaccagagttaaataggctttatccctgggatgcaaacttggttcatcattgcaaatcaataaatgtgatttatcacataaacagaactaaagaccaaaaccacttgattatctcaagagattcagaaaagatttttgataaaattcaacatccctttacttgaaaaactctgaccaaactagatactgaagaaatgaatatacctcaaactaataagagccatagaagacaaactcacagccaacatcatactgaatgggtaaaagctggaagcattctccttgaaaaccggcacaagacaaggacgccctctctcaccgctcctgttcaacatagtattggaatttctggccagagcaatcaggcaaaagaatgaaataaagggcattcaaataagaagagaggaagtcaacctatccctgtttccagatgacatgattctgtatctagaaaaccccagtcgtctcagcccaaaagcttcttaagctgataagcaactttagcaaagtctcaggatacgcaattaatgtgtaaaaatcactagcattcctatacatgaacaacagtacaagtgagagccagatcataaacgtactccccttttcagttgccacaaaaagaataaaatacctaggaatatagctaacaacaaagcgaaagatctctgcaaggagaactataaatcactgctcaaacaaatcagaaattacacaaagaaatggagaaacattccatgctcatggataggaagaatcagtattggtaaaatggccaaaatgcccaaagcaatttataaattcattgctattctgattaaactaccattgacatctagttctgtaaactaccattcacagaactagagaaaactattttaaaatttgtactgaaccaaaaaagagcctgaatagcccaagcaatcgtaagcctaaaaaacaaagctggaggcatcacactacccaacttcaaactatactatggggctacagtgaccaaaatagcatggtagtggtacaagaatagacacataaccaaaggaacagaatagagaatccaaaaataagactgcacatgtacaactatctgatcttgaagaaacctgacaaaaacaagcaatggggaaaggattccctattcaataaatggtgctgggataactggctagccataggtcgaaaattgaaactagacccttcctgacaccatacacaagaattaattcaaggtggattaaagacttaagtgtaaaacccgaaactataaaaaccctggaagacagcctaggcaactacattcaggacattaggtactggcaaagatttcatgacaaaagtgtcgaaagcaattacagtcaaaccaaaaattgacaaatgggatctaagcttctgcacagctaaagaaactatcaacagagtaaatagacaacctacacaatggcagaaaatttttgcaaactatgcatctgacaaaggtctaatatctagcatctataaggaacttaaatacatttagaagaaaaaccaccccattaagacatgtgcaaaggacgtggatacttctcaaaagaagatgtacatacagccaacaaacatatttagaaaagctcaacatcactgatcattagagaaatgcaaatcaaaaccacagtgagatatcatatcctaccagtcagaatggctattattaaagagctgaaaaataacaagacgcttgtgaggttgtggataaaaggaaggcttatacactcttggtaggagtgtaaattagttcagccattgtggaagacagtgtggcaattcctcaaagacctaaaatcagaaatagcatttgacccagcaatcccattactgggtatatacccaaaggaatataagttgctctgttataaagacacatgcacccatatgttcattgcagtacttatgacaatagcaaacatatggaatcaacccaagtgcccatcaatgatagactggataaagaaatgtggtacacatacaccatggaatataaggcagccacaaaagagaatgaagatatgtcctttgcagggacacggatggagctggaagtcattatccttagcaaagtaacacaggagcagaaaaccaaatattacatgttcttacttaggaatgggaactgaatggtgagaatacatggacacgtatagaggaagaacacacaccagggcctacttgagggtagaaggtgggacgagggacagtatcaggaaaaataactagtggatactagtcttaatacctgggtaatgaaataattgttacaacaaacccccatgacacacgtttacctgtgtaacaaaccttcacatcctgcacttgtacccgtgaacttaaaaaagaaaaagtgcttccttctagcctttctggtttctggtaagaaattgattgtcatttgtattacctttcccactttcctgctgttttttttttttttctttttttgagacagagtgtcgcactgtcgcccaggctggagtacaatggcgttatctcggctccctgcaacctctgcctcccaggttcaagcaattctcctacctcagcctcctgagtagcagggattacaggcagggtttggctatgttagctaggccggtcctttcctgctgtttttaaggtatttccagccgggcatggtggctcacgcctgtaatcccagcactttgcaaggccaagacgggtggatcagctgaggtcgggagttcgaggccagcctggccaacatggagaaaccccatctctactaaaaccacaaaaattagctgggcgtggtggcgcatgcctgtaatcccagctactcaggaggctgaggcgggagaatcgcttgaacccaggaggcggaggttgtggtgagccgagatcgtgccattgcactccagtctgggcaacaagagtgaaactctgtctcaaaaaaaaaaaaaaaaagatatttcctttgtctttagttttcgaatatttggccatcataaatcttggtgtggatttcattaactgtaccctctttcaggttttttaaactcttgaatctctatattgagttgttatttttttttaaatgtatcctatccttttatccctcttctttgacactcagatgatattaactttagttcttttgttattgtttgacaattcttggggactttatttttttttccaaaccgttttcttcttttccagattggatgacttctagtgtgttatctcctagcttgctgattgttttcgcatgtttctttcattctagtattgagcacatccattaagttttgtatttcagttattgtgtttttcaggtataaaatttctatttggtcttcctgtgtatcttctacttcttgattaagattctttttctttgctgtgactttttgctcataaaatttgtttcatgtgtttttataattcctttttgaataatttttatcatgacaagactaaaattttttcaggcaactctagcatctctgctgccttggtcttagcacctgtcattagccttttttcattcagtttgagatcttcctggttctttgtatgacaacttattttttaataaaacctgaacattttgggtcttatgagaatgtagtctttatttaaattatctggtgtagctgtctcattctgacacttcatctgagagtagtccctctacctctttgctccaaggttgaggtgggagtcgggttttttacttggcctccttggtaggtaaggcggaaggttttccatgttactgctgtgtaggcatgttagttttggctccctggtaggtctccagtgaaccccttttggc

SEQ ID NO: 4 - DNA, 74882 bp, Homo sapiens
aggacgaatgagatttcactatggacagaattgtgactaaattttaccatatggcctacaatgtctctcccagtcaaggttatatataatgcctctgtactcttctatttcccagtatcatatctggaaccaagacacttggacaggaatcctattttagacagaggactgaaagtagtaaatgtaaatatttttaagacattgcatttgataaggaataaaggaagagtgaatctctgactcatttctcctcaaattattattttgttgtgatttatgaaaattaacaatctgaacaagagaaggaagttatgattaattttggaagattgtaaattgcataccagttttccaatgttagccatttttaatcaactcagtttttaaacaaaaatttataaatatggctgaaccgaagatatctatagagagcttcaacataagatttgatcaagcagaagaaaggatcagtaagctcacagactggttattagaaattacccagtcagaagaacaaaatgaaaaaagaatttaagagtgagaaagtctgtgagaattatggggcagtgaagcaaaccaatctttgcattataggagttccagaaggaacacagagagagaaaggagtagtgaatgtatttaaagaaataatgacagaaaacattcataaactagggacagatataaatgtccacacataggaagctcaaaggtctccagttatgttcagctgaaacaatgctacaataagacttagtaaaactctcagaagcgttaagacaaagagaggatcctgaaagcagcaagagaaaagaagcaaatctcatacgagagaactccattatggctatcattagatttttcaacagaaaccctgcaggtcagggatagagtgaaaaaaaaaaaaaaaaaaagcaaacaaaaatttcttgctcaaagaaagaaaaaaaaaaacaccaggaaccataaagttgtccctcagaaatgaaggagagataaggactttcccagacaaataagaactgaggaagttcactagacttgccttataagaaatgcaaaagggaattctttaagctgaaagaaaaggatggtaattggtaatatgaaaacatataaatgtaaaaaattcactggtgaaagtaagtatgtagtcagattcagaatgctgtatgtaaagctacaatggtggtgtgtaaatcaattatatctttagtaagaaggttaaatataaagtagttaaaataggtatatttacaataattaagtgatatacaatatataaaatgtaaattttgacatcagtaacaatatgttggtgggtaataaaattgtagaattcttgtgtgttattgaagttatcagcttaaaaatagcctgttacaaccgtaatatgttttatgtaagcctcatggtaaccacaaaagaaagagctacagtagatacataggagataagtaagaaatcaaagcataccacaacagagaatcattaaattacaaaggaagacaggtagagtggaagaaaggaacaaaaaatctgcaaagctaccagaaaacaatgaacaaaatggcagttgtatgtctttatctatcaaacaagtagtttaaatgtcaatggattaaattctcccatcaaaagatacagagcagctgaatggattaaaaaaaaaaaagtccaaactatatgctgttaataagagactcatttcatctttaaggacacaaatagactgaaagtgaagaaatgggaaaagatagtctatgaaaatggaaacgaaaagagagcagaggttgttatacttagatgaaatagacattaaataaaaaattgtgagaagaggcacagaagattattatataatgataaaagtgttggttaatcaagaagatacagcaattgtaaacagatatgcacccaatatcagaacacctaaatacataaagcaaatattaatagatctgaagggagagacaagactgcaagacaataatagtataggacttcaatatttcacattcatcaataaacacatcatcgacttagaaaatcaatatggaatttgatttataatttgatatgtggacttcaatcacacagtaaagcaactgtacctaacaaacgtatatcagaatagttcatccaacaacattggaacacacatccttcttaagcatatgctaaacattctccagggtataccacgttagtctagaaaacaaatcgtaacacatttaagaggatttaagtgatatcaagtatcttttttaaccacagtggtatgaaattataaatcattaataggaagaatttcaaaaaattgcaaatatatggaaattaaacaacatgcttctcaataatcagtgggtcaaagaagaaatttaaaggacaataaaacaataccttgacactaatgaaagtggacactcaacatatcaatttgtataggatgcagcaaatcataagagagaagtttatagcaacagatgcctacacataaaagaagaaaaatctcaatctagtgttacacttcaaggaactagaaaaataacacactaagcccatagttagttgaatgaatgaaatattaaaaatcagagcagaaataaatgaagtagaaattataaaagcaatagaagagatcaacaaagctaagagttgtttttttaaaagataaaattgacaaacctttagctagactgaaaaaatagtgaagagttaaagaaaatcagaaatgaaagaggagacattacatcttatatcactggaatatgaaggatcataagagacaactatgagcaatcatatgccaacaaattagataacctaaattcctggaaacatacatcttatcaagactgaatcatgaagaagttgaaaatctgtataaactactaattaaggaagttgaatcagcagtcatagactgcccaaaaaacaacccaggacctgatgcctttactggtgaattctaccaaatatttaaagaataaacaccagtgtttctcaagctctctcaaaaaattgaaaattgatgagagaaaacttcaaactcattttaagaggccatcattaccatgataccgaagtcaaagacactacaagaaaaaaaaatgcaggccaatattgttgatgaagatagatgcagaaattctcaatgaaatactagcaaaccaatacatgaaaaacatcatacaccatgatcaagcaggatttattcctgggatgcatttatgtctgtggttcaacatttacaagttgataaatgtcatacattaatagaataaattacaaaaaccatgtgattatctcaataaatgcagaaaaagcattagagaaactttaacattttttatgataaaaacccgcagcaagttaggtatagagggaatgtacctgaacacaataaaggtcatatatgataggcccaaaattaacgtcatactcaacagtaggaaggtgaagatgtaaaaaaaaaaaaaagatgtaaattactacatgaaatcataaaatattattgggtgatggaataacagtgtagagttactttatgcaatcaaaccaaagttatcagcttaaaatagtctaactgtaagatgtttcatgtaaacctcttgatcactataacgaaaaactatgctagatacacttaagataaaaagtgggaatcagagcatagcactagagaaaatcctctaaccataaaggaagacagcaagaaaggaagaaagaattacaaaacaaccggaaaacaatgaacaatatagcaatagtaaatccttacctataaataattaccttgaatattaatagattaaattcttcaaagaaaagatagtgactgaatcaatcagaaaataagacccaagtatgttctgcctataagagaatcactctcacctttaagggcacatacagattgaatgtgacaggatagaagtagataatccatgctgatggaaaccaaaagaaagcaggagtagctatacttatatcagatgaaatagaatttaaataaaaattataaaaagagacacagaaaaggtcatataatgtaaaggggtcaatttatgaagaagatataacaattgtaaatatatctgcacccaacatcagagtacctaaatatataaagtaaatgttaataaatctgaagaatgagatagactgcaatatagtgtagtagactttagtatgcctctttaaataatgaacagatcatccagacaaaaaatgatatagaacttgaactacatcttagaccaaatgtaacagacgtatatagagcatttcagccttctatccaacagtagcagaatccacatttttctcgagcattttggaaacttccccaggatagatcgtaagtcagaccagaaaataaatctcaacaaatttaagaagattgaaattatgccaaatatcatctccagtcacaatggtatgaaaatagaattcataacagaaggaatattgcaacatttataaatttgcacaaacttacttggccctaaacaaccaagagtaaaactgaaatgggaaattaaagggaaattaaaaatatcttgagacaaatgaaaatactacataacaaaaattatgggatgcaacaaaagcattttattttattttattttattttactttaagttttagggtacatgtgcacaatgtgcaggtttgtgacatatgtatacatgtgccatgttggtgtgctgcacccattaactcatcatttagcattaggtatatctcctaatgctatccctcccctctccccccaccccacaacagtccccagtgtgtgatgttccccttcctgtgtctatgtgttctcattgttcaattcccacctatgagtgagaacatgcagtgtttggttttttgtccttgcgatagtttgctgagaatgatggtttccagcttcatccatgtccctacaaaggacatgaactcatcattttttatggcagcatggtattccatggtgtatatgtgccacattttcttaatccagtctatcattgttggatatttgggttggttccaagtctttgctattgtgaatagtgccgcaataaacatacatgtgcatgtgtctttatagcagcatgatttataatcctttgggtatatacccagtaacgggatggctgggtcaaatggtatttctagttctaaatccctgaggaatcgccacactgacttccacaatggtggaactagtttacaatcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatattctttgcccactttttgatgtggttgtttgtttttttcttgtaaatttgtttgagttcattgaagattctggatattaaccctttgtcagataagcaggttgcaaaaattttctcccaatctgtaggttgcctgttcactctgatggtagtttcttttgctgtgcagaagctctttagtttaattagatcccatttgtcaattttggcttttgttgccattgcttttggtgttttagacatgaagtccttgcccatgtctgtgtcctgaatggtaatgcctaggtttttttctagggtttttacggttttaggtctaacatgtaagtctttaatccatcttgaattaatttttgtataaggtgtaaggaagggatccagtttcagctttctccatatggctagccagttttcccagcagcatttattaaatagggaatcctttccccattgcttgtttttgtcaggtttgtcaaagatcagatagttgtagatatgcggcattatttctgagggctgtgttctgttccagtggtctatatctctgttttggtaccagtaccatgctgttttggttactgtgtccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatactgattcttcctacccatgagcatggaatgttcttccatttgtttgtaacctcttttatttcattgagcagtggtttgtagttctccttgaagaggtccttcacatcccttgtaagttggattcctaggtattttattctctttgtagcaattgtgaatgggagttcactcatgatttggctctctgtttgtctgttattggtgtataagaatgcttgtgattttttgcacattgagtttgtatcctgagactttgctgaagttgcttatcagcttaaggagattttgggctgagacgatggggttttctagttatacaatcttgtcatctgcaaacagggacaatttgacttcctcttttcctaattgaataccctttatttccttctcctgcctgattgttctggccagaacttccaacactatgttgaataggagtggtgagagagggcatccctgtcttgtgccagttttcaaagggaatgcttccagtttctgtccattcagtataatattggctgtgggtttgtcatagatagctcttattattttgagatatgtcccatcaatatctaatttattgagagtttttagcatgaagggttgttgaattttgtggaaggccttttctgcatctattgagatgatcatgtggttttcgtctttggttttgtttatatgctggattacatttattgattttcgtatgttgagccagccttgcatccccgggatgaagcccacttgatcatggtggataagctttttgatgtgctgctggattcggtttgccagtattttattgaggatttttgcatcaatgttcatcaaggatattggtctgaaattctcttttttggttgtgtctctgcccggctttggtatcaggatgatgctggcctcttaaaatgaggtagggaggattccctctttttctattgattggaatagtttcagaaggaatggtaccagttcctccttgtacctctggtggaatttggctgtgaatccatctggtcctggactttttttggttggtaagctattaattattgcctcagtttcagagcctgttattggtctattcagagattcaacttcttcttgatttagtcttgggagggtgtatgtgtccaggaatttatccatttcttctagattttctagtttatttgtgtagaggtgtttatagtattctctgatggtagtttgtatttctgtgggatcggtgatgatatcccctttgttattttttgtcacgtctatttgattcttctctcttttcttctttattagtcttgctagcggtctatcaattttgttgatcttttcaaaaaaccagctcctggattcattgattttttgaagcgttttttgtgtctctatttccttcagttctgctctgatcttatttatttcttgcattctgctagcgtttgaatgtgtttgctcttgcttctctaggtcttttaattgtgatgttagggtgtcaattttagatctttcctgctttctcttgtgggcatttagtgctataaatttccctctacacactgctttaaatgtgtcccagagattctggtatgttttgtctttgttctcgttggtttcaaagaacatctttatttctgcctccatttcgttatgtacccagtagtcattcaggagcaggttgttcagtttccatgtagttgagcagttttgagtgaggttcttaatcctgagttctagtttgattgcactgtggtctgagagacagtttgttataatttctgttcttttacatttgctgaggagtgctttacttccaactatgtggtcaattttggaataggtgtggtgtggtgctgagaagaatatatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggattctaagtctctttgtaggtcactaagaacttgctttatgaatctgggtgctcctgtattgggtgcatatatatttagggtagttagctcttcttgttgaattgatccctttaccattatgtaatggccttctttgtctcttttgctctttgttggtttaaagtctgttttatcagagactaggattgcaaccccttcctttttttgttttccattggtttggtagatcttcctccatccctttattttgagcctatgtgtgtctgcatgtgagatggatttcctgaatacagcacactgatgggtcttgactctgtatccagtttaccagtctgtgtcttttaattggagcatttagcccatttacatttaaggttagtattgttatgtgtgaatttgatcctgtcattatgatgttagctggttattttgctcgttagttgatgcagtttcttcctagccttgatggtctttacagtttggcatgtgtttgcagtgggtggtaccagttgttcctttccatatttagtgcttccttcaggagctcttgtagggcaggcttggtggtgacaacatatctcagcatttgcttatctgtaaaggattttatttctccttcacttatgaagcttagtttggctggatatgaaattctgggttgaaaattcttttctttaagaatattgaatattggcccccactctcttctggcttgtagagtttctgcaacgaaagcatttctaagagaagtttatagcaataaacacacagatcaaaaataagaaagatcccactaaaacagtctaatgctgaacctcaaaggactagaaaaaacaacaatataaatccctagtttatagtagcaaagaaaaaaacaaaggtcagaacagaaataagtgaaatagagactgtaaaacaataggaaagatgaacaaaacagaattgattttttcagaagataaacagttgacaaacttttaactaagaaaaatgacagaagactgaaatatataaaataaaaaatgaaagagtaggcaatacaggagataccacagaaatacagatgacaagagactactgtgaacagttatacacaaacaaattacataacctaaaacacatggatgagatcctggaaatgtacaactaccaagaatgaatcatgaagaaatagaaaagctttacataataacaagtaaggagattaagtcaataataaaaaatagctcttatgtgaaaaagttcaggacttgatggtttcacatctgaactttacaaacatttaaagaagaagtaataccaatgcttctgaaattcttccaaaaaattgaggagtagataaatctttcaaactattttaagaggcctgtatgaccctgataccatagacaaacaagtatattataagaaaaaattaccagccaatattcctgataaacagatgcagatattctcaataaaatactagcaaattaaattcagtaacacattataaggatctgttgtcatgatcaagttggatttatttctgggatgcaagtttggttcaacttatgcaaatcagtggaggtcatacactacattaacaaaaagaaggacaaaaatatggctatctgaatagatgcagaagaggcatttgacaaaatctaaaatattaagtaaagaagattatattagtccattctgacattactataaagaactgtaggagagcagccccagtgcttatagataaaactcccatctccctaggacagagcacctgggggaatgggcggctctgggtgcagcttcggcagacttaaatgttcctgcctgccagctctgaagagagcagcagatcccccagcacagcattcgagctctgctaagggatggactgcctcctcaagtgggtccctgaccctcatgcctcctgactgggagacacctcccagcaagggttgacagacacctcatacaggagagctccgggtggcatctgccaggtgcccctctgggacgaagcttccagaggaaggaacaggtagcaatctttgctgttctgcagcctccgctggtgatacctaggcaaacagggtctggagtggacctccagcaaactagagcagaccttcagcagaggggcctgactgttagaaggaaaactaatgaacagaaaggaatagcatcaacatcaacaaaaaggatgtccaccaagagaccccatcctaaggtcaccaacatcaaagaacaaagatagagaaatccacgaagttgaggaggaaccagcacaaaagactgaaaattccaaaaaccagaatgcctcttctcctccaaagtatcacaactccttgccagcaagggaacaaaactggaatgagaattagtttgatgaattgacaaaattaggcttcagaaggtgggtaataacaaacttctctgagctaaaagagctgttctaacccaatgcaagaagctaagaaccttgaaaaaaagttagatgaattgctaactagagtaaccagtttagagaagaacataagtgaccttatggagctgaaaaacagcacaacaactttgtgaagcatacacaagtatcaataggcgaatcgatcaagcggaagaaatgatatcagagattgaagatcaacttaatgaaataaagtgtgaagacaagattagagaaaaaagaatgaaaaggaaacaagcctccaagaaatatgggactatgtgaaaagaccaaacctatgtttgattggtgtacctgaaagtgacagggagaatggaaccacactggaaatcactcttcaggatattatccaggagaactttcccaacctagcaagacaggccaacattcaaattcagggaatacagagaacaccacaaagatactactagagaagagcaaccccaagacacataatcgtcagattcatcaaggttgaaatgaaggagaaaatgttaagggcagccagagagaaaggtcaggttacccacaaagggaaggccatcagactaacagtggatctctcagtagaaatcctacaagccagaagagagtgggggccaatattcaaccttctgaaaaaaaagaagtttcaacccagaattgcatatccagccaaattaagcttcataagcaaaggagaaataaaatcctttacagacaagcaaatgctgagagattttgtcaccaccaggccttcctcacaagagctcctgatggaagcactaaatatgggaagaaaaaaccggtaccagccactgcaaaaacataccaaattgtaaagtctttcgacactatgaagaaaccgcatcagctaatgggcaaaataaccagctagcatcataatgacaggatcaaattcacacataatatttatataaccttaaatgtaaacaggctaaatgccccaattaaaatacacagactggtaaattggataaagagtcaggacccattgatgtgctgtatttaggagactgatctcaatcctagtctctgaaaaaacagactttaaaccaacaaagataaaaaaaaaagacaaagaagggctttttacatttttacaaagaagggctttaccattacataatggtaaagggatcaatgcaacaagagctaactatcctaaatacatatgcacccaatacaggagcacccagattcataaagcaagttcttagagacctacaaagagacttagactcccacacaataatagtgggagactttaacaccccactgtcaatattagacagctcaatgagacagaaaattaataaggatattcaggatttgaactcagctctggaccaagcggacctaatagacatctacagaactctccacccgaaaccaacagaatatacattcttctcagcaccacatttcacttattctaaaattgaccacatagtggaagtaaaacactcttcagcaaatgcaaaagaatggaaatcataatagtctctcagaccacagtacaatcaaattagaactcaggactaagaaactcactcaaaaccgcgtaactacgtggaaactgagcaacctgctcctgaatgactactgggtaaataacaaaattaaggcagaaatcagtaagttctttgattcctatgaaaacagacacaacatagaggaatctctgggacacagctaaagcagtgtttagagggaaatttatagcactaaatgcccacaggagaaagcgggcaagatctaacatcgacaccctaacatcacaataaaagaactagagaagcaagagcaaacaaattcgaaagctagcagaagacaagaaataactaagatgagagctagagacacaaaaatcccttcaaaaaatcaatgaatcaggagttgcttttttgaaaagattaacaaaatagatcgaaagccagactaataaagaagaaaagagagaagaattaaacagacattataaaaatgataaaggggatatcaccactgatcccacagaaatacaaactaccatcagagaatgatataaacatctctactcaaataaactgcaaaatctagaagaaatggataaattcctggacgcatacaccctcccaagactaaacctggaagaagttgaatccctgaatagaccaataacaagttctgaaattgaggcagtaattaatagcctaccaaccaaaaaatacccaggaccagacagattcacagccaaattctaccagaagtacaaagaggagctggtaccattccttctgaaactgttccaaacaagagaaagagaaggaatcctccctaactcattttttgagaccagtatcatcctgataccaaaacttggcagagacacaacaaaaaaagaaaatttcaggccaatatccctgatatgaacatcaatgcaaaaatcctcaataaaatactggcaaaccgaatccagcagcacatcaaaaatcttatccaccataatcaagtcggctttatctctgggatgcaaggctggtttaacctatgcaaatcaataaacacaatccattatgtaaaccgaagcaacgatgaaaaccacatgattatctcaatagatgcagaaaaggcctccgataaaattcaagagccttcatgctaaaaactctcaataaacttggtattgatgaaacatatctcaaaataataagtgctatttatgacaaacccgcagccaatataatactgaatgggcaaaagctggaagcattccctttgaaaactggcacaaggcaaggatgccctctctcaccactcctattcaacatagtattggaagttctggccagggcaatcaggcaagagaaagaaataaagggtattcaaataggaatagaagacgtcagattgtctctctttgcagataacatgactgtatattttgaaaaccccatcgtctcagcccaaaatctccttaagctgataagcaacttcagcaaactctcaggatacaaaatcaatgtgcaaaaatcacaagaatttctatacatcaataatagagaaacagagagtgaaatcttgagtgaactcccattcacaattgctacaaagagaataaaacactaagaatacaacttacaagggatgtgaaggacctcttcaagtacaactacaaaccactgctcaaggaaataagagaggacacaaagaaatggaaaaacattccaagctcatggataagaagaatcaatatcgtgaaaatgaccatactgcccaaagtaatttatagattaagtgctatcccaatcaagctaccattaactttcttcacagaattagaaaaaactactttaaatttcatatggaaccagaaaagaggctatatagccaagacaatcctaagcaaaaagaacaaagctggaggcatcatgctacctgaattcaaactgtactacaaaggctacagtaactaaaacagcatgttactggtaccaaaacagatatataggctaatggaacagaatggagtccttagacatatcaccacacatctacagccatcttatctttggcaaacttgacaaaagcaatggggaaacgattccctatttaataaatggtgttgggaaaactggctagccatatgcataaaagtgaaactagactccttccttacacctcatacaaaaattaactcaagatggattaaatacttaaatgtaagacctaaaaccataaaaactctagaagaaaacctaggcaataccattcaggacataggcatgggcaaggacttcatgtctaaaacaccaaaagcaatggcagcaaaagccaaaattgataaatgggatctaattaaagtaaagagcttctgcacagcaaaagaaactatcatcacagtgaacaggcagactacagaatgggagaaaatttttgcaatccatccatctgacaaagggccaatatccagaatctagaagaaacttaaacaaatatacaagaaaaaaaaaaaaaccccgtcaagaagtgggcgaaggatagaacagatatttcccagaagaagacatttgtgtggccaaaaaacatatgaaaaaagctcatcatctttcgtcactagagaaatgcaaatcaaaaccacaatgtgataccatctcatgccagttaaaatggctatcattaaaatgtcaggaaactacagatgctggagtggatgtggaacaataggaccacttttacactgttggtcagagtgtgaattagttcaaccattgtggaagacactggtgattcctcaaggatctagaaccagaaataccacttgacccagcagtcccattactgggtatatacccaaaggattataaatcattctactataaggacacatgcacacatacgtttattgcagcaatattcacaatagcaaagacttagaaccaacccaagtgtccatcagtgaaagactggataaatcaaatttggcacatgtacatcatggaatactatggagccataaaaacgatgagttcatgtcctttgcagggacgtggatgaagctggaaactatcattctcagataactaacacagaaagagaaaaccaaacactgcatgttctcactcataaatgggagtcaaacaatgagagcacatggacacagggcgtggaatatcacacactggggcctgtctgggggttgtgggctagggaaaggatagcattaggagaaatacctaatgtagatgacaggttgatgggtgcagcaaaccaccatagcatgtgtatgtatacctatgtaacaaacctgcacgttttgcacatgtatcccagaacttaaagtatttaaaaaaaaaaaaaaacaaacaactgtccgatactgggcaatttatcaataaaagaggtttagttgactcacagttctgcatgcttgtggagccctcaggaaacttacaattatggcagaaggggaagcaggcatgtcttacatggcatcaggcaagagagcatgtaatggaagcaaagggggaagagccccttataaaaccataagatcttatgagaactcactatcatgagaacagcataggggaatccatgcccaagatccagtcacctcccaccaggtctctttctcaacacccagggattacagggattacaatttgagatgagatttgggtggggacacaaagccaaatcatatcaaagatttacctctaaacataataaagacaatataccacaagcccatagtgagtattatgctcagcactgaaaagttgaaggcctttttcctaagatgaggaacaagacatgggtactcaccctcacttttgttcaacacagtactgaaagtactaaccagaacagttaggcaagtcaaagaaataaaaaggattcaaattggaaaggaagaagtaaaattgtctttccttatagataacataaccttatatatagaaaagcttaaagactccaccaaaaacctgttaaaattgattaataaattccataaagttgtagattacaaaatcaacatacaatttttagtagcatttctatacagtaacatcaaattgcctcaaaaggaaattgagaacacaatcctatttacagtagtttcaaaaataaattaggtataaatttacccaaagaggtaaaaactctgtaagcagaaaactataaaccatttatgaaagaaatttagggagataaaataaaaggaaagatatcccatgttcatgaattgaaaggatgaacattgttaaagtgtctctacttcccaaagttatctacagattccatgcaacccccgtcaaaaactccaatgacatattccccagaaatagaaaaaaaaaatcctaaaatttgtatgacatcacaaacacttcaaaatagctagagcaatgttgagtaaaaaggataaaactggaggcctcatagtgcgtgctttgaaaatctactacaaagctgtgttaatcaaaacagcatggtgctggcataaaagcagacacacagacttacaggatagaatggaaaagccagaaaaaaatccacacatttatcgccaattgattgttgataaaaacgccaagatcacacaatgggggaagggcagtctcatcaataaatggtcgtagggaaactgggtgttcacttgcagaagaataatattagactcccatctcacatcatatatatataaatcatctcaaaatggattaaatgcttaaatgtaagacctaaaactgtgaaagtagtaaataaatcataggagaaaagctctctgtcattggtatgatcacacgtactttggatataacccccaaagcacagacgacaaaagtacaaatagacaaataggatgacatcaaactaaaaagcttctgcacagcaaaggaaacagaatgaagagaaaacctgtggaaaaggagaaagtatgtgagaccatatgtctgataaggaattaatatccagaatatatgaggaacttgaaagtaagaaaacaatctgatataaaaacatgcaaaggacctatataaacatttttgaaaataagacatataattggccaacaggtttatgaaaaagtgatgaacattactgatcatcaggaaaatgcaaattataactctaatgagatactgtcttatagctgttagagtggctactttaaaaaagaccgaaggtaagtattagcaaggttatggagaaaagagaacccttgaagactgttggttgggttgtaaattagtattacagccataattgtaaacagtatggaggtatctcaaaaataagaagtagaactatcatgtcatccaacaattttactatttagtgtatgtccaaaggaaatcatatcagtatctcaaagagatgcctgtatttctgtcacggcatccttggagtgttacttttctagctgggaacctctgtggctggtattgcctttgtctgaattttgcttgggcctgcttggcttgttctgcctactctgcctggcaggatacactctgctcgcactaacagcctgccaagggtgagccaggtacggagtggtgaggggtgtgtgagttagcgtgtgatctggccactgcacacagccaggcacactagttgtggtgtggtggacagctccaggtgccggcaccctgcaaggctgtggctcaatgaggcttactgcaagcagcttccatggctgccactggggtaggcagtggtgcctggaagcttggagacttcaggaactgcagagccccattgagggtgtcacagctctggcttggggagctcttaagtctgggctccctgaagtgctacagctcttctctccttcttgtcacctgcaacgtggcaagcaaggggcgtgtttcagccctgtttgtgttactgctctttcagtcgtgccgttccgcaggtcctgagttcttgtcctgtgtccaggaagaatgagttatgtggacaagtggagggtgaacaaggtgaagagatcctttattgagtgacagaacagcttaaaggagacccacagtgggtagctcctctctgcaggcagggcatcctgacaagtgttcagctctcagcagagaggagacccatagtgggtagcttctctccacaggcaggttgtcccatcatctgctcagctctcagcagagaggagaccctcagtgggtggctcttttctgctggcagattgtcctgtcatctgcttgagtttggctgagtccagggtttctatgggcttcagaggggaggaagtgcatgctgattggtccatggaaagccatgggcaggcccagaaaaagcaccagaagttctccctccagtccatggcactggcagtccagtccccaaacctcaggctgtctctgacctgaagatgaggtttcaccaggtacctgcccctttccatctaggcctgtctgcctcctgctgccattaacctgccatccacggtgcccatggtgcccaggctgtttgtgctgaatgttgcctgcaggcctgcatcaagccactcttagccccctgtcagcctttctcccatcctctttggtacccaaagtctggagggggccaaggcatgagggggctggtgtgtcatagctgccctgaatgtgtgcacacctggctgattcatgacagtgcccaggcttggccacaactttgcttcaaaattggagcgggtgtttgtagtgggtgcttggagtggggagaggctaggcagcaggagcagtcacttacaagcttgtgggtcagcagggcttcctgggtccccaagagtgtagagatgcccgggtttgcagccacagcttgacggctacaactgcgcccggggggcggggctcccacctgtttaacttggaatgggctgggagcttccacctgttcttggttcctgctggctccgtggagtgcacagccccagctgtgcctcccccactgcatctggtgtcattgatgatgccagggattgattgacaccattccagacaggctgccgctgccttcagtccctgctctgaagaggtacatctgctgccattaggatagggacaatgactgctcttaactgcttcatgctgacagggggcattgtttatggggaaaatggcagttatgtcttcttagaggccctatctaagggtccctagtaaaagtaaaagggagccatcagccaagtttccatttgcatgaccatttggagtttgatggcccgaaggcgagaagagacaaaccgggttattggaagacatggatcaaaacaaaacaaaggggtaaggacagctcaaaaaccctgaggctactcacatgctcaaaattagaatattgatccagattttttatattacgcatcccttttgtctcttctgagccgtagtcagaaatcactggttggttcacaagagcaagctgggttagtctaaaatgcagaccaaaacttaaaaacaaagtccggagggggctgaggcagcatggagctggcgtatcagcactgccccaagcgtgcacatacccagctatgtcatgacagtgcccaggcttggccacaacgttgctccaaaattagagtgggtgccaggagtggggagaggccaggcagcaggagcagactcttgcgagactgcaggagtgtcttcctaggcccttgagagtgcagaaatgcctgggtctgcagctgtggctgggtggctgcagctgcacccaggagggtagggctcctgccccttcaacttggaagtgggcagggcttccacctgttcctggctcttgcagctttgtggagtccacaagctccagccttacctcccacactgcagctggcatcatggcagtggccactccagatgccccactactaccatcacttccatgttcattgtggcgttatttccaatagccaagatgtggaatcaatctaagtgtccattaatgggtgaatggatgaagaaaacatgttatatatacacagtgaaatatcattcacccttaacaaaagaaggaaatcctgtcattctcaacatcatggatcaacctgtaggacattatgttaagtgaaataagtcaggcacagaaagacatactcatgatcttacttattataagtgtagtgtaaaaatgttgacctcatagaaacagtgaaatgttgattatcagaggctagggtgtgggaggaattagggagatgttggttaaaagacagaaaaatttatttaaagtggaggaataaattcaaagacttgtaaatcatggtgactgcagttaataacaatatgttgtatatttgaaaattgctaagacagtagattttaagtgttcgtaccagaagaaatgataagtatgtaaggtaatgtatatgttaaatagcttgatttagccattctacaggtatcaaagcatcatgttttatattataaatatatataatcagttaaaaaaaagtactgagactctgagaaaggcattagttaatttgcccatagttttatatttagtgaatccagtggtcttacttcagatgtgtattcttagccaaaagatgcacttgctttcacctccacttctgtccctaaaaactgaaaagcaaaataaagaggtggaaagaggctgggtgcggtggctcatgcctgcaatcccagcactttgggaggccaacatgggcagatcacgaggtcaggagttcaagaccagcctgaccaacatggtgaaaccccatctctactaaaaatacaaaaattagctgggcgtggtggcgcatgcgtgtaatcccagctactcaggtggctgaggcaggagaatcgcttgaccacggaggttgcagtgagctgagatcagcgccactgcactccagcctgggctacagagtgagactctgtctcaaaaaaaaaaaaaaaaaggaaagaaattcagtagccatttcattcagccttgcagttgatgcagtctttagctaaacactgggatagtttgggagggaaggccgtagtttgggagggaaggccgttagtacaatttttttatacgttgtgcataagaagcttttgagtcatggatctttgataattactttcagtagtaacgtatcctcggtaattttttttactttcagtaataacatatcctagacaaattttatgcatttttttccatacttgaaagaaactttttattaaaaaatagtattaataacggagcataatctggtaggagtgttcattactactgttttattgtttttaagttttttccatgggtagagtaggaaacacgcatttttggagagaaaaacatgaatcccaaatttatcctcattccaatttaagataaagattttgagggattttatttaccactttggtcttaccctttttgtatatctttttcttttattatccttttacctctgttctctgattttacatttttttttgcattttttttttttttttgctagatgcaggcctaggtattttattttacttttcgttatacagtcttctcgattattttaactaagcaggtttttttggatggtgggaggagaaggagaaaacattaagttgtctgcttcttatttattttacatattgcttataattctcttgtgaattattttagggtttttattggttgtttttgtttttgccttcctgatataaaaattatattgcttgcaaataaagattactttccttctttttcttccatttttggcctctaatgttttctttacttgtgttgtttaagatattaaataatagaagagatagtggacatccttgtcttattccttattttaatgagaaagtacctaacatttccaatttagtaagttgctggctaattgggaagtacagacacatgtgtatatctatatatctgtatatctatatctatatctatatgtattcaggctaaaaaatacctcttaatttctatgtaaacgttaaaatttttattttggtaattatgtatgatgttgaattatgtcacttgaatttttagcagttatgaaaatgaacatataatcttctgttaatataatggattttattaatgcatttttaatattagaaacctttgaatttctggcatgtacccctctttcaaatgttttttagtgttttggattcttttgcatattatctcatttaaagtttttgcatcattattcttcagtgtgtttgatttgtacagttttctgtgcagttttgtgaagttttggggccaatgttatatatctgttatataaaaataatttggaaattttcttcctttttaaaacctagtccttatttttattttattcaggcactgttttaacagatgatcaagtacctaccatgtgctattaacaataaaattgtaatggtagttaatagttccttagctcttaactatatatttgtcagtattctaagtacagttgattctcactgcttgaagtagatttgttctgtgacgtagcagtgaataataaattagctcttactggaattacaatgttaggttcctgtaagcctctggtcacaacatttttgttcacctatcaatacgtaacttttaaaaaatgtgtatttctgtttaaagacaacttatttaaaatatgtattgttgattcattaatattgaactcatgtcccacagcagtatgactcatgcctgaaggaagcttttgtaacacacatattttctccttaaggcatatcacaggcgtcttgtgcttaggaacactagatagcacttgggcattctaaatagccaaatcatcaacaaaaagcacaaaaatgagaacattgttgcacttaatagactgtgaaaagaataatcctttatagtatgagagcagaaacaaagcagagcatttgttcagtttcagctgataggatgcaaatcaggtgactcaaaattctcctcctcctgcacatttccacaaattattgccaaagtgctacgaatattgatgttgggatacaaataaattttattgagtagacaaattcataaatgcggaatctgtggatgaggattgatcgtatttctttgtatttaatatgtgttcatttattggtcatagcaatcctatgaggtaggtattataacacatactatacaataaagaggttaagttccttgtacagtgttgaacaatcaatgagtgtttgaggacaccaccaaagtagtataactgataccaagacatgttgtttacccttaggagctatttctatctaaaagcgttaaaggtgttttgctcaaataactaaatttaaggtagtttgaaataagtagcataagtgtagtgctaccaagatgtagtggatattcagagggaagattattttggagaccacggaaaggctttaggtgatggtttctaaatggaggcttttagaatcaataagatttcatcaagttggcttatgaggatgtaggagatgaactatttcagaaggtactcattttttacatcaaatacgttcaatgattctagtcttttgggaataggaaagtgatggtgaaggggcaacctctttagttttcagttttcgggattcatatactcactctatgaccattttttccagtactatttaaaaatttattctgcctttgtaatactgggaactaaagcatagcaccattaattggaagtcttaaagatgaacaaggcaatgttttaatgtaaatgtatgattttcttattatggaagaagaaaaaccaataatagattgacatttgtgcaataggactgcaaatagtgggtgttttgtgggagaaaaaattgtttcccaattttttgggaaaaattcaagtaaatattaaaaattgctgaaatacaaagattttcccccatatacaatacttttgtaatatactcatcatgtttttcaatgcatctcattagccatacctcttaactgcattgtaaaaaccaaaaaattaagagggaatattttaaaccaaatattctaacttcaataggcatcatagtgattatcatttcagatttggtgtccttgtaactgggctgatttatcataggtggtggatgtgtaaacttacctgtgtatgatcttgttgagggcaagaattgtggcttttcattttttgcgtttctgataaccagcaaagttcctatcacatagaaagccctcaggaaatgttactgcctacctaaatgaatactccaaaaccctttatgactaataatttctatgtaaatattgtagattgtgttgatcagtgttcttccattctatgtattaatgttttattttcagtgcaacactgtgagagtgatcaaagtgcaaaaatcctgtccttatatttagctttataatcagaaaacaccatactaatccataattttttttcacaccattggcctgcttttctttttattgttagttttgtttttattgtcagagaatgttaggtaatttcccagcataactttctcaagaatatatttcctcattactgcagtgaataactcagtgatgtgaaattagaagataacctattctgtttcagcaccagtgctttgacacatataacttgaaatgtgaatacgaattttgttttttcatgttaaaggattcaatttttcatcagttacttagatcttcataaaatctgaagttaggaaggaactttactaattattaagtcctattccattttaatgcctgcaatagtaaatgtttatttatgataaaactctgattaggtagtagggaaaattcaaggtcaaaagtacaaatttctaccaaactaaagaaagaatatgttaatatgacttgcaagcttggattcatatatattaaggaggggggtggaagatgacagttttaagaatcacatagtgttcaacaaaaagccaataaaaagtcctctctgtgccaagagttattgaacattttgaaataagagttataaattaattcatatatttcaatattatcaacatttgctcttggtcaagttcccctcctctcccaagaagagattgttttttgatccagtgttcaattttggttctctccgttaaacatatcaagcttacaagactaagataggtgtcactgagaatgtattttattaaaaacaattgaaaaaattgtattcttaaacatgggatcatatttggagtcttggtgtctatgaaatcctcctggtacaaaatttatatatggataaaaactaaaacagtaggattttgaaatcttttaacttttagattacaaaaagaatatgggaaatacagaaacacacaagaagcaagttttaaaatccctgtaatccctctatccagaaatagtaatattttgatgtatacattttcagggtttttttgtgtgtgtgtggtgtatgcacacacatctatactattttacaaactttgaatcataccgtacgaacacttttgttccttgcttttttcaactttgtgaacattttcctatgccaccaaaaatttagttcaaagtcatttaaaatggttatataattttccactgaatgcctgtatcataagtgatcttcagcagtaggacattagatatatagatatatccagttttcaattatgaactgttatgctaagtatttttatgtagctttttatacacaattcctatttttgtatggtgaagggaatgggattttaattcttatattgaatgtaccttgcaactatacttctgttttatcttagatattatcaaatgatatatttaaatatttatcttggtaaataaatacttgataagttaggtcacttttgtcacaaacaaaatttttaattttttattctatttctacataggtcagttgtagttgtaatgaaggaatcataattcctcaaatctaaaaattagaaagatggaaactgatatttcttcacatttaatagtttgattatacatcttatgattaatgttagtattatctgagacaaatatttcactgtcctttatgtaaagttctttatgtacattgtccactatgacaaaatatgtctcttaatttaggtcttggggaatgaacacttgtttttaatattagcctatcagagtaagcactttaattggattagctcatttaattctcataacattgcatgaactataggtagcattttatcctattttatacatgaggaattctgactcatagagtcctcatgtgtcatagagtcctttgtagagctgcaaagtataggcagtaatataggtggtagtatcatgattgatttgtaggaactctgttactggcacctgcatttgtaaacatctacagcaggaatgtatgccatttaatgcttttgttttttttcttctactctaattgaagattattttccaaagttattctcttaacaaaaattgaaaaatatactatatagaatatgtatatagatatttgtatgcatatgtatgtgtacgcattcgggtatgaatagaaatccacaaacctaactgaatagttgctttgcagacacttggttatgaaacactatccactgaccgaaatattttttctggctataattttggagtataattaaaatataaacttgtaagttcctctttttaaaaagatactttagaaaaacagattttactcttttcattagaaaaatattccaatatgtaacagtatatatactcagaaatgcatatgtctgatttaaaatgatttattctttagttttaagcctatgtatatattttaaaaataatttcttattttaggttcgggggtacatgtacagatttgttacatgggtatattgcatgatgctgaggtttgggatatagatgatcctgtcacccaggtactgagcataatatctgataggtagtttttcagcccatttccccctccctcccccctccctcctttagacaactctaaatgtctattgttctcatctttctgtccatatgtattccgttatttaggtcacgcttacaagtgagaacatacagtatttggttttctgttcctgtgttaattaggataatggcctccagccacatccatgttgctgcaaaggacacatttcagtctttttatggctgcgtagtattccatggtgtatatgtgccacatttgctttatcgactctaccatcgatgggcacctaggttgattccatatctttgcgatcgtgaatagtgatgcagtgaacatatcggtgcatatgtctttttttaggataatttatttgcctttgggtatatacccagtaatgggatggctgggtcaaacagtagtcctgttgtaagtttttgagacatctctcaactgctttccacagtggctgaactaacttgcattcccaccaagagtgtatatgtgttcccttttctccccaggcttgtcagcatttattattttttgactttttaataatcaccattctgactggtgtaagatggtatattgttgtagttttgatttgcatttctctgatgattagtgatgatgaacatttttcatttatttcttggccacttacaatgtcttcttttgataagtgtctatatcctttgccgattttttttttttttttttttgagacggagtctcactctgtcgcccagactggagtgcagtggcaggatctcagcttactgcaatctctgccccccaggttaacaccattttcctgcctcagcctcccgagtagctgggagtataggtgcctgccaccaagcccggctaattttttctattttgtttagtagagacggggtttcactgtgttagccaggatggtctcgatctcctgacctcttgatctgcccgcctcggcctcccaaagtgctgggattacaggtgtgagccaccgcacctggccccattttttaaaggagttatttgttttttgcttgttgatttaagtttcttatagattctggatattagacctttgtcagatgcatagtttgtgaatattttctcccattctctaggctgtttactgttgataatttatttttctgtgcagagctatttagtttaattaggtcccacttgtcaattttcatttttgttgcaattgcttttggggacttagtcataaattctttgccaaacctgatgtcaagaagtgcatttcctaggttttcttgtaggatttttgtagtttgaggtcttatctttacatctttaatccatcttgggttaatttttgtatgcggtgaaaggtagagactagcttcattcttctgcatgtggctagacagttatcccagcaccatttattgaacagggagtcctttcctcattgcttccttttgttgactttgttgaaaatcagatggttatgggtgtatggctttatttctgggttctttgttctgttccattggtctatgtgtctgtttttgtaccagtcccgtgctattttggttactatagccttatagtatagtttgaagtcaggtagtgttctttttgcttagtattgccttggcgatttgggatctgcttttgttccatgtgaatattagaataggcttttctaattttgcaaaaaatgatgttggtagtttgatagaaatagcattgaatttataaattgctttgaccagtatggccattttaacaatattgattcttccaattcatgggcatggaatatatttccatttatttgtcttgtctctcatttatttcagcagtgttttgtagttcttgtagagatctttcacctctttggttagatgtatgcataggtttttgctattggaaattggtgtgtgttcttgatttggctctcaggtagaatgtttttggtgtatagaagtgctattgatttttgtacattgattttgtatccttatttatcagttccaggagccttttggcagcatctttaatgttttctaggtatggaatcatatcatcactgaagagaggtaatatgacttcctttcctatttgaatgtattttatttctttcttttgtctgattattctgactagcactttcagtactatgttgaataggagtgttgagagtgggcagccttgtctcattctagttctcaaggagaatgactccggcttttgcccattcagtatgatgttggctgtgggtttttcattgtgagaatgaataataagaatgaataaggtttttcattcttattattgtgaggtatgttccttcgaagccttgtttgttgagggtttttatcataaagagatgttggattttgtagaaagctttttcttgtctattgagatgatcatatgctttttgtttttgattctgtttatgtggtgaatcacatttattgatgtgcatatgttgaaccaaccctgcatccaagaatacagcctactcgatcatggtgaattaactttttaatgtgctgctggattcatttcgctagtttttttttgtatttttgtgtttttttttgtttttttagggttttgtgtttgtgttcatttgggatattggcctgaagttttcttttttgttgtgtctttgccagattttggtatcaggataattctggccttgtagaatgagttagggagcagggggagtccctcctcctcaatttttttgaatattttcagtaggattggtgccagttcttatttgtatgcctggtagaattcagtgtgaatccttctagtccatggctttttttttgttggtaggtttttaattactgactcaaatttggaacttgttattggtcttttcaggttttcactttcttcctggttcaatctttggaggttgtgtgttcccataaatttatttcctctagatttcttatttgtgttcatagagatgttcataatagtctctgaggatgttttgtatttctgtgggatcagttgtaatgtcatctttgtcatttctgtttgtgcttatttggatcttccctttttctcctttgttaatctaatgagaagtctgtcaatcttttttattcttccgataaacctactcttctttccattgatcttttgtatggatttttgtgtcttaatttaattcagttctgatcttaattatttcttttcttttattagctttgtggttttttttttttttctagttcctctaggtacaaagttagattgttaatttgagatctttctaatttttgatgaatgcatttggcaccgtaaactttcctcttaacatgctgtagttccatcccaaagattttgttaatatgtggttctgtttttgtgaatttcgaatagttttttggtttctgccttcatttcattatttccccaaaacttattcaagagcaaattccttccttttcatgtatatgtgtagctttgagagatcttcttggtgttggtttttgtttttattgcactgtgatgtgagaacgtgcttaatatgattttgatttttttgaatttattgagacttgctttatgaccaaaacatttggttgatcttagaatatgtttcttatgcagatgagagaaatgtatattatgtgattttgggtggactattctatagatgtctattaggtcccattggtggactgtcaagattaagtctggaatttctttgttagttttcttcctcagtgatctgtctaatcctgtcactggggagttgacatctcccagtattattatgtggctattgaggtctttttctaggtcaaaaaggacttgttttatgaatctggatgctccaatgttgggtgtgtatagacttaaggtagttaagtcttcttgttgaatggaaccctttgccactatgtaatacccttgtttgcccttcttaattgttttcagtttaaagtctgccttatctgatattagaattgcaactcctgctctttattgttttccatttgtatggcagttctttttccctttaattttgaggctttcggtattgttacatgtgagatgcatcttcttgaagacagcagacagttggatcttgtctttttgtccagcttgccatcctatgccttttaagtgggtctttattccattcacattctgggttggcattgatatgtgaagttttgatacagaaattgtgtttttagctggttgttttgtagagttgtttgcatagctgctttatagtgtctatgggctatatgcttaattgtgtttttgtggtatcagatactgttcttttactttcatgtttagcactcccttatggactttttataaggctggtctagtggttacaaattcttagcatttgaagcttactttggtgggatatgaaattcttcattggaatttattctttttaaggctactgaaaattggtttccgatctcttctggcttgtaagtttctgctgagtagcccgctactatcctgatggggtttcctttataagtgacctgactcatctctctagctgcctttaagattttttctttaacatcggccttggtgaatctgatgtctgtgtgtcttggggatggtcatcttgtataaaactcacaagagttttctgtatttcttgaatttgcatgttgatatctctagtgagattggggtatttttcataaactgtatcttcaaatatgttttcaaagttgttttctctctcaggaatgccaatgaatcctaggtttggtctctatataatcccatatttttcagaaatttttttcatttttaaaatattcttttttccttatttttgtctaagttgaattgaaagaactaaactggtcttcaagctctgagcttcttttctcagcttagtctattctgctgtaaatgcttctgattgtactatgaagttcttgtagtgaatttttcaattttagaagttcagttcggttctttttaaaaatggctattttgtctttcagctcttggatagttctactggattcctttgattccttgaattggtttcacctttctcgtaaagccattgaacttccttgttatctagattctgaattgtctgtcatttcagtcatttcaatctggttaagatctattgctggggagcttctgcactcttttggaaagaagaggacagtgactttttgaattgttagagttcttttgctgattctttttcatctgagtgggctggtgttcctttaactgtggtataagttgagtatactcaattggcttcttttctaagtgttttcagagggccaagactctgtacaggatttttatttgtgagtagattctttccctgggtttcacagatgatgtatattggcagaatatttttggtgttgtaatttggtctgtcaaccagtagatggtgcttaagtataatggccgatagataggctttggctctgacttgtcgctcttttgtatttcagcaagtttagagcaccgctgtcttccctaggagccattcagtggcaggaactagccctcacattcggaaaccccacacaggtttcccagtttcctctctcttcaccctcagtgtctatgttgcctttgaactcttggtgtttcctctctgaagatttgttcaaagtatgtttgtttacttgatattttggtctctcttggtggcataggcacttcctggctgtgtctagtcagccatcttgtcttctgtgccctctcaaatccttcttcaagccagtatttttgttattgccattgaaatagacaataattgtcctaatgttaaggaaaaatttattcagtgatacttgttaaagtacattaaggaagactttatttagggtcattgcgatagatgtaaggaccactgacatgggattttacagtgagggagagagactcacaatacaacatgggcaagtgggaatttatagccaatgagaagggatggagagttagtagatagaaaattactaaaaggaaatatcagacttaaaaggtgattctggctaaactcacctagaaggatttttttctgaagacaggccaagataatcagacatctcctggggatggtggggaatgaagaatgcaattagatatccagggtgatcagttatcaatgtttttgctgtactgacttagcagagttttttgctaaaactgaattttacaagaaagtgcacagatgggcctaggagaaggcttggtcaagcaaataatcttcatcagttataaagcccttcacataataaaagcggctttaataattgtgaatttaaccttgcatagaaatttttcaaataagaaactaatatacttcaagaatatgcaggggattttttactagtaatttagttacatgtttccctctttttgttcgttagaagttacatgagggcagttatgacttctgttcactaaggttaattccattgaatacatacaaagcattattttcaaggccaaggccattggtagtggtggtaggggctggaacaaagaaatttattagataagatacccttaacactgatatacgtccattttgttttaagagcatttctgtagagacaaaaaagcatagaaaatatactcattgctatttggagtactttgtggtaaatctggaatccttgcttttgcttttatagtagttccataacaaggttatttttaaaacatcatccaaaactgaaatttcaacattaattggattggcacttctagttgtaaatcagcacttccagtcataaatcttgaggaaattggtatcagacctcatgatattctgttttcagtaggttagttttctcagcattattttgtgctaaggagaagaatctctgtgttttaaaccttttcaaagctatgtaacttgatatttgctcttttaaaatcttagccatcaaataccagctctactgcctgtgtccgtggctttccattctccctatcattgccctgttagggcatcattatcagttagagagacttgtattgcttccatactattcttcactgctagatgaaagtttctaaagtttagctcttatcctgtcattacaaacttgaatatgtagaataattccccattgactaatgtgttttctgtggcctaacatttctatcctttttgtgtgatttcatcccccatctacttttttagttttatattccatcgttcttttttcttcgcctaatacttaaactgttctctaaatagcccaacaccaatatgtgtatttatcattttctttacattgttttatttctctgaaatggcctttcttcagttttgcatgcctaaactctaccaaatgagcccaattgtaatgacttttccatgaaggccttcaaaccaagttatcacttgtttttctttgcttttattattttttttaacttttaaaaatgttttcttctaacttctttttaatttttttgtatttatttatttattgccctcaaacattctcctatccagttattgttcttttataaagctcatctctccttccctcccacatagttgctctgcatactttctactcctcttatttaattttttgttttggaaaatttagggactatacaaaataaacacaatgaagtttatagtatgatgtatcaccatgtacccatcactcagaaacaagttatcgttatgacattcttgtttcgtttttgcattcctccacttctcaccatccactcagtcattggtaattctttaagataaaatttacataattcaaattcacaaatctgagctggacaattacgacaattaagtaaacacatgaaacccaatccccctttcaaagtatagatagaatgtttctttctctccagaaactttctattgcctctttccagtcagtcttcccaccctcataggacggctttaacttttcttcaccttttgttttacctttcttgttctttccatgtaaatggaattacactctgtgtaagtcttcttttgctcaacatgtttctgagatttatctcttattattgcttggaacaatagtccattccattttattacttagtactattccattctgtgactgttttataatttgtatatccatttggtttatggactttttgattattttcagtttttagctattatgagtaaagctgctgtgaatatatacatgtaagcctttttgtggatattactgattcttgttattcactctagttatgttctgtaaagtcaccgtggacactgaattattgaatactgaaccattgcttctaggggaaatatagggttaggttcttgtgatcctctggtcacaacatttttgtgaactgatcaacatataattttgttttatgtgtgtttctgtttaaaggcaccttatttactatatattgttgtttcattaacattgaattcacagccaacagcactagaactgatgtctgaataaactttatctaaaatgtattttctccttaaggcacaccacagccttcttgcactcaggaatactacacagcacttcagtattcttcatggcaccattctacacaacaaaatcaccaacaaaatgcatcacaacttgaaaaacatggcaaaaaatagatcatgaaaaggacgcttgtttacagtatgattgccaaaacaagagagagtattggtatgttccacatcagctgagaatgtacctgtctgctgactcaaatttttgctgctccgtacacatctacaaattattgtgaaagagcttcaagtattgattttggggttactaacaaattttagttaggaggtgaattcacaaatgtgcaatctgtgaataatgaagattgtatatgttcttatttttcttggatagatattagtattcacaaatgtgcaatctgtgaataatgaagattgtatatgttcttatttttcttggataaatattagtataattgatgggttaaatagcatccatactttataagatactgccaagcctttttctaattgtagttgcaccattttaaattcttattattaatgcataagcattccagttgtttcatatattcatcaacatttgatattatcagtctttcattttactcattgtagcactcatttgatttttccttgctgtagttatgtgtttatgtcttatctctcccggctggaaattttttggcggcagtatataatttgtatttgtatttgccaaactaatattttggagagatactatacctttgttgttatgtgcacaaacgttggagctagaatgcctgtggtcaaagctcaactctcccacttacaaattttgaggccgtagataatgaaaataacataacagtaaaataactttttataactatattaatttgggtctctcaacaaacaattattattagtagtttggaaatcaagcctttttgaggttagatagcttgtcccagatcaaacgagtaagaggtaccagaacaagatttcaaattcaggtctaacttactccaaagccagtgctcttaactactgcacaatacagtattgccgcctaaatcccactttaaaacctaccatatgtcattaaattaatgctcatcatcctctattaagatgtaaatgatattgaattaatttaaaacttattcacttattgtaatagattatatactttttgcttttctacatgcaaaatgatgttatttgatattaatagtaattatattctttcactccaaaactttagcttttttttttttttgcctattgtgatgtctagcaccaccagttcaaatttgaatagaaatgataatagtgcatattttttgtctcgtttccaatttaaaagggaaagtttttaatatttcatgattaaacttcaagatgttttatgtattcttttttatgatttttttctttatttcttgtaaaaaaatgggatacatatgcagaacctgcagatttgttacataggtatacatgtgccatggtggtttgctgcacatattgacccatcctctaagttccttcccctaaccgctcatcacccaacaggtcctggtgtttgttattctcctctctgggtccatgtgttctcactgttcaactcccacttatgagtgagaacgtgcagtgtttggtttctgttcctgtgttagtttgctgataattatggcttccagcttcattcatgtccctgcaaaagacatgatctcattcttttttatggctgcatagtgttccatggtgtatacgtatcacattttctttatccagtctatcattggcatttgggttggttccgtgtctttgctattgtaaatagtgctgcaataaacatacctgtgcatgtgtctttatagtagaatgatttataatcctttgggtatatacccagtgatgggattgctgggtcaaatggtatttctggttctagatccttgagaaatggccatactgccttccacaatggttgaactgatttacattcccaccagcagagtaaaagcgttcctatttctccacagcctcgccagcatctattgtttcttgactttttaataattgccgttctgactggcatgagatggtatctcattgtggttttgatttgcatttctctgatggtcagtggtgttgagcttttttttttttttttgtatgtttgttggccatgtaaatgtcttcttttgagaagtgtctgttcatatcttttgcctactttttgatggggttatttttttcttgtaaatttgtttaagttccttgtagattctggatattagacctttgtccaatgtgtagattgcaaaaattttctcccattctgtaggttgcctattcattctgatgatagtttcttttgctgtgcagaagctctttagtttaattagatcccatttgtcaattttgatttttgttgcagttgcttttggcattttcatcatgaagtctttgcccatgcctgtgtcctgaatgatattgcctaggttttcttgtaggttttttttttatggttttgggttttacatttaagtctttaatccatcttgagttaatttttgtgtaaggtgtaaggaagggtccagtttcagttttctgcatatggctagcctttttcccaggaccatttattgaatagggaatcctttccccattgcttgtttttgtcaggtttgttgaagatcagatggttgtagatgtgtggtgttatttctgagatctctgttctgttccatatatgcctgttttggtaccagtaccatgctgttttgattactgtagtatagcttgaactcaagtagtatgatgcctccagctttgttctttttgctcaggattgtcttggctatatgggttcttctttgattccatatgaaatttaaagattttctaattctatgaagaatgtcaatgatagtttgatgggaataacattgaatctataaattacttcgggcagtctgtcctttcgggttttcagcattttttcattgattctttctcatctttgtgagtttgtccagtttgatctttgaggctgctgacccatggatgggtcagctgttgttgttgctttctgtttctttgtgttttgttgttgttgttgttgttgttgtttcagttgtcaggtccctcttctgtagggccactgcaatttgctgggggttcacttcaggccctatacatgtggtttgctcccgtgcctggagatgtcactcaaggaggctgcagaacagcaaagatgggtgcctgctccttcttctgggatctctgaccttgaggggcaccagcctatgccagtaggattgctcctgtatagggtgtctgacaacccctgttggagggtctcacccagttaggggcatggggaacaggaccccttttttttttagacggagtctcgctatgttgtcaccaggctggagtgcagtggtgccatcttggctcactgcaacctctgcctcccaggttcaagcaattcttctgccgcagtctcccaagtagctgggattacaagcgtgtgccaccacgcccagctaatttttgtatttttagtagagacagggtttcaccatgttggccagaatggtcttgatctcctgacctcgtgatctgcctgcctcggcctcccaaagtgctgggattacaggcgtgagccaccatctgcgcccggctgaacaggacccatttaacgaagcactttgactgtccattggtggaggggttatgctttacttgggggaagcacgttgtctgggcttcccggattcctcagaaccaccaggaggaaaggctaagtttgctggtctgcagagactgctgccacccttttctctaggggctcaggcccctaccccaaggagctgaaatggcttagacagcagacagctgtagctgtggtgctggttgcccctcctgtagggagctcagtaggcttcagcagattccagctgaaaggctattgagaatctgcagagctctggggttgggacgctagggcccagtggcatgggttcgcaagttggatcttctgatccatgggttgcgcagttctgtggaaaaaccacggtttccccagctgggtggaatgctcactcactgcctcccttggctatggggagggtgttcccctgcccctgtggctctcaggtgggctgccataccacactgttcttccttcctcttcatggaccacacaagctttctggtcagttctgatgagataacctggataccttaattgctggtgagggattcacagtcttattatgattcttttcaatgggagcctccgaacatggctgtttctactctgccatctagatagtcttaatcagattaaggaatttccctttttcctaggtcgctgagagttttttttcataaatggatattgaattttattatttttttaattattgaaattatagtttattttcttctttgaaagagaaatacatgtgtagtgaattacattgattgcattcttgaaatattaaaccttccatgtattcatttcaatcacttagctgagatatattttgtaataactggctttaatgtgctaattttgtgcttgggactttcacataagtgattatgaaagagattatcttctaattttgtttttggcttgtgttgatatcaaggttattttgggagggctaacatttttctgttttctggaagagtttctaaaagcttggttttatttcttcagtatatataactggtggtatttttattcttttcaatcttacatttttttcttgtgttattgtagtggctaggatctctagtacaatattgaatagaagtggtttgagtgaatatccttggttagttgagaattattaggatgatagccttcagtactgtaatgtcataagcattttaagtgctaggtgttatttattggctacttttattcataaaagttccacatgttgtccaggctggtctcgaactcctgacctcaggtgatccacctgtgtctacctcccaaagtgctaggattactggtgtgagctactgcgcccggccgagtttattttttaatcatacatttgtgttgaatttttaaatcaaatttatctattgaaaaggttatatagttttatccatcagtctgtgtagagatggtaaaatgttaatccaatattgcatttgagggatagtatcctttctgtatattgctgtattcattttctgtttttaaaaggatttttgcatctctactcatggaaaatactggtcagggtctatacttctgttttcatttaatgtccttggtcatttggtttcaggattagctcacttcataaagtaagttgagaatttaaatagttgacagagtttaccagtcatattatctgtggctagaatcctgggttggagtgtgttatttatgtttctgttggtggtgggagggtagacatgacatgcaataaacggcacattttaaatttatggttttatgtattattcattgtgaaattgtaactacatggaagatggtgaacctatccatcacactctacaagtttcccctcaatttttttgtgattctgggtaatctttcccttttgttctcccttatctccatctatcaccaaactgtattttctttttcccataatgatcagtttgcattttctagagctttatgtaaatagatagttacaagagaaagtcatttttttctggcttccttcactcagcgtaagtatttggaggtttttcatataaagtttattcttttttgttgttcattcatattccattatatgaatatattcacttgatcatagacatttggttgtttctagcttttggctattacaaataaaatgtacatgtgtaagtctttgtatagacatttacttttttattcatttcagtaaatacctgtgaatgaaatggctagatcattgggtagctgtatgtttaactttttaagaaactgctaaattgtttcccaaagtggttgttctcattaacagtgtaggaaggttcagttttttcagatccttacccacatttgttatgtttggtcttttaaattttaaccactgtaaaaggtatctagttgtatcttattataattttaatttgcattttcctgttgactagtaatgttgaagatattctcaggtttttttttttttaccatatgtatatcttttttttggtgaactgtctattcaaacgttttatccttttatgaaattgagttttttccttattgttgagatttgagagttctttatatattcagaatgcaagtaagacatatgcttgtaaatatttacacacagtctttgacatcttttcattctcatagcagtgtctttcacatctatcttgagacttattcctaagcatttttatattttacatgttattttaattggcattttaaaatgtttcatttaattttattttccatttgttcattggtagtatgtagaaatacaattgatttttgtatattgacctggtattctgcaactatgctaaacatacttatagttctagcagcttttgtgtagttttggggagcaaatagggtcctgatagagagatggctttatggaagaagtacaaggacccttacgggccaggttaggagatgtaaggagattcctcaggatttgatcgccagtgtttttgtctaagtgttggatatatggagtgggtgtggagggaattaccccactgccctacctgttaatgaatgtttagaggttaggcagagggttcaggcaagctgcctaaatggttctcggttgttgttcacacttacccatgtgatagaaaaagtgaaggttatcctgacagtgtggtaataagtcctgtgcctctactcaaaaggcagtattgctatggctgcataaaggatccctgaggctgaagtaacatatgtcagcaatgaggatacaggcctttaggtaaactaatgtattagtccattttcaaactgctgataaagacatacctgagactgggcaatttacaaaagaaagagatttaatggacttacagtttgatatggctggagaggcctcacaatgatggcagaaggcaaggaggagcaagtcacatggatcatggcaggcaaagagtgaacctgtgtagaaaaactcccatttttaaaaccatcagacctcatgagaactcattcattatcatgagaacagcacgggaaataccttcctccccaataattctgtcacctcccaccaggttcttcccatgacacgtgggaattgtaggagttacaattcaagatgagatttggcagaggggacacagccaaaccatatcagtctatctctgaccgctctcaaatctcatatcctcacatttcaaaaccagtcatgccttcccaacagtcccccaaagttttaactcatttcagctttaactcaaaagtccacagtccaaagtctcacctgagacaaggcaagtcccttctgcctataagcctgtaaaatcagaagcaacttagttacttcctagatacaatggaggtacaggcattgggtaaatacaaccattccaaatgggagaaattggccaaaacaaaggggctacaggccccatgccagtcccaaatccagcagggctatcaaatctttttttttgagagagagagtctaactctgtcgcccaggctggagtgcactggcgtgatcttggctcactgcaagctctgcctcccgggttcacgccattctcctgcctcagcctcctgagcagctgggactacaagcatccaccaccaagcccagccaatttttttttttttttttgtatttttagtagagatggggtttcactgtgttagccagggtggtctcgatttcctgacctcatgatccgcctgcctcggcctcccaaagtgctgggattacaggcatgagccactgcacccagccaatttttttttttcgtatttgtagtagagatgggatttcaccatgttagccaggatggtctctatctcctgacctcgtgatccacctgcctcggcctcccaaagtgctgggattacagatgtgagccacagtgcctggccagggctgtcaaatcttttttttttttttgagacagagtctccctctgtcgcccaggctagagtgcaatggcacgatctcagctcactgccagctccaccccctgggttcacaccattctcctgcctcagtctcctgagtagctgggactacaggcacccgccaccatgcccagctaattttttgtattttagtagagacggggtttcaccatgttagccaggatggtctcgatctcctgaccttgtgatccaccgcctcggcctcccaaaatgctgggattacaggcgtgagccaccgcacccagccggctgtgaaatcttaaagctccaaaatgatctcctttgactccatatctcatgtccgggtcatgctgatgcaagaggtgggttctcatggtctgggcagctccacccctgtgtctctgcaggatacagcctccatcccagctgctttcattggctagtagtgactgtctgtggcttttccaggcacacagtgctgtcggtggatctgccattatggggtctggaggatggtggccctttctcacagttccactaggttggagccccagtaggaactccatgtgggtgattcaaccccacatttcttttctgcactgccctagcagaggttcttcatgagcgccccacccctgcagcaaacttctgcctggacatccaggtatttacgtacatcctgtgaaatccaggtggaggctcccaaacctcagttcttgacttctatgcacttgcaggctcaacaccacatgaaagctgccaaggcctggggcttgaaccctctgaacgcatggcctgagcttatactggcccctttcagtcatggctggagcagctgggatgcagggcaccacctttctggactgcacacaccatggggacccttggcccggcccacaaaaccatgttttcctcctaggcctttgagcctgtgatgggaggggctgccatgaagacctgtgacatgtcctggagacattttccccattgtctaggggattaacattcagctcctcattacttttgcaaatttctgcatccggcttgaatttctcctcagaaaatgggattttcttttctttcgcattgtcaggctacaagttttccaaacttttatgctctgtttcccttttaaaactgaatgcctttaacagcacccaagtcatgtcttgaatgctttactgcttagaaatttcttccatcagataccctaaatcatctctctcaagttcaaagttccacagatctctggggcaggggcaaaaagctgccagtctctttgccaaaacatagcaagagtcacctttgctccagtttccaacaagttcctcatctccttgtgagaccacctcagcctgtacctttttgttcatatcactatcagcatttttgtcaaagccattcaacaaatctctaggaagttccaaactttcccagattttcctgtcttcttctgagccctccaaactgtcccaatctctgcctgttatccagttccaaactcgcttccacattttcatgtatgttttcagcagcaccccattctactggtaccaatttactgtattaatccattttcatgctgctgataaagacatacctgagactgggcaatttataaaagaaagaggtttaatggacttacagttcttcatgactggggaggcctcacaatcatggcagaaggcaaagaggagcttgtatggcagtggacaaagtcacctcttatatggcagtggacaaagagagaacttgtgcagggaaactcccatttttaaaacaatcagatttcatgagactcattcactataatgaggacagcacacgaaagacccacccccataattcaatcacctccgaccaggttcctcccaagacatgtgggaattgtaggagttacaattgaggatgagatttgggtggggacacagccaaaccatatcagccagcaaccttggaagttagtttgcttgatcatgtgactggctgctcaaagctgaaagcaaatacaaagcctactaaaaatacaaaaattggctgggtgtggtgatgtgcacctgtagtcccagttacttgggatgctgaggcacgagaatcacttgaacccaggagatggaggttgcaataagctgagattgtgccactgtgctccagcctgtgtgttggagtgagactctgtttcaaaaaaaaaaaaaaaaaaaaagcaaagtcatgcttattggtgtatgtgccactttctcagtttgtgtcctctcatcctgccatcccccctttaccctgacatcagctgcctcaaggagaaaactaagtgccctggagaaattttaaagaagaggagggacctgaactttcatggctttattggatacgggttaccagatcaccatccttggtcccatgtgggaagggaaagctgaacccagggcttgccaaaagggctgaagatgaaggggaagagctaccgtaatatttcacctccttgagcgaggttgctttccaaatatcagaagctacatgagggaggaaacaactgcagggtttggacaccaaccctggagcgagcagccaaaggagagaaaaagtctacacagtgctcctcatgtccttatcgtccttttccactcccagtactctctgctccccagattttcagcctggagatattacaggcattttgtggccattgtaagctgtcacataccaacactctgtagattgtcaaatttatgaatgtaccatttcataatttctggaaacatgttttctcttagtacagttcattaatatggcataagacatgtttactggcagactcaaatatctttatttcctctgtaataagaagaactaaattactatagcccttgacatgtgcctgtgagacaccttggtccgtgttttagtataggatctgtatctgaattcaactgctagatttgaggaaagtttaccaagggatatgatgttaaattgaccttgtgggtaaagcccttgggctgatttcatgtacaaagtttactctattaaataaacggttgggtctggttctctgatagcttaagtgaaaagctaatggtgtccactgggtggcagccaccctccagctccaaggacagtctaaaagattaactggtaagggctgatccagcacaatgggctgaattaaaagccattttcttggaccaggggttgagagacttcagtctgtgtgccaaatttggctacaatctgtttttctattgctcttagcttgggaggatttttacattttttaaagcattgggggaaaaagaatacacacttgagactgtatggggcttgcaaagccaaaactatttactatctgctcttttcagaaaacaagttttctaactcctaccttagacagtattcctaaggattaagttatgatatctttttcctgagtgttgggctcttgccagttacttcacttgggtagtaatagtagattacagagacacccctccatggagacataagctatgaactgccatttggaagggctgggtcactcatgttgatgcctagagtaagtgcctgtttttacaattagtctgaatggaatcaagctgctggtcaagcctgcacttgttagtgcctttcaatctggaaacttgtctttttttttcttcttcttctttttgaggcagggtcttgccctgtcaccaggttgcagtgccgtggtacgagatggtcactatagccttgacctcccagtctcaagcaatcctctctccttagcctcccatgtaactggaactacaaacacgcaccaccacacctaattttataatttttttgtagagacagggtctcactatgttgccaagggtctcgaactcctgggctcaagtgatcctcctgccttggtctcccagagtgctaggattacactcatgggccaccatgcccggccattgtctttcatttttggaaaattttcatatattatttacttgatcagcccctcccttcttttttcttgttttgtttttctggaatttctgtttggatgttagagtttctcaatttcccccccaattttcttaacttttctttcctattgtctgccttttgtcctacttcttggtagtttcttttccctacctttgttttcaaaccttctaatacagtttatgtttcatttacatttttaaattccaagaattcttcctccaatgcctgtttgtaataataccctgttcttatgtcaagtacacaatttgtcagtctccatctaataaaatcacagtgtggttttttaaagactattctgtttcttgcattgtttattcccaaatcctttttgtttgttactgcgtttagtttaatctgtgctatttatgatgcaagctttcttcacatatcttgtgattcttatatgcagatttatatttaatagggaggcaataaatatgagttggcttttctatgtaataggacaggccttataacccagtggacttcattgtagggttattaggtaggtatccagaggtactcataaatgtcactatcatagggcattttctcttgggctgtttagttccttctgagaaaaacttttaacttcctacctgaatggtgtaaacttgtctggcagtgttattttagccatgtgatggagaagtctgggattctcaccatttagtatgttaactttcaattaatacccctgtttttcataaggtgcttctcctctaccatctattatgcttagataattatagagaaccagaatctgtttagcaagggctgaaatttatgttctatcttatagataggaaaagtaaatggagcctaaaatgcagatataagtgcataaaagttattctgttaattcttttctctatattaaatatgatgtttctccaaattttgatgttttatttgaagccataataaactttgttctaaggcattcacattcatttaagtaattggatttattttatgaaacattctcattctgatcaaaattttcaccgaaggatgaagatttaacagaagtgctaatagtaatatatttgagttgaactttaggtaacatgttagaaagaagataacttaatattttgaggatattttccatttaaataaaaacagcaagaaccaatgtattaaattgaatgctgtggttctagttattgttttttggatgtatttaataatttctaatgtctttttggcttaacactggacctcacagttaggtaatgaggatggaagtagtatatttgcctttctatgaatgccataccataagatttttcaggatatttttgtagttaagaagatagcatatgagtagaatgatagataattcaatttgaggtacttgtaactgaattggattcatgtctactggagatgagattctcatggaaaatcaacagctgataatgtaaatgaagaactttgtgatcctacaaattataaaacagtgcagttatcatttaggttttaggttttgactgccagagatttgctttatagagatttgctttattgagatttgctttattgggaatgcctatatttcagtgttagaattattataattgactatagatcttttatataaaatattctcatttgggggaatagaggatagatagcaatatatgactcttaccttaaaattggtataaatctaatgaatacccatataattactattgaacttaagaaataaaacattacagataaaatggaagtcatctgtgaatctcttacctataccattcacctttatcattctcttcccagtagtaacccttattctgaatttgttgttttatattccctgcttgtttcacaattttactctttttctcacatccagaataaatgtagtcttgttttacgtatcttaaactatatttgaatagtatcaaactggaacatgcttccccccgcccccaacattgtttctcagatacattcgttgatggatctagttctttatttcaactgttgaagagtatttcattgcatgaatgtatcataatttattattaattcctctattgcttgtttcataatttttactcttgtgaacagtgcttcaaagaatcatgaataggtgaaaatttccttgaggtatgtatctaggtatagaatggccagcatatagtatataaacttttaaacattttactaatttttttgaatcgttctttaaagtagtcccatcagtttactgtttcatgagaaatgtatgaggtttcacaaagacttgatattgttagacttaaagtactgataatctgatgtacgtagattatattacagtgaattattttgcgttttttggtattaggatatttttaaaatgaagagcaaattatttgttctctctttgtctgctttcactaataatggtgtgcttctaattacctagtctgttttcccattagttcatagttttattaaagaaatctctcttctacctactgttagatacaccaccccattatataaagttcatttggttaggtttattttgtgctaagcaactaaatagaaaatggaatgtttttattgtctttttgtgccctaaaaagagtcagtcagctcttggtaggggaaagaattaagcctgttgtctaggtgataacagtagaataatgcagtgagggagtgaaaaatcagggatctaagttgcagaaaattcagttactaacagcaattaattgaataaagaaaatgcaaagttatgaaaaacaccagtactttgattatattatccttgtagaatacagtcattcattgcttaatgatggggatgtgttctgagaaatgcattgttaggcaattttgtcatttacaaacatcatgaaatatgcttacacaaacctaggtggtatagcctactacccacctaggctgtatggcataggctattgctgtcaggctacaaactatacaggatgttactgtactgaatgaatattgtaggcagttataacacaatggcaaatatttatatatctaaacatagaaaaatgctgtaaatatgtggtataaaagataaaaagtgatataaggcacttaccatgaatggagcttgcaggactggaggttgcttcgggtaggtgagtgagtgaatggtgaaggcctaggactttaccatacaccactgtagagtttttaaacaatgtatacttaactacactaattatattaaaagatatttttctttcttcaataataaatttactttagcttactttaatttttttagtttataaacttcttgactcttttgtaataatgcttagcttaaaacataaacatattgtacaaaaatgttttatttctggcaggcatgtggctcacagctgcaatcccagtgctttgggagggtgaagcaggaagattgcttaatcccaggagtttaaaaccagcatggggaagataattacaccttatctatacaaaaaaataatttaaaaaatgagccaggtgtgttggtgtacccctatagtcccagccactctggaggctaaggaggaaagattgcttgagcacaggagtttcaggttgcagtgaactctgatctcaccactgcactccatccagcctgggagacagagtaagaccccatctcaaaaaaaaatacatatatatatatataaatatatatttatatacatatataaatatgtatataaatatatatttatatacatatataaatatgtatataaatatatatatacatatataaatatgtatataaatatatatttatatacatatataaatatgtatataaatataaaacacacgtgtgtgtttcttatcttcagtctgtaagtttcttttctattttatccttttactttgtaaacttctttgttaaaaattaagacacaaacattcattagtctaggcctacacagggtcaggatcatcagtatcactgtcttccacctccttatcttgtctcactaaataacacctgtggagctgtcatcttctatgttaacaacacctttttctgaaatactgcctgaaggaactgcctgaggctgttttagtgtcaacttttttttaataagtaggggtacaccctaaaataatgatgtaaagcatagtatagtaaatgcaaaaaccagtaacataatcatttattatcattatcaagtgttatgtagtgtacataattgtgctatagtttttttatatgattgccactgcagtaggtttgtttatcccagcatcaccacagtcatgtaggaatgccttttactgctactttatgatggctatgacatcactatttgataggaatttttcagctccattataatgttatggactcaccatcatatatgcagtttattattgactgaaatatcattatgcagtgcatgacttcaattatactctatttaatctcccttctaggtcctgatttttaaggtaatttgaaatcattttttctgcctttctctgttactatctgaattgcttcctaagaagattaaataagagtaaggactttttcctggatgttaaccgtaacattagcatgttattttaattaaattggtttattaaatataatgacatagttaaatattgatgggggaagggagtagtctgtattacatccagaggagggatggttctactggaacttactggacagctagatgacaatatgaagatctaaggaatggggaagagaagaaagggataagataagagatgctgaaaggtattcttaatagacttaagtattttacttgggttatgctcttttctataattttcactggctcattagaagtagaaaagtttataagtagagaatttaatagaagaaaggcaggtaatgttgttgagatgtgtggggtcagatctatcctgaaataaaaagaatctgatcacatttccttagtgatttaaaatagaaaaacagggtgatagaaataaatgtcagaagcagaaattggaagaaataaagaatggcaagtttaatgttggcaattggtcatcagaatcctattgttgttgttgttattttttttttaagatggagtcgcccaggctgtggtgcagtggcgcgatctcagctcactggaagctccacctccctggttcatgccattctcctgcatcagtctcctgagtagctgggactacaggtgcccatcaccacacctggctaattttttgtattttttagtggaaacggagtttcactgtgttagccaggatggtctcgatctcctgacctcgtgatccgcctgcctcggcctcccaaagtgctgagattacaggcgtgagccactgcgcccagccatcagaatcctattttaacttatatttgtagattttcttgtcatgccagttaattacatagtctgtttctggtatttcctatgttgacttgatcatagctgtcactaacaaatacttttatcttcgacctatttaatgtgttttttttttcttacattttatggagtgtttacatgatcccctcttacttaactttagtggactgtcaggattattgtcccatgcccattttgcctgtagtttttctttaattgcagtcgttctttttttttgtttttgtttttgtttgttttttttgagacggagtcttgctctgtcgcccaggctggagtgcagtggtgctgtcggctcactgtaacctccacctcttgggttcaagcgagtcttcgtcctcagcctcctgagtagctgggataacaggcactcaccaccatgcctggctaatttttgtattttcaatagagacgaggtttcaccatgttggtcgggctggtcttgaactcctgacctcatgatccacccacctcggcctcccaaagtgctgggattacaggcatgagccactgcgcccggccggcacagtcgtcctttttaacagtgtttattttagctcaaaacaaatgtatttattattcttgagtttcctttattattgctgaataacttcaagtaatttttgttttttcctcactaggtctttctttgcaaatattacttttagataagtttgtatgagtcttaaaaagctctttctatgtataattaaaacaagatagcacctttattttgactatgtaaataattgtatctcatagattcaaagctagcttgtgtttgcagaagacagtattgccatagtgaagtaattttaaagtaaaatttgacaacaactagactaggtctgtaggaggattttttattgtattaaggctcatactgtgctaagtataatattttttattttttgatgaattatattagaaactaatttttatttgtagttctactttatatattttctatattagagaaatttcccactaaagaatcttcattaacatttttctgcaagtgatttccgaatgtttctaaccctaaacagtttcctatcattgcttctaaacatttttttctttttaaatcttgctattgcttcgaattcaggttgtttgaactctttattatccttctcttctgctaccttgttcccaatccaactaccctacctaatttcctattcgtatcattggtattattatttttctggtcaataaaataaatgtttgttgaaatttacattttaatcctgctagctctgagatctttgggaaataatgtcttcaagtttcattatcttgtctataaagaggggagagcaatgtttcatgacatgagattggcaaaatgattagattaaatgagatagtgtaagtgatgcacttggtacagtgcctgtctcttagcaaatgatagttcccctgtaggtatatgggatcaaaagctcatagttgtttttgacacctttcttctctaaaccctctgtattgcattttccatcaaattttgataatcccagctttataatgttcacatatatttgattttattgtattctcttagctgaaatattgatccaggcgcagatttgctgtacattaatgtaaaggttgacttccttacagatttgtctccatactttcctttcttacaatacattcttttttttttttttttttttttgggatggagttttgccctgtcacccaggcagagtgcagtggtgtgctctcggctcactgcaacctcctcctcccaggttcaagtgattcttctgcctcagcctcctgagtagctgggactgcaggtctgcgccaccacaccctgctaatttttgtatttttagtagagacggggtttcaccttgttggccaggctggtctccaacttctgacctcgtgatccgcctgcctgggcctaccaaagtgctggaattacaggtgtgagccaccgcacccggccccttataatacattctgcgtattccagtcagatgactttttctaacattccacgtttgttatgccatgtatctgctaagaaagaacaacaacaaaaaaggaattgttccttattgtcttacttcacttagtggaaccatccattccatccagtttggtctgcttactcaaagactattaccattcttctttctgtgcccttgctcaggccaggccttcttcacaacgtcattcgaagtgtacaatgtttcttgcacttatttccaatttaattgtgtactgccttgtgtagttcttatattactgtcttctgtcaatattaaatttaatcatatactgtcacatcatagttttgttttattttctactgtaatttaactttctgattaggccattttcttttctaaggtataaattctcctatacttcttatcttctttgaattcattctgttattctatgtatgtacttcaatttcttataagaaaaacagcacaatttgagtttgaaatttacttttaaaattataattaatgaacatagtactttattaaggaatcaacaaaaagtgttttattcaactggcaggcaaacttttctatttccataaattagttttaccaaacttcaaccttatataaatggaattttgcattttactgtatactctttctgtttggcttcattttagttttttgagatttatctatattgtgctgtataaaataagtactgcattcttttttattgctgaatagtattccagtgtatgaggattttacaattttatacattctcagtttaagggacagctagatttttaatgattttttgctgttattaatagggttgcagtgaatatgcctgtacatatatttttgggtacgtatgttttcatttcttttgaataaatacttaagtgtgacttgctggattgtatggtaagttaaacgtctttgtccagactgtcacaaaggtggtgctgtactcttcccattgtatcccatcagattgcttattattttgggtttctctcattactaatgatgtttaaagatttaaatgtatgacttgagactgtcaaactactaaaagaaaacattgcaggatgctttaagacattggtttgggaaaagatttagtttctgggttttctttctgttttttttttttttaataatatctatctctgtttaatttctcattcaggtcatgaattgttttcctggttttaaaattatttatatgtgttcttttgtatcttgtagagtttccttaggatcattattataaactcattttcaggcatttgacatattttcttttctttggggtctgttactggagaattattgtgttgttttggaggtgtcatgtttccctgccttttcatatttcttgttcccttacattgatatttgcacatctggtgtaactgtcacttctaattttatggagtagcttctgtaaggaaagactttttcctgtagatgtagctgtaatgtttgttgggtagaatgttttcgcattggttctcggtgattgcaatggtgtagtttttgtatgatacttcacctgtaatcaacaactgcagtgtctgtgattcccttaatggcttagcctgcagttgtttgtggagattgtggtgagactttggtggggaaggggtcatcagccagactgatcctcaggcctctaggtgtcacgtgggggcaccaacagtggtggttgtgtgtcctgggtgagccaatcttaaggtcctaggtggggagccagtggtagcagtgtcaggcccttcctgattggccctcgcatccctgggccgggctacacagattctggtagtggcactggtgggttggtcttcaggtgcccaggcatcagtgtgtgttggtgactggccagtctggctggtccccaggctcctgggtgaggcgcacaggaaccagctataagattgctttttttaaaattaaatattaagagcctttcttaagctgtgtggtgtggctttcttcactcctgctgctgatttaccaccattgtttattagattgggacaagatcactaactactattagacatgtaccccatttttactgtatattgctgtataacaatggtggcttaaaatagcaaaagtttattatctctttcagttatgtaggtggactggatgtaggttgatagatttgtttccatctctgatgtggtgtctgctggatagctggggcatctaaaatagccttactcacatggttagcagttggtgcttgttgccagctagaactcagctggagctgttgacaatgttcacatgttctcttgaacatggactttgtatgattgtttgggctgtctcactgcatgggacctagattctaaacagaagtgttataggtgaccaattggtagctgcagttttcttaagacaaatccttagatgttacactgccacattccattggtcaaaagaggtcatagagccaattcagatttaacagataggggaaagtcatgctgaaaaagaacacgtgggatgagataatgttgtggcccttttaagaaatataatttacttaatttgaaatttcctgtgaaattttgaaacttactttgaaactttgaaagattattagcaattttccaaatagtttaacttcattattaagtgtattcaaacttcacagaagccagtatacaaagggaaatcccagatttaagtgatgagtttatataccattgtttaactggtcctctgagtgatcctgcatgattgataatccacactactgtctctctagacagaagacagactcagtaaggaaatgttttaagtgggtgtaattctgatatctgccattacaaaaacaacgacgaaaaagcaaatatttcttcttatttcttatcagcaaaagaaaggaatgaggtgtactggaattcctagcactgtgatactcaaaatgtcagtttttaaggcttttgtgttttagggaaacactcaaagaaaaaatttatgtgagttttcaggctgtttacttacattcttaagaaaaagtgattttaggccgggcacggtggctcacacctgtaatcccagcactttgggaggctgaggcaggcagatcataaggtcaggagatcgagaccatcctggctaacacggtgaaactccgtctctactaaagaaaaaaaaagaaaaagaaaaagtgattttagatcttttcaaagatttgtttaatgtgtatttgttcatattttaatttttaaatgtaatttctcactggtaaattttccttaaaatataaattgctccctggatatttgttcattattttgcaaagtacaaaactccattagagtttcatttaataaatattaagtacaatattgggaccccttattggcttatataaatcatataaacaggtgactgtttataggattcctttattttagctgccagtaagaagcctgccatgatttttttatgtctttggattccccatcttacctgccagctctagtatctattattggtagccataaaaaatactgacaatatagaccagtttgaattttcttaaatttatcacataggtataccatatcacctaaaaaagttaatgtgattacaaagatagctaatttatactcagtcagcagattcctttatttggctgtgtctccaagataaattaaaaataaaataataaaaataaaaaactatagttgagttataatattttactgactgaaatttaacttcagccaagctttaaaaaaattacacagtttatatcagtacatctttattttatgttctatacatgactccatgataagtgttcaatgtggatttcagaggatcccaaatgacacacacacatacacaatattgtattaaaaagtcagattggtaaggaccctgtagaaatcaggatgcttgcaacatggatttcagcaaagtttctgaaaagataattaacaagcaggctggtttatagaatatataataaggctctaaaaacacaattgggttttaacatggcaagttgatgtagcccaaacagtaaataatctggataatctattatcttgatttttaactgttttgattcagatatttctttgtaatgaaatttttggcaaattaaaatttcacaacgctactcttagaacaggatataggaatctcctcagttaacacccggactcctttgtcagatctaactgtagttgtaagtatttgccttgcttactttgatgctgcagtccttggtatgtatgatttccaaagaattgaagagtaagtttaataatcttgtcactttatttagcttggctcttcaattcattggttattgatattaagattttggtctttagaatatagggtgtgatttgacttatagttaataggttatacatggccatacttaaatctctaatgatatgcctttgcacttaggataaaatacaaaatctttgcagttatgtaacccggatttttaaatttcaagttagttatctttacaaatttttatatctttccaccttataataaacatgaaacattaatagattcagggaatgaaatccttttcttaagaagataagattaaaattttatgtcatcagaaaatataattttagggtactaaccagtaagatatagataaggaatgagacaacctatagataagctttacctgctttattaagtctaatgcatactagagacttttttattctttgagtttcaggaagttaaatttgttcctctgtctcataagatagtattatagtttgtgagaaagttctaatttaacaaacacttaaaaggactaccatgtttaaggcattttcttaagttccagaaatatagtctagctgaaaaatcaaaatcatgtgtattatatattatgaatatgtataatacagtgtaatgggtagaataatgggagcatgtttaaatacagtggggaaactggtaagtatgaggttaattttgtttgttgctctctgacaaaaatcttagaaagtcagtggcctttaaccctcagtacaacaccaaggtccattggattctgttttacttttgagtttctgtttttgagcaattctgagaatttataaggattgatattttatgacttttattattttctagggctcttccaaagagcaaagagaaaaagtgtttatttctgtacatatatatatatttaaattttatatttaccacctggatctattgggcctttttataaatctgtgatatatttttgtatcatagtgttcttgtatttcctccatcttgaaacattttgctgttctattattattagaattatttcatcattacttatcagctagctttcttcaactgcccttaaatagggggctgaggtgggtgaatcacttgagatcgggagttcgagaccagcctggccaacatagtggaaccctatctctactaaaaatacaaaaattagctgggcatggtggcacatgcctgtaatcttagctactcaggaggctgaggcagaagaattgcttgaaccagggaggcagatgttgcagtgagctgagatggcaccattgcaatccagcctgggggataagagggaaacactatctcaaaacaacaagaacaacaacgacaacaacaacaacaaacaaacaatgaaataaaaggaaaatgggagaatgatgaagtcatctagaagagtagtgcagtagttgaataaatggtcactattgctttatcctttagttttatcaagttgtccaaaatattgcatgatctttcatgaatatataaataaaagaagatcagagaccccatctttgtagtctccttttccagttgagaattcagaatttttaatttttttttcaaactttttttttgcttgggggtaaattttccctttaattcttcttttccataatgaaaaagttatgaaaattgagaagagactttaatatttactagtcaaatcagatatcagggctctaatgttaatggcaaaattggtcttagaagcagatcctcatactgagtcatcagatgacacattccaagatgcatttcttcagacaactatcaatgtgtgaataatgcatttctcaaaacaaaaagcagataacgtattcacattcagttagtgaagaacaggaaggaccttatcacacagtattttgcagcaagaacctggaccatctcattttgctaaaaggataggtaacatattctttaatcttttatgatttcgtgctcagattcattatatatggttcctaagtggacaaatactgaaggtaaatatatatatatatatgcataggtgactagaaggaaacagataatgtagaaatgaaaaaattattaattggtaattataagtggtgttataagtgtaaaaatgaaacttttgcaattatcgaacaaagaagatggccattttctcttcatcaaaactataagctaaaggtttaaaaaaaattcatcaggtgtgctgtattttgatgatgtcagttcaagaagaacaagaataatgataagttagatccaattagagatgtatttgacatctggaatcaatatgtacaagatggatgtgtctctggttcatacatgacaattgatgaagcgttagttgcatttagaagacattgaatacatatacattcaaaaccaaaactttctgatgaaatttcactgctcctttatttttacttctgcaatataaaatgacttgaacataaaaataaaattacatagtccatctgacccagctggtgaatggtgatgattatttttttttttggcatttgaaaagttaagctagaccttgaagcttattttaaagtttggcaaataaaaggcagaggcaagagaatagctagaaatatgtatgtgtgtacccccacatacacatatatatgtgtatatatgtaacatataaactatagatgatattttataaaatttatatatctaaattgatttataagtttatacatctacaaattttaacagatatatacatatgaaattttgtctgaaattaaagcttgccattgggagattttatatgtaaatgtaagtagtgcttatcgtatttctgtttagaaagtaactgggtattcattggagattaggttagagaagatattaaatgtagggatttaatgaaggatcacagatgacatagactggagttaaggcatttataataaagaagctgaaacacctaggtgcaatggatcatattcttttgttcattcctgaattgatttgtgtgtgagataattttttgtggcctaagaaatggttttgggctgagcatggtggctcatgcctgtaatcccagcactttgggaggctgagacacgcggatcacttgaggtcgtgagttcaagaccagcctggccaacatggtgaaactccattcctactaaaaatacaaaaaattggctgggcgtggtggcacgtgcctgtaatcccagctgttcaggaggctgaggcaggagcatcacttgaaccttggaggcaaaggttgcagtgagccaagactgcaccattgcactccagcccaggcagcagaatgagactctgcctcaacaaaacaacaacaaaaaaatgaaatggttttggaagacatttacaatagtttatttcctaggtcacattaaaaatgaacatgaaatgatattaattacttaacagtttttttatcctttggggttttttaactataccactctcttattgttatactatgaaatgtccaaagtgctactagtacttttgtttgaggcaaatattattcagagactaagtttgaccttgaacatcaccttggatttaatacaggctttcaagtaaatatttgattttaggaaaacctatgtgttgaggctttccttccaagtagaatggagtagctggtagcaaattagtacttctgcttagagcaatgagaaaatcaagataaaatatacatgtaaccattctgtatcagagttgaccttggggatgtatttcaagtctcagttgtatctgtagtaaagcttattcttcctctgttttgtcctaattatattggtaatcacattcaatataaattgactaattattaaaattgaatcactaagcttgtcaggctgtataaaacaagtaaaccccaattatatgctgcattcaagagccacatcttaaattaaatgggaggatgaagctaaaaggatgaatagatacactgtcctaacactgaaaggcaaactggtgtagctactatatccaataaggtagactataagataaagactaaatataggtggtccataacgtatgatggttcaacttacaattgtttgacgtaacggtggtgcaaaaatgatacacattcagtagaagctatgctttgaattttgatctttctctaggctagtgatatgtaatagaatactctattgcagtgttgggcagtagcagcaagctgcagtttccactcagccaagcagtcatgagggtaaataaccaacactctatagtatatgaaatgtatttttgacttaacaatatttttcacttacagtgggtttctcaggatatagcctcattataaagttaggagaatttgtataaaagatggatgttttataataataaaagggtaattgtatcaggaagttttcactatcctaaatctgcatgcacatagtgagatagtatatataaagcaaaaattgatagaagcaaaagaactggacaaatccccaaatatactgggagaatttatgatgctgtcagtagtaccaaccatcaatagctgatagaacaagtagatgacaaaaaaaaaaaaagagagaggtagagcacatttttacagcaagagtaataagtgacttaatttacaactatataacatttcactggaaaatatgagagtacacattcttttgaagttcagatggaagattaatcaaaattggccaaataggggatatagatcaataggtataaagatttagtgcaattaaaatgtcaaataggttttgggttttttaaagtaaaaaaatgactatctcttctgaaatttgtttagaaattcaaaggatcaaggataatcaaggcaatcttaaggagtaacaaaataagtgtaagagagagtaccaattgtcatcattttctgtaacacaatactagagttattaaaaacagtggtattgatgcaagaataggctggtgcaagaataggctagtgtaacaggagagagtatccagtgtggtaggcagaataatggccttcaaagatatccagccctaattcgtggtacctgtgaatatgtcacattataaggcaaaaggaactttgcaaatacagttaaggttacagacaattaagatagtaaaatgatcctgggttttctgagtgggcccagtctaatcacatgaacccttaagagcagagaagtttttccagctgaaagcagaatagagatgcagcagaagggggagtcattgattccaagcatgagaaagattctgtgcactattattgatgagatttaagggcctatgtaaaagactggagagaggcctctggttgctaaacatagcctctagcttaagtcagcaaggaaatagggacatcaatcctgtaaccaaaggaactgaaggaactggactgtgtgaagtagaatctttactgagccttaagagtacgagctcagcaggcagacattttgatttttgttttttttttttttgaaactgggagtagaaaaattagctgagctaacctggatttctgacttgtaaattgtgaatagtaaaattgtgttgttttgagctgcaaagtttgttctaatttgttacagaagtaaaagaaaactattacttccaggaacaggtctgcatatatgcttctacctgatttatgactgatttttttaagtataatggagaaaagaattttatttcaattcaatatccttatagaaaatatgcttattgacatacataaaaatccattttaggtacatcatagatccaactatgaaagatttaaaaaataaagcttttagatggaaacatggcagaatatcttcgtgatcttgggttagggaaagatttcttaataataggaaaaattgatacattggatcacattaaaaataagaactttagaaatctaaaaactgaaaggtaaatcatagaatgaaagaagatacttgtaatacatatatccaacaaaggactcatattccataacccaattttaaaaatgaataaaagacttgaaaaggcacttcacaaatagtatatgttcaatatgaacatgaaaagatactcaacataaaaaatcattagggaaatgcaagctaaaaccacagcaaaatatttctacacacccaccagagtggctaagtaaaaaagatgccttttccaagtgtttgtaaggaagttgtatagttggatatctgatacacaaattggtactaccactttgggaaactgggagtgtttactaaacctgaacatatatgttatctattacccaggaattttagttgtaggtatatatctaaaaggaaagtttgcttaagtttaccaaaggacatgtgcaggaatgttgatactatttgtaatgacctaaattggaaacaatccaaatgtctacttatagtagaatggataactaaatcatggtacattcatagcatggtatactgtacaatgagaatgaacagcatacaattaaatttaaacatagatgaatctcataaacttaatgttctgcagaggcatcagatacaaaaggaatgcctatggtatgattcatttttataaagttcagaaacagacaaaattaatatatagtgttagaagtcagtatttccttctgttgtgggtagagcaatgactgggagaaagtatgaggggagttttttttttttttaatcaaagatttagacactgctttcaagctctatatgtgtttgaggaattggtgttttcactctttttattctttttcttatgtagataataactatagttaattcactgttttacttcgatcagtttaataatactgattatgttcacgtttatttgagtcttgtacctgtaccaaccaggtagataggagaagtatatgcataatcaaagacagccaactgagccagctgagatttatttacaagtgatagcttaattatttgggggctttacattagttctttcaattaatcagttttttgctttcttgtctattcattggagtttacttctaaagctacctgtcctttgttgacatttggatttctctgtttaattatttagatttgggattagttctgtaaaattcacagaacgccttgggttacacttgagtttgggaacaagtaattacaagttatattaagattgtaaatgatctgtatactgcagacatcattcttctcaaatttctctttaagtatgtctaaattataacataaaccagtggtttagtatgcttttttagatactgatgatgctttgtgagactaattttattctctacccacatcagtatcttttctgattgccttgatgaaattagataaacctttatctatgccacccactaccaaagatgtttcacttttccttctatccttttaagggtatttatcacaatgtcaaagcaggaaaaatagtaataaacatagttatagaaataataacagcaaatggttataacatgtcaatcagtatttaaagcactttattgacttatttaacatatgaaacaactgagagaggtgtgattgttagcttaattttaaacatgagaaagaaagtctcagaccacaggttaactaacttgctgaaggtcacacatctattaaatgtatgtgtcagaattaaatccagattacctagtctttgtccttaaccactgtgccagtaaaagacagataaggagattttcaaagttaaaattcagtcactaactaaacaaatctgggattataagtttttcaaagttttgaataagctaatgattatatttaaatagtaataatttttaggtaaatttttttataattgcatatttaaaatactaatttaaattttgtagtaaggcatgtaaatgttgtttgccatactgtttcatgtttggaagtctgtttatgtttatcctttctttcccaatatataggaaaaggtaattcatgggccatcctaaaggagtgtgttaggttgttctgtagctttttgtagtagtatatttgtatgtaatgaagtgcatttttaaattgcacttgtaatttttaattgcttcttagaaattcctgaatatttaggaacttcataaaaatattctggaagcaagcattacctggataacatggtacttaaaaacctttcattatcaaggaaataaaaaatagaaaagaatgttggtatgaattataagaatggaaataatctaacagatatttatctaattacatttatccagatgagtttttctgatttgcttataatacatcacaacaacatctcagcctgtctccaggttggtacatctttatttaaaaatttgggccaggtgctgtggctcacgtgtgtaatcccagcgctttgggaggctgaggcagatgtattacctgaggtaaggagttcaagaccagcctggccaacaaggcgaaatccctcctcagtatactaaaaatacaaaaagttagccagccgtggtggtgggcacttgcaatcccagctacttgagaggctgaggcacaagaattgcttgaatctgggaggcggaggttgcagtgagccaagatcatgccattatactccagcttgggcgacagagtgagactccatttcaaaaaaaaaaaaaaagaaaattttttttaaagttatttaaactgattttatatgcaccatttatttataacaattttattttattttataatgttttacatttgtgtctctcattagatactcagactaaccctatgatctcataggggagatataattgtcccattgtttttacaaggggcctgatgaccagaggttaaaatgtatgtacagagtcactctacaaatatgccatataattatcatttgaaaccacatcttccgttctctgatacaatgcttttcccattgctccaggtcacttctcatatgatttgaaaaccaaccaaccaataacaactttacctatgattagaatcccatcatttaaagagtgacaatttagttacaaaagattaaaaagaattcaacagcaacaaaaaaaaactagattaaaattgggcaaggacttgaatacacatttgtattatacaaagaagatactcaatggccaacaagtatttgaaaagatgctcaacatctctaatcattaggcaaatgcaaatcaaaaccacagtgagatattacctcacacacctaagaatggctgctgtaaaaaaagaaaacaaaaccagaagaatcctgaaataacaaatgttggtgaggatatatagaaattggaacctttgtgtattgttggtggggatgtaaaatggtacatccattatgaaaaacagtataatggttcctcaaaaagttaaaaatagaattatgattgtacaattccaagaattgaaggtagggtctcaaagagatactgatatgcccatgttcatagcagcattatgcagaacagccaaaaggtggaaggaatgaatagataaaacaatatatatataaaatagataaaacaatatatatcttgagggcgttattctaaatgaaataagccagcaagaagaagacaaatattgtataattccacttacatgagatatttattgttgtcaaattcataaaaacagaatgtagaatggtggttaccaggggttcagtggagtaggaaatggggagctgttgtttaatgggtatagagtttcagttttacaagatggtgtttggtcacacaacagggtaattatatttaacagtaccaaactgtattcttaagagggattaaggtggtgaattttattttgtgtgtcttttaccacaattattatttttaaaattttatttttacagtgacacggtctcactctgtcacccaggctggagtgcaatggctctatcatggctcactgtagccttgagctcccaggctgaagcaatcctctttccacagcctcccaagcaactgggaccacaggcacatgccaccatacctggctttttttttttttttaatatttttttttaaagtcagggtctcactatgttgcccaggctggtcttgaattcctggtctcaggtcatcttcctgccttggccccccaaagttctgggattacaggcataagccaccacacccagccaaatgttttttaattttaaaaataaaataaattgtataggtagaattaaaaatacataaatcagatcatgccaaccctttaaagtcatctagtgtgcttaagataaaatttaaaatccttttaaaaaagatttaaaaatgtatagtaaatgcccacatgattctcacagttaggtgtgcttctttcattgtattaaggatgtataaattttataagactaaatatcgtgagatatttattattgaatatatagcaattcaaaatacagtagtccctccttttctgcaagggatacattccaagaaccctagttgatccctgaaatcacagatgttactgagccctgtatataccttgttttttcatttatatacatacctatgataaagtttaacttataagttaggcacagtatgagattaacaataactaataataaaatagaataattataataatataagttatgtgaatgtgttctctgtcaccctctctcataatattatattgtacagtactcacctggttttagacatcagttgatcataagtaactgaaactctgtaaagagaaaccacacataagggagactactgtattttatgaaatatgtatgtgcatattaaatggaaaatgttttaaaaatattcaaatgttaaaacattgcaaactgatttaaagatccactcacaaaggcaatcagcttgcaaattcaaaggaagttgctattacctgtattttctcagttataccacagtggagctattcataatgtatcagaaagctaggcgtcacagttggatattatgtatataaatcagttgatttttgactcaaataactgaagtgtgttttggagataagttttatgattggaattggaaatgactgaattttgtggagcaaagcttttaactgtgttcacttggagatattctatagtgctttgactctggtttactactgtgcccagtggggtagatatttttttaaaaagacacgtattcaggaaaaaattttatttataaagattacaatatttgctcttgaaaataagaaataatgttagtcaaagaagccctgaatattactgtaaatcattgtacatgtattagtccttatggatttctttgcactagtaaaaatataattattcattttatttatataaggtctttgtgctgctgtaagaaaataccaccaatggtaatttacagtcaggcactgcatatttcaatcagtggtggacaacatgtgcaaaggtggttgtagaagattataatacagtgtatttactgtattttctgtgtttagataggtatttaccactgtgttacagctgcctacagtaacatcttctataggtttgtagcctaggatcaataggctatactatatagcctagctgtgtagtaggctatactatttagatttgtgtaagaatagactgtgaggttcacacaatgatgagatcacctaatgtcatatttctgagaacatatccctgttgttaagcaatgcatgactgtataagaaacactcaataaataatgtatggtagaaggtgattaaataccaaaataaatgaaaaccattaaagtgggcttaaaaacaaagtctcataattttagttactcatcacataaaaatgctttagttgttgcctgttccctaacagataagtgaatgttcacctaaggagactcaggagaaatccccaatactgagacaaacccagagattgagggataactgttctgattcagagggttttgtttgatcttacccctaaactttacaatgaaagtatgtttggtaatacagttaatataaaaatcagggttggctgggtgtggtggctcacgcctgtaatcctagcactttgggaggccgaggccggtggattgcctgagctcaggagttcgagaccagcctaggcaacatggtgaaaccctgtgtctactaaaatacaatcgaaattagcagggcgtggtggcgtgcgcctgtagtcccagctactcgggaggatgaggcaggagaatcgcttgaacctgggaggtggaggttgcagtgagccaagatcacgccactgcactccaacctgagcaacagagtgagactccatctcttaaaaaaaaaaacaaaaacaagcaggggtccccgacccccggaccatggaccagtagcagtccgtgacctgttgagaactgggctgcacagcaagaggtgagcagcagatgagcaagtgaagcttcatctgtatttacagccactccccactgctcacattagcacctgagccctgccttctgttagatcagaggcagcattagattcttattggagtgtgaaccctattgtgaactacacatgtgagagatctaggttgtgcactccttatgagaatgtaatgcctgatgatctgaagtggagctgaggcaatgatgctagcgctggggaacagctgcaaatacagattaacattagcagagaggtttgactgcacagagaccatagtaaatcaattacttgcagactcatttcaaaacccaatcagtgagtggcaggtggcaagctgcatctgacgtcaagctttatagtggcaagtgaggtgatgtacttcaattgtacagctgcatctggtggtaacgctttaagtcagaatccagcacttcttttaattcatgagtggcctgcttattattttatttaccactttcatctgcttctctttcctgcattacacacttttcttagtcagagttttggtaaacccaccagctaaccctacccaaaataagtaaaagccaaacatcactggagagcttctttgaaaagggagacagacccaatgatgagatagcagaagactctaagactgccaaccaaaaaaaaaaaaaagctgcatttaaaagaaaataccgagagtcttacataagttatgggttcattgcagtaggtgatttcacattctcagagcctgctttgtgtaatatgtggtgactggctgtccaaagccatgaaaccttcaaaactgcttcaccacatggagactacacgccctgcattagaagacaagcctttggagtttttcaaaagaaaagaacatgaacataaagaacagaagcaattactaaaggccactatttcatcaaatgtgtctccactgagaccatcattcttagtggctaaccacattgctaaagctaaggagccctttacatgaagagttgatcctgcctgctgctaaggacatatttcatgaacttttaggagaggctgcaattcaaaaggtggcatatcttcccctttgagctagcaccctaactagacgaatcaatgaaatagcagagtacatggaggcacaactgttagagaggattaatgaatcactgtggtatgcaatccaggttgatgggtctaccagtgttgacaacaagggaacaatgcttgtttttgtatgatgtatttttcaggaggatatacatgaggaaatgttttgtgtgcttttgttgccaaccagcaccacagctgcagaactattcaagtctttgaatgattacatatcaggaaaacgaaactggtcattttctgtcagcatatgcacagatggagcagctaccattacttgacagctttttggtttcactacttgggtcaaagaggtcgcttctgaatgtgagcctacacaccctgttatccttagagaaatgctggctagccaaaaaatgtcacctgaacttaacagcattttacaggatgtgattaaaattatcaaccacattaaaatacatgcccttaactcacatctgtttgcgcagctctgtgaggagatggacacagagcacacacatcttctctaatacacaggagtgagatggttttctaaaggtagatcactggccagagtttgagttacaagagccgcttcagagatttcttttaggagaatagttcttttcttttagaaaaacaatcaccactggcagcacatttcagtgacacagaaagggtcccaaaacttgcttacttgtgtgacctattcaacctgcacagagaactcgatctgtcgcttcaggggagaacaacaagtgtgttcaagtcggcagataaaatggctccattcaaaaccaaactggaattatgggggtgatgaaggaacattgggatttctgacatgtttcaagcattagcagagattttgagagactgagccagggctgcctttctctcagctagtgtatgatcacctatctcggctttcaaaagagttgagtattacctcccaaccacaaaagacccccgaactggaaggaatggatttgtgacccattcctgaataagtcaggtgaattgcctttgtccttgctagaagaggatccactgcttgacttcaaattatggtggccttaaaagtatgtttgagacaacttcaaatctccatatgttctagactaaagtcaaggcggaatatcctgagattgccacaaaagcactaaaaagcctgcttccattgccaacatcctgtctttgtgaagcagggtttcctgcagtgacagcaaccaaaatgagattatggagcagactgaatataagcaacacattttgggcgtcactatctcccatcaccccgagatgggaccatctagttgcaggaaaacaagctcagggctctcactgattcaacattatggtgagttgtataattatttcataatatattacaatgtaataatagaaataaagtacacaataaatataatgtgcttgaatcatcctgaaaccacttccccacccccagttcacggaaacattgtcttccatgaaactagtccctggcgccaaaaaggttggggaatgctgaaaaatgaaatccatctttctttgcattctttcaaaagattgagtctttcagaatatagaggggggcctataatgggatatattcattaactcatgcaacaaatatttattaaacacctatcatatgccaaacattgtggttaccagggagatagagtgataaacaatatagacatttgcaaaatattcacttcattcccctattgataagcattgatgcatcctgtgtcatatagaaaaggaggaaaattattattcggtaatattatagaacttaatgcaatttaagcaaatgcgtgtatacaaatgtgtatattttgtatatatttgatataatataccatatatatataatatcattctatgtaacctaccacatgttcagaatctgctgcagagattttttctgtgacacaaagaaacattaaatgcttatgcttcttttgttttttgtgggtttttttttctgtttttaaactagggatttggttatcctgcaaattatgaatttacttttgttttaatattctaaagctatacattaatattatttgccacatattggctgagagc

SEQ ID NO: 5 - DNA, 26679 bp, Homo sapiens
ccattctgacattactataaagaactgtaggagagcagccccagtgcttatagataaaactcccatctccctaggacagagcacctgggggaatgggcggctctgggtgcagcttcggcagacttaaatgttcctgcctgccagctctgaagagagcagcagatcccccagcacagcattcgagctctgctaagggatggactgcctcctcaagtgggtccctgaccctcatgcctcctgactgggagacacctcccagcaagggttgacagacacctcatacaggagagctccgggtggcatctgccaggtgcccctctgggacgaagcttccagaggaaggaacaggtagcaatctttgctgttctgcagcctccgctggtgatacctaggcaaacagggtctggagtggacctccagcaaactagagcagaccttcagcagaggggcctgactgttagaaggaaaactaatgaacagaaaggaatagcatcaacatcaacaaaaaggatgtccaccaagagaccccatcctaaggtcaccaacatcaaagaacaaagatagagaaatccacgaagttgaggaggaaccagcacaaaagactgaaaattccaaaaaccagaatgcctcttctcctccaaagtatcacaactccttgccagcaagggaacaaaactggaatgagaattagtttgatgaattgacaaaattaggcttcagaaggtgggtaataacaaacttctctgagctaaaagagctgttctaacccaatgcaagaagctaagaaccttgaaaaaaagttagatgaattgctaactagagtaaccagtttagagaagaacataagtgaccttatggagctgaaaaacagcacaacaactttgtgaagcatacacaagtatcaataggcgaatcgatcaagcggaagaaatgatatcagagattgaagatcaacttaatgaaataaagtgtgaagacaagattagagaaaaaagaatgaaaaggaaacaagcctccaagaaatatgggactatgtgaaaagaccaaacctatgtttgattggtgtacctgaaagtgacagggagaatggaaccacactggaaatcactcttcaggatattatccaggagaactttcccaacctagcaagacaggccaacattcaaattcagggaatacagagaacaccacaaagatactactagagaagagcaaccccaagacacataatcgtcagattcatcaaggttgaaatgaaggagaaaatgttaagggcagccagagagaaaggtcaggttacccacaaagggaaggccatcagactaacagtggatctctcagtagaaatcctacaagccagaagagagtgggggccaatattcaaccttctgaaaaaaaagaagtttcaacccagaattgcatatccagccaaattaagcttcataagcaaaggagaaataaaatcctttacagacaagcaaatgctgagagattttgtcaccaccaggccttcctcacaagagctcctgatggaagcactaaatatgggaagaaaaaaccggtaccagccactgcaaaaacataccaaattgtaaagtctttcgacactatgaagaaaccgcatcagctaatgggcaaaataaccagctagcatcataatgacaggatcaaattcacacataatatttatataaccttaaatgtaaacaggctaaatgccccaattaaaatacacagactggtaaattggataaagagtcaggacccattgatgtgctgtatttaggagactgatctcaatcctagtctctgaaaaaacagactttaaaccaacaaagataaaaaaaaaagacaaagaagggctttttacatttttacaaagaagggctttaccattacataatggtaaagggatcaatgcaacaagagctaactatcctaaatacatatgcacccaatacaggagcacccagattcataaagcaagttcttagagacctacaaagagacttagactcccacacaataatagtgggagactttaacaccccactgtcaatattagacagctcaatgagacagaaaattaataaggatattcaggatttgaactcagctctggaccaagcggacctaatagacatctacagaactctccacccgaaaccaacagaatatacattcttctcagcaccacatttcacttattctaaaattgaccacatagtggaagtaaaacactcttcagcaaatgcaaaagaatggaaatcataatagtctctcagaccacagtacaatcaaattagaactcaggactaagaaactcactcaaaaccgcgtaactacgtggaaactgagcaacctgctcctgaatgactactgggtaaataacaaaattaaggcagaaatcagtaagttctttgattcctatgaaaacagacacaacatagaggaatctctgggacacagctaaagcagtgtttagagggaaatttatagcactaaatgcccacaggagaaagcgggcaagatctaacatcgacaccctaacatcacaataaaagaactagagaagcaagagcaaacaaattcgaaagctagcagaagacaagaaataactaagatgagagctagagacacaaaaatcccttcaaaaaatcaatgaatcaggagttgcttttttgaaaagattaacaaaatagatcgaaagccagactaataaagaagaaaagagagaagaattaaacagacattataaaaatgataaaggggatatcaccactgatcccacagaaatacaaactaccatcagagaatgatataaacatctctactcaaataaactgcaaaatctagaagaaatggataaattcctggacgcatacaccctcccaagactaaacctggaagaagttgaatccctgaatagaccaataacaagttctgaaattgaggcagtaattaatagcctaccaaccaaaaaatacccaggaccagacagattcacagccaaattctaccagaagtacaaagaggagctggtaccattccttctgaaactgttccaaacaagagaaagagaaggaatcctccctaactcattttttgagaccagtatcatcctgataccaaaacttggcagagacacaacaaaaaaagaaaatttcaggccaatatccctgatatgaacatcaatgcaaaaatcctcaataaaatactggcaaaccgaatccagcagcacatcaaaaatcttatccaccataatcaagtcggctttatctctgggatgcaaggctggtttaacctatgcaaatcaataaacacaatccattatgtaaaccgaagcaacgatgaaaaccacatgattatctcaatagatgcagaaaaggcctccgataaaattcaagagccttcatgctaaaaactctcaataaacttggtattgatgaaacatatctcaaaataataagtgctatttatgacaaacccgcagccaatataatactgaatgggcaaaagctggaagcattccctttgaaaactggcacaaggcaaggatgccctctctcaccactcctattcaacatagtattggaagttctggccagggcaatcaggcaagagaaagaaataaagggtattcaaataggaatagaagacgtcagattgtctctctttgcagataacatgactgtatattttgaaaaccccatcgtctcagcccaaaatctccttaagctgataagcaacttcagcaaactctcaggatacaaaatcaatgtgcaaaaatcacaagaatttctatacatcaataatagagaaacagagagtgaaatcttgagtgaactcccattcacaattgctacaaagagaataaaacactaagaatacaacttacaagggatgtgaaggacctcttcaagtacaactacaaaccactgctcaaggaaataagagaggacacaaagaaatggaaaaacattccaagctcatggataagaagaatcaatatcgtgaaaatgaccatactgcccaaagtaatttatagattaagtgctatcccaatcaagctaccattaactttcttcacagaattagaaaaaactactttaaatttcatatggaaccagaaaagaggctatatagccaagacaatcctaagcaaaaagaacaaagctggaggcatcatgctacctgaattcaaactgtactacaaaggctacagtaactaaaacagcatgttactggtaccaaaacagatatataggctaatggaacagaatggagtccttagacatatcaccacacatctacagccatcttatctttggcaaacttgacaaaagcaatggggaaacgattccctatttaataaatggtgttgggaaaactggctagccatatgcataaaagtgaaactagactccttccttacacctcatacaaaaattaactcaagatggattaaatacttaaatgtaagacctaaaaccataaaaactctagaagaaaacctaggcaataccattcaggacataggcatgggcaaggacttcatgtctaaaacaccaaaagcaatggcagcaaaagccaaaattgataaatgggatctaattaaagtaaagagcttctgcacagcaaaagaaactatcatcacagtgaacaggcagactacagaatgggagaaaatttttgcaatccatccatctgacaaagggccaatatccagaatctagaagaaacttaaacaaatatacaagaaaaaaaaaaaaaccccgtcaagaagtgggcgaaggatagaacagatatttcccagaagaagacatttgtgtggccaaaaaacatatgaaaaaagctcatcatctttcgtcactagagaaatgcaaatcaaaaccacaatgtgataccatctcatgccagttaaaatggctatcattaaaatgtcaggaaactacagatgctggagtggatgtggaacaataggaccacttttacactgttggtcagagtgtgaattagttcaaccattgtggaagacactggtgattcctcaaggatctagaaccagaaataccacttgacccagcagtcccattactgggtatatacccaaaggattataaatcattctactataaggacacatgcacacatacgtttattgcagcaatattcacaatagcaaagacttagaaccaacccaagtgtccatcagtgaaagactggataaatcaaatttggcacatgtacatcatggaatactatggagccataaaaacgatgagttcatgtcctttgcagggacgtggatgaagctggaaactatcattctcagataactaacacagaaagagaaaaccaaacactgcatgttctcactcataaatgggagtcaaacaatgagagcacatggacacagggcgtggaatatcacacactggggcctgtctgggggttgtgggctagggaaaggatagcattaggagaaatacctaatgtagatgacaggttgatgggtgcagcaaaccaccatagcatgtgtatgtatacctatgtaacaaacctgcacgttttgcacatgtatcccagaacttaaagtatttaaaaaaaaaaaaaaacaaacaactgtccgatactgggcaatttatcaataaaagaggtttagttgactcacagttctgcatgcttgtggagccctcaggaaacttacaattatggcagaaggggaagcaggcatgtcttacatggcatcaggcaagagagcatgtaatggaagcaaagggggaagagccccttataaaaccataagatcttatgagaactcactatcatgagaacagcataggggaatccatgcccaagatccagtcacctcccaccaggtctctttctcaacacccagggattacagggattacaatttgagatgagatttgggtggggacacaaagccaaatcatatcaaagatttacctctaaacataataaagacaatataccacaagcccatagtgagtattatgctcagcactgaaaagttgaaggcctttttcctaagatgaggaacaagacatgggtactcaccctcacttttgttcaacacagtactgaaagtactaaccagaacagttaggcaagtcaaagaaataaaaaggattcaaattggaaaggaagaagtaaaattgtctttccttatagataacataaccttatatatagaaaagcttaaagactccaccaaaaacctgttaaaattgattaataaattccataaagttgtagattacaaaatcaacatacaatttttagtagcatttctatacagtaacatcaaattgcctcaaaaggaaattgagaacacaatcctatttacagtagtttcaaaaataaattaggtataaatttacccaaagaggtaaaaactctgtaagcagaaaactataaaccatttatgaaagaaatttagggagataaaataaaaggaaagatatcccatgttcatgaattgaaaggatgaacattgttaaagtgtctctacttcccaaagttatctacagattccatgcaacccccgtcaaaaactccaatgacatattccccagaaatagaaaaaaaaaatcctaaaatttgtatgacatcacaaacacttcaaaatagctagagcaatgttgagtaaaaaggataaaactggaggcctcatagtgcgtgctttgaaaatctactacaaagctgtgttaatcaaaacagcatggtgctggcataaaagcagacacacagacttacaggatagaatggaaaagccagaaaaaaatccacacatttatcgccaattgattgttgataaaaacgccaagatcacacaatgggggaagggcagtctcatcaataaatggtcgtagggaaactgggtgttcacttgcagaagaataatattagactcccatctcacatcatatatatataaatcatctcaaaatggattaaatgcttaaatgtaagacctaaaactgtgaaagtagtaaataaatcataggagaaaagctctctgtcattggtatgatcacacgtactttggatataacccccaaagcacagacgacaaaagtacaaatagacaaataggatgacatcaaactaaaaagcttctgcacagcaaaggaaacagaatgaagagaaaacctgtggaaaaggagaaagtatgtgagaccatatgtctgataaggaattaatatccagaatatatgaggaacttgaaagtaagaaaacaatctgatataaaaacatgcaaaggacctatataaacatttttgaaaataagacatataattggccaacaggtttatgaaaaagtgatgaacattactgatcatcaggaaaatgcaaattataactctaatgagatactgtcttatagctgttagagtggctactttaaaaaagaccgaaggtaagtattagcaaggttatggagaaaagagaacccttgaagactgttggttgggttgtaaattagtattacagccataattgtaaacagtatggaggtatctcaaaaataagaagtagaactatcatgtcatccaacaattttactatttagtgtatgtccaaaggaaatcatatcagtatctcaaagagatgcctgtatttctgtcacggcatccttggagtgttacttttctagctgggaacctctgtggctggtattgcctttgtctgaattttgcttgggcctgcttggcttgttctgcctactctgcctggcaggatacactctgctcgcactaacagcctgccaagggtgagccaggtacggagtggtgaggggtgtgtgagttagcgtgtgatctggccactgcacacagccaggcacactagttgtggtgtggtggacagctccaggtgccggcaccctgcaaggctgtggctcaatgaggcttactgcaagcagcttccatggctgccactggggtaggcagtggtgcctggaagcttggagacttcaggaactgcagagccccattgagggtgtcacagctctggcttggggagctcttaagtctgggctccctgaagtgctacagctcttctctccttcttgtcacctgcaacgtggcaagcaaggggcgtgtttcagccctgtttgtgttactgctctttcagtcgtgccgttccgcaggtcctgagttcttgtcctgtgtccaggaagaatgagttatgtggacaagtggagggtgaacaaggtgaagagatcctttattgagtgacagaacagcttaaaggagacccacagtgggtagctcctctctgcaggcagggcatcctgacaagtgttcagctctcagcagagaggagacccatagtgggtagcttctctccacaggcaggttgtcccatcatctgctcagctctcagcagagaggagaccctcagtgggtggctcttttctgctggcagattgtcctgtcatctgcttgagtttggctgagtccagggtttctatgggcttcagaggggaggaagtgcatgctgattggtccatggaaagccatgggcaggcccagaaaaagcaccagaagttctccctccagtccatggcactggcagtccagtccccaaacctcaggctgtctctgacctgaagatgaggtttcaccaggtacctgcccctttccatctaggcctgtctgcctcctgctgccattaacctgccatccacggtgcccatggtgcccaggctgtttgtgctgaatgttgcctgcaggcctgcatcaagccactcttagccccctgtcagcctttctcccatcctctttggtacccaaagtctggagggggccaaggcatgagggggctggtgtgtcatagctgccctgaatgtgtgcacacctggctgattcatgacagtgcccaggcttggccacaactttgcttcaaaattggagcgggtgtttgtagtgggtgcttggagtggggagaggctaggcagcaggagcagtcacttacaagcttgtgggtcagcagggcttcctgggtccccaagagtgtagagatgcccgggtttgcagccacagcttgacggctacaactgcgcccggggggcggggctcccacctgtttaacttggaatgggctgggagcttccacctgttcttggttcctgctggctccgtggagtgcacagccccagctgtgcctcccccactgcatctggtgtcattgatgatgccagggattgattgacaccattccagacaggctgccgctgccttcagtccctgctctgaagaggtacatctgctgccattaggatagggacaatgactgctcttaactgcttcatgctgacagggggcattgtttatggggaaaatggcagttatgtcttcttagaggccctatctaagggtccctagtaaaagtaaaagggagccatcagccaagtttccatttgcatgaccatttggagtttgatggcccgaaggcgagaagagacaaaccgggttattggaagacatggatcaaaacaaaacaaaggggtaaggacagctcaaaaaccctgaggctactcacatgctcaaaattagaatattgatccagattttttatattacgcatcccttttgtctcttctgagccgtagtcagaaatcactggttggttcacaagagcaagctgggttagtctaaaatgcagaccaaaacttaaaaacaaagtccggagggggctgaggcagcatggagctggcgtatcagcactgccccaagcgtgcacatacccagctatgtcatgacagtgcccaggcttggccacaacgttgctccaaaattagagtgggtgccaggagtggggagaggccaggcagcaggagcagactcttgcgagactgcaggagtgtcttcctaggcccttgagagtgcagaaatgcctgggtctgcagctgtggctgggtggctgcagctgcacccaggagggtagggctcctgccccttcaacttggaagtgggcagggcttccacctgttcctggctcttgcagctttgtggagtccacaagctccagccttacctcccacactgcagctggcatcatggcagtggccactccagatgccccactactaccatcacttccatgttcattgtggcgttatttccaatagccaagatgtggaatcaatctaagtgtccattaatgggtgaatggatgaagaaaacatgttatatatacacagtgaaatatcattcacccttaacaaaagaaggaaatcctgtcattctcaacatcatggatcaacctgtaggacattatgttaagtgaaataagtcaggcacagaaagacatactcatgatcttacttattataagtgtagtgtaaaaatgttgacctcatagaaacagtgaaatgttgattatcagaggctagggtgtgggaggaattagggagatgttggttaaaagacagaaaaatttatttaaagtggaggaataaattcaaagacttgtaaatcatggtgactgcagttaataacaatatgttgtatatttgaaaattgctaagacagtagattttaagtgttcgtaccagaagaaatgataagtatgtaaggtaatgtatatgttaaatagcttgatttagccattctacaggtatcaaagcatcatgttttatattataaatatatataatcagttaaaaaaaagtactgagactctgagaaaggcattagttaatttgcccatagttttatatttagtgaatccagtggtcttacttcagatgtgtattcttagccaaaagatgcacttgctttcacctccacttctgtccctaaaaactgaaaagcaaaataaagaggtggaaagaggctgggtgcggtggctcatgcctgcaatcccagcactttgggaggccaacatgggcagatcacgaggtcaggagttcaagaccagcctgaccaacatggtgaaaccccatctctactaaaaatacaaaaattagctgggcgtggtggcgcatgcgtgtaatcccagctactcaggtggctgaggcaggagaatcgcttgaccacggaggttgcagtgagctgagatcagcgccactgcactccagcctgggctacagagtgagactctgtctcaaaaaaaaaaaaaaaaaggaaagaaattcagtagccatttcattcagccttgcagttgatgcagtctttagctaaacactgggatagtttgggagggaaggccgtagtttgggagggaaggccgttagtacaatttttttatacgttgtgcataagaagcttttgagtcatggatctttgataattactttcagtagtaacgtatcctcggtaattttttttactttcagtaataacatatcctagacaaattttatgcatttttttccatacttgaaagaaactttttattaaaaaatagtattaataacggagcataatctggtaggagtgttcattactactgttttattgtttttaagttttttccatgggtagagtaggaaacacgcatttttggagagaaaaacatgaatcccaaatttatcctcattccaatttaagataaagattttgagggattttatttaccactttggtcttaccctttttgtatatctttttcttttattatccttttacctctgttctctgattttacatttttttttgcattttttttttttttttgctagatgcaggcctaggtattttattttacttttcgttatacagtcttctcgattattttaactaagcaggtttttttggatggtgggaggagaaggagaaaacattaagttgtctgcttcttatttattttacatattgcttataattctcttgtgaattattttagggtttttattggttgtttttgtttttgccttcctgatataaaaattatattgcttgcaaataaagattactttccttctttttcttccatttttggcctctaatgttttctttacttgtgttgtttaagatattaaataatagaagagatagtggacatccttgtcttattccttattttaatgagaaagtacctaacatttccaatttagtaagttgctggctaattgggaagtacagacacatgtgtatatctatatatctgtatatctatatctatatctatatgtattcaggctaaaaaatacctcttaatttctatgtaaacgttaaaatttttattttggtaattatgtatgatgttgaattatgtcacttgaatttttagcagttatgaaaatgaacatataatcttctgttaatataatggattttattaatgcatttttaatattagaaacctttgaatttctggcatgtacccctctttcaaatgttttttagtgttttggattcttttgcatattatctcatttaaagtttttgcatcattattcttcagtgtgtttgatttgtacagttttctgtgcagttttgtgaagttttggggccaatgttatatatctgttatataaaaataatttggaaattttcttcctttttaaaacctagtccttatttttattttattcaggcactgttttaacagatgatcaagtacctaccatgtgctattaacaataaaattgtaatggtagttaatagttccttagctcttaactatatatttgtcagtattctaagtacagttgattctcactgcttgaagtagatttgttctgtgacgtagcagtgaataataaattagctcttactggaattacaatgttaggttcctgtaagcctctggtcacaacatttttgttcacctatcaatacgtaacttttaaaaaatgtgtatttctgtttaaagacaacttatttaaaatatgtattgttgattcattaatattgaactcatgtcccacagcagtatgactcatgcctgaaggaagcttttgtaacacacatattttctccttaaggcatatcacaggcgtcttgtgcttaggaacactagatagcacttgggcattctaaatagccaaatcatcaacaaaaagcacaaaaatgagaacattgttgcacttaatagactgtgaaaagaataatcctttatagtatgagagcagaaacaaagcagagcatttgttcagtttcagctgataggatgcaaatcaggtgactcaaaattctcctcctcctgcacatttccacaaattattgccaaagtgctacgaatattgatgttgggatacaaataaattttattgagtagacaaattcataaatgcggaatctgtggatgaggattgatcgtatttctttgtatttaatatgtgttcatttattggtcatagcaatcctatgaggtaggtattataacacatactatacaataaagaggttaagttccttgtacagtgttgaacaatcaatgagtgtttgaggacaccaccaaagtagtataactgataccaagacatgttgtttacccttaggagctatttctatctaaaagcgttaaaggtgttttgctcaaataactaaatttaaggtagtttgaaataagtagcataagtgtagtgctaccaagatgtagtggatattcagagggaagattattttggagaccacggaaaggctttaggtgatggtttctaaatggaggcttttagaatcaataagatttcatcaagttggcttatgaggatgtaggagatgaactatttcagaaggtactcattttttacatcaaatacgttcaatgattctagtcttttgggaataggaaagtgatggtgaaggggcaacctctttagttttcagttttcgggattcatatactcactctatgaccattttttccagtactatttaaaaatttattctgcctttgtaatactgggaactaaagcatagcaccattaattggaagtcttaaagatgaacaaggcaatgttttaatgtaaatgtatgattttcttattatggaagaagaaaaaccaataatagattgacatttgtgcaataggactgcaaatagtgggtgttttgtgggagaaaaaattgtttcccaattttttgggaaaaattcaagtaaatattaaaaattgctgaaatacaaagattttcccccatatacaatacttttgtaatatactcatcatgtttttcaatgcatctcattagccatacctcttaactgcattgtaaaaaccaaaaaattaagagggaatattttaaaccaaatattctaacttcaataggcatcatagtgattatcatttcagatttggtgtccttgtaactgggctgatttatcataggtggtggatgtgtaaacttacctgtgtatgatcttgttgagggcaagaattgtggcttttcattttttgcgtttctgataaccagcaaagttcctatcacatagaaagccctcaggaaatgttactgcctacctaaatgaatactccaaaaccctttatgactaataatttctatgtaaatattgtagattgtgttgatcagtgttcttccattctatgtattaatgttttattttcagtgcaacactgtgagagtgatcaaagtgcaaaaatcctgtccttatatttagctttataatcagaaaacaccatactaatccataattttttttcacaccattggcctgcttttctttttattgttagttttgtttttattgtcagagaatgttaggtaatttcccagcataactttctcaagaatatatttcctcattactgcagtgaataactcagtgatgtgaaattagaagataacctattctgtttcagcaccagtgctttgacacatataacttgaaatgtgaatacgaattttgttttttcatgttaaaggattcaatttttcatcagttacttagatcttcataaaatctgaagttaggaaggaactttactaattattaagtcctattccattttaatgcctgcaatagtaaatgtttatttatgataaaactctgattaggtagtagggaaaattcaaggtcaaaagtacaaatttctaccaaactaaagaaagaatatgttaatatgacttgcaagcttggattcatatatattaaggaggggggtggaagatgacagttttaagaatcacatagtgttcaacaaaaagccaataaaaagtcctctctgtgccaagagttattgaacattttgaaataagagttataaattaattcatatatttcaatattatcaacatttgctcttggtcaagttcccctcctctcccaagaagagattgttttttgatccagtgttcaattttggttctctccgttaaacatatcaagcttacaagactaagataggtgtcactgagaatgtattttattaaaaacaattgaaaaaattgtattcttaaacatgggatcatatttggagtcttggtgtctatgaaatcctcctggtacaaaatttatatatggataaaaactaaaacagtaggattttgaaatcttttaacttttagattacaaaaagaatatgggaaatacagaaacacacaagaagcaagttttaaaatccctgtaatccctctatccagaaatagtaatattttgatgtatacattttcagggtttttttgtgtgtgtgtggtgtatgcacacacatctatactattttacaaactttgaatcataccgtacgaacacttttgttccttgcttttttcaactttgtgaacattttcctatgccaccaaaaatttagttcaaagtcatttaaaatggttatataattttccactgaatgcctgtatcataagtgatcttcagcagtaggacattagatatatagatatatccagttttcaattatgaactgttatgctaagtatttttatgtagctttttatacacaattcctatttttgtatggtgaagggaatgggattttaattcttatattgaatgtaccttgcaactatacttctgttttatcttagatattatcaaatgatatatttaaatatttatcttggtaaataaatacttgataagttaggtcacttttgtcacaaacaaaatttttaattttttattctatttctacataggtcagttgtagttgtaatgaaggaatcataattcctcaaatctaaaaattagaaagatggaaactgatatttcttcacatttaatagtttgattatacatcttatgattaatgttagtattatctgagacaaatatttcactgtcctttatgtaaagttctttatgtacattgtccactatgacaaaatatgtctcttaatttaggtcttggggaatgaacacttgtttttaatattagcctatcagagtaagcactttaattggattagctcatttaattctcataacattgcatgaactataggtagcattttatcctattttatacatgaggaattctgactcatagagtcctcatgtgtcatagagtcctttgtagagctgcaaagtataggcagtaatataggtggtagtatcatgattgatttgtaggaactctgttactggcacctgcatttgtaaacatctacagcaggaatgtatgccatttaatgcttttgttttttttcttctactctaattgaagattattttccaaagttattctcttaacaaaaattgaaaaatatactatatagaatatgtatatagatatttgtatgcatatgtatgtgtacgcattcgggtatgaatagaaatccacaaacctaactgaatagttgctttgcagacacttggttatgaaacactatccactgaccgaaatattttttctggctataattttggagtataattaaaatataaacttgtaagttcctctttttaaaaagatactttagaaaaacagattttactcttttcattagaaaaatattccaatatgtaacagtatatatactcagaaatgcatatgtctgatttaaaatgatttattctttagttttaagcctatgtatatattttaaaaataatttcttattttaggttcgggggtacatgtacagatttgttacatgggtatattgcatgatgctgaggtttgggatatagatgatcctgtcacccaggtactgagcataatatctgataggtagtttttcagcccatttccccctccctcccccctccctcctttagacaactctaaatgtctattgttctcatctttctgtccatatgtattccgttatttaggtcacgcttacaagtgagaacatacagtatttggttttctgttcctgtgttaattaggataatggcctccagccacatccatgttgctgcaaaggacacatttcagtctttttatggctgcgtagtattccatggtgtatatgtgccacatttgctttatcgactctaccatcgatgggcacctaggttgattccatatctttgcgatcgtgaatagtgatgcagtgaacatatcggtgcatatgtctttttttaggataatttatttgcctttgggtatatacccagtaatgggatggctgggtcaaacagtagtcctgttgtaagtttttgagacatctctcaactgctttccacagtggctgaactaacttgcattcccaccaagagtgtatatgtgttcccttttctccccaggcttgtcagcatttattattttttgactttttaataatcaccattctgactggtgtaagatggtatattgttgtagttttgatttgcatttctctgatgattagtgatgatgaacatttttcatttatttcttggccacttacaatgtcttcttttgataagtgtctatatcctttgccgattttttttttttttttttttgagacggagtctcactctgtcgcccagactggagtgcagtggcaggatctcagcttactgcaatctctgccccccaggttaacaccattttcctgcctcagcctcccgagtagctgggagtataggtgcctgccaccaagcccggctaattttttctattttgtttagtagagacggggtttcactgtgttagccaggatggtctcgatctcctgacctcttgatctgcccgcctcggcctcccaaagtgctgggattacaggtgtgagccaccgcacctggccccattttttaaaggagttatttgttttttgcttgttgatttaagtttcttatagattctggatattagacctttgtcagatgcatagtttgtgaatattttctcccattctctaggctgtttactgttgataatttatttttctgtgcagagctatttagtttaattaggtcccacttgtcaattttcatttttgttgcaattgcttttggggacttagtcataaattctttgccaaacctgatgtcaagaagtgcatttcctaggttttcttgtaggatttttgtagtttgaggtcttatctttacatctttaatccatcttgggttaatttttgtatgcggtgaaaggtagagactagcttcattcttctgcatgtggctagacagttatcccagcaccatttattgaacagggagtcctttcctcattgcttccttttgttgactttgttgaaaatcagatggttatgggtgtatggctttatttctgggttctttgttctgttccattggtctatgtgtctgtttttgtaccagtcccgtgctattttggttactatagccttatagtatagtttgaagtcaggtagtgttctttttgcttagtattgccttggcgatttgggatctgcttttgttccatgtgaatattagaataggcttttctaattttgcaaaaaatgatgttggtagtttgatagaaatagcattgaatttataaattgctttgaccagtatggccattttaacaatattgattcttccaattcatgggcatggaatatatttccatttatttgtcttgtctctcatttatttcagcagtgttttgtagttcttgtagagatctttcacctctttggttagatgtatgcataggtttttgctattggaaattggtgtgtgttcttgatttggctctcaggtagaatgtttttggtgtatagaagtgctattgatttttgtacattgattttgtatccttatttatcagttccaggagccttttggcagcatctttaatgttttctaggtatggaatcatatcatcactgaagagaggtaatatgacttcctttcctatttgaatgtattttatttctttcttttgtctgattattctgactagcactttcagtactatgttgaataggagtgttgagagtgggcagccttgtctcattctagttctcaaggagaatgactccggcttttgcccattcagtatgatgttggctgtgggtttttcattgtgagaatgaataataagaatgaataaggtttttcattcttattattgtgaggtatgttccttcgaagccttgtttgttgagggtttttatcataaagagatgttggattttgtagaaagctttttcttgtctattgagatgatcatatgctttttgtttttgattctgtttatgtggtgaatcacatttattgatgtgcatatgttgaaccaaccctgcatccaagaatacagcctactcgatcatggtgaattaactttttaatgtgctgctggattcatttcgctagtttttttttgtatttttgtgtttttttttgtttttttagggttttgtgtttgtgttcatttgggatattggcctgaagttttcttttttgttgtgtctttgccagattttggtatcaggataattctggccttgtagaatgagttagggagcagggggagtccctcctcctcaatttttttgaatattttcagtaggattggtgccagttcttatttgtatgcctggtagaattcagtgtgaatccttctagtccatggctttttttttgttggtaggtttttaattactgactcaaatttggaacttgttattggtcttttcaggttttcactttcttcctggttcaatctttggaggttgtgtgttcccataaatttatttcctctagatttcttatttgtgttcatagagatgttcataatagtctctgaggatgttttgtatttctgtgggatcagttgtaatgtcatctttgtcatttctgtttgtgcttatttggatcttccctttttctcctttgttaatctaatgagaagtctgtcaatcttttttattcttccgataaacctactcttctttccattgatcttttgtatggatttttgtgtcttaatttaattcagttctgatcttaattatttcttttcttttattagctttgtggttttttttttttttctagttcctctaggtacaaagttagattgttaatttgagatctttctaatttttgatgaatgcatttggcaccgtaaactttcctcttaacatgctgtagttccatcccaaagattttgttaatatgtggttctgtttttgtgaatttcgaatagttttttggtttctgccttcatttcattatttccccaaaacttattcaagagcaaattccttccttttcatgtatatgtgtagctttgagagatcttcttggtgttggtttttgtttttattgcactgtgatgtgagaacgtgcttaatatgattttgatttttttgaatttattgagacttgctttatgaccaaaacatttggttgatcttagaatatgtttcttatgcagatgagagaaatgtatattatgtgattttgggtggactattctatagatgtctattaggtcccattggtggactgtcaagattaagtctggaatttctttgttagttttcttcctcagtgatctgtctaatcctgtcactggggagttgacatctcccagtattattatgtggctattgaggtctttttctaggtcaaaaaggacttgttttatgaatctggatgctccaatgttgggtgtgtatagacttaaggtagttaagtcttcttgttgaatggaaccctttgccactatgtaatacccttgtttgcccttcttaattgttttcagtttaaagtctgccttatctgatattagaattgcaactcctgctctttattgttttccatttgtatggcagttctttttccctttaattttgaggctttcggtattgttacatgtgagatgcatcttcttgaagacagcagacagttggatcttgtctttttgtccagcttgccatcctatgccttttaagtgggtctttattccattcacattctgggttggcattgatatgtgaagttttgatacagaaattgtgtttttagctggttgttttgtagagttgtttgcatagctgctttatagtgtctatgggctatatgcttaattgtgtttttgtggtatcagatactgttcttttactttcatgtttagcactcccttatggactttttataaggctggtctagtggttacaaattcttagcatttgaagcttactttggtgggatatgaaattcttcattggaatttattctttttaaggctactgaaaattggtttccgatctcttctggcttgtaagtttctgctgagtagcccgctactatcctgatggggtttcctttataagtgacctgactcatctctctagctgcctttaagattttttctttaacatcggccttggtgaatctgatgtctgtgtgtcttggggatggtcatcttgtataaaactcacaagagttttctgtatttcttgaatttgcatgttgatatctctagtgagattggggtatttttcataaactgtatcttcaaatatgttttcaaagttgttttctctctcaggaatgccaatgaatcctaggtttggtctctatataatcccatatttttcagaaatttttttcatttttaaaatattcttttttccttatttttgtctaagttgaattgaaagaactaaactggtcttcaagctctgagcttcttttctcagcttagtctattctgctgtaaatgcttctgattgtactatgaagttcttgtagtgaatttttcaattttagaagttcagttcggttctttttaaaaatggctattttgtctttcagctcttggatagttctactggattcctttgattccttgaattggtttcacctttctcgtaaagccattgaacttccttgttatctagattctgaattgtctgtcatttcagtcatttcaatctggttaagatctattgctggggagcttctgcactcttttggaaagaagaggacagtgactttttgaattgttagagttcttttgctgattctttttcatctgagtgggctggtgttcctttaactgtggtataagttgagtatactcaattggcttcttttctaagtgttttcagagggccaagactctgtacaggatttttatttgtgagtagattctttccctgggtttcacagatgatgtatattggcagaatatttttggtgttgtaatttggtctgtcaaccagtagatggtgcttaagtataatggccgatagataggctttggctctgacttgtcgctcttttgtatttcagcaagtttagagcaccgctgtcttccctaggagccattcagtggcaggaactagccctcacattcggaaaccccacacaggtttcccagtttcctctctcttcaccctcagtgtctatgttgcctttgaactcttggtgtttcctctctgaagatttgttcaaagtatgtttgtttacttgatattttggtctctcttggtggcataggcacttcctggctgtgtctagtcagccatcttgtcttctgtgccctctcaaatccttcttcaagccagtatttttgttattgccattgaaatagacaataattgtcctaatgttaaggaaaaatttattcagtgatacttgttaaagtacattaaggaagactttatttagggtcattgcgatagatgtaaggaccactgacatgggattttacagtgagggagagagactcacaatacaacatgggcaagtgggaatttatagccaatgagaagggatggagagttagtagatagaaaattactaaaaggaaatatcagacttaaaaggtgattctggctaaactcacctagaaggatttttttctgaagacaggccaagataatcagacatctcctggggatggtggggaatgaagaatgcaattagatatccagggtgatcagttatcaatgtttttgctgtactgacttagcagagttttttgctaaaactgaattttacaagaaagtgcacagatgggcctaggagaaggcttggtcaagcaaataatcttcatcagttataaagcccttcacataataaaagcggctttaataattgtgaatttaaccttgcatagaaatttttcaaataagaaactaatatacttcaagaatatgcaggggattttttactagtaatttagttacatgtttccctctttttgttcgttagaagttacatgagggcagttatgacttctgttcactaaggttaattccattgaatacatacaaagcattattttcaaggccaaggccattggtagtggtggtaggggctggaacaaagaaatttattagataagatacccttaacactgatatacgtccattttgttttaagagcatttctgtagagacaaaaaagcatagaaaatatactcattgctatttggagtactttgtggtaaatctggaatccttgcttttgcttttatagtagttccataacaaggttatttttaaaacatcatccaaaactgaaatttcaacattaattggattggcacttctagttgtaaatcagcacttccagtcataaatcttgaggaaattggtatcagacctcatgatattctgttttcagtaggttagttttctcagcattattttgtgctaaggagaagaatctctgtgttttaaaccttttcaaagctatgtaacttgatatttgctcttttaaaatcttagccatcaaataccagctctactgcctgtgtccgtggctttccattctccctatcattgccctgttagggcatcattatcagttagagagacttgtattgcttccatactattcttcactgctagatgaaagtttctaaagtttagctcttatcctgtcattacaaacttgaatatgtagaataattccccattgactaatgtgttttctgtggcctaacatttctatcctttttgtgtgatttcatcccccatctacttttttagttttatattccatcgttcttttttcttcgcctaatacttaaactgttctctaaatagcccaacaccaatatgtgtatttatcattttctttacattgttttatttctctgaaatggcctttcttcagttttgcatgcctaaactctaccaaatgagcccaattgtaatgacttttccatgaaggccttcaaaccaagttatcacttgtttttctttgcttttattattttttttaacttttaaaaatgttttcttctaacttctttttaatttttttgtatttatttatttattgccctcaaacattctcctatccagttattgttcttttataaagctcatctctccttccctcccacatagttgctctgcatactttctactcctcttatttaattttttgttttggaaaatttagggactatacaaaataaacacaatgaagtttatagtatgatgtatcaccatgtacccatcactcagaaacaagttatcgttatgacattcttgtttcgtttttgcattcctccacttctcaccatccactcagtcattggtaattctttaagataaaatttacataattcaaattcacaaatctgagctggacaattacgacaattaagtaaacacatgaaacccaatccccctttcaaagtatagatagaatgtttctttctctccagaaactttctattgcctctttccagtcagtcttcccaccctcataggacggctttaacttttcttcaccttttgttttacctttcttgttctttccatgtaaatggaattacactctgtgtaagtcttcttttgctcaacatgtttctgagatttatctcttattattgcttggaacaatagtccattccattttattacttagtactattccattctgtgactgttttataatttgtatatccatttggtttatggactttttgattattttcagtttttagctattatgagtaaagctgctgtgaatatatacatgtaagcctttttgtggatattactgattcttgttattcactctagttatgttctgtaaagtcaccgtggacactgaattattgaatactgaaccattgcttctaggggaaatatagggttaggttcttgtgatcctctggtcacaacatttttgtgaactgatcaacatataattttgttttatgtgtgtttctgtttaaaggcaccttatttactatatattgttgtttcattaacattgaattcacagccaacagcactagaactgatgtctgaataaactttatctaaaatgtattttctccttaaggcacaccacagccttcttgcactcaggaatactacacagcacttcagtattcttcatggcaccattctacacaacaaaatcaccaacaaaatgcatcacaacttgaaaaacatggcaaaaaatagatcatgaaaaggacgcttgtttacagtatgattgccaaaacaagagagagtattggtatgttccacatcagctgagaatgtacctgtctgctgactcaaatttttgctgctccgtacacatctacaaattattgtgaaagagcttcaagtattgattttggggttactaacaaattttagttaggaggtgaattcacaaatgtgcaatctgtgaataatgaagattgtatatgttcttatttttcttggatagatattagtattcacaaatgtgcaatctgtgaataatgaagattgtatatgttcttatttttcttggataaatattagtataattgatgggttaaatagcatccatactttataagatactgccaagcctttttctaattgtagttgcaccattttaaattcttattattaatgcataagcattccagttgtttcatatattcatcaacatttgatattatcagtctttcattttactcattgtagcactcatttgatttttccttgctgtagttatgtgtttatgtcttatctctcccggctggaaattttttggcggcagtatataatttgtatttgtatttgccaaactaatattttggagagatactatacctttgttgttatgtgcacaaacgttggagctagaatgcctgtggtcaaagctcaactctcccacttacaaattttgaggccgtagataatgaaaataacataacagtaaaataactttttataactatattaatttgggtctctcaacaaacaattattattagtagtttggaaatcaagcctttttgaggttagatagcttgtcccagatcaaacgagtaagaggtaccagaacaagatttcaaattcaggtctaacttactccaaagccagtgctcttaactactgcacaatacagtat

SEQ ID NO: 6 - DNA, 26679 bp, Homo sapiens; identical to SEQ ID NO: 5

SEQ ID NO: 7 - DNA, 35780 bp, Homo sapiens
aatctccctgctgcacaaatttgtgaaaaacgtatattcccatgtcatggtgaagagattctgattcattaacataaggatgagacccagaaatagatgtttttaggaaacatcatagataacctgataaataacatattttcagaaattttctatgggtttcaaaaagtgtaatagttgcactatggtggtaataactgatacattcaggtactactagtgaccatgtaaatcataaaactttggaaacaaatttgccattttctaaagagttattaaaatgttatataatttgattcaattatcttattttttattgttttttgtaaggcagtaatctagaaggttattttaatttatacattatttccaagattttgatattaaaagtgacatagaatctaaattattgtttatctgctcaatggatcattatataaccattaaattttataattatgaatactgtagtatcagggaaataaaaggtagataaaaagcataaatctcatttatttgtacagtacattttcaattgtctaaagattgtctaaaaataaagagtaaaggaatatgttcaaatttaaagtagttggttttggccaagtgtggcagctcactcctgtaatcccagcaaaatgagaagctgagatgggcagatcacatgagaccaagagttcgagaccagcctggccaacacggcgaaaccccgtctctactgaaaatacaaaaatttgctgggggtggttgtgcacatctaaaatttcagctacttgggaggctaaggcatgagaatcacttgaacatacttcttgaataaagaagtcacttcctggactctaagccaagagtctaagccaaatatcagaccagtttttccagggggccttattagcattcatttgttaaagtcaaccttagtttcttaaagctgaccatcatatctaattttgcacatcatactcactaatggtttccagattctggaggaatcaagtagagagaaaaagtaattatttcaattttatttataaaaatataatctaggccaggcatggtggcttatgcctgtaatctcagcatttttggagtccaacgcaagtggatagcttgagcctaagagttcaaggctgcagtgagctatgatcacaccgctgcactcttgccttattgatggagagagatgctgtctctttgtaaaaaacagaaaaacataacctaccacattgcggtaaactataaatatcctaagagaaaatgcttttcttaaatctggaagccaaagcacaaaagagccagcaaaattttgaagaaaaggttattaaataattataatcacccttttcagtttatttagtcaaatctaattaagtcttattctgctgtatcttggcttggcaattttatgagctcatcagttgctttattagagttgtggaaattcttacccagtccaatggtatgatcttaaagttatcagaaacctttattctgtagcacttttcagagccttttccattagacactttggcctatatcagattgtaaatgctttcagagaagaatcaaagtaaaacaataaattgagaatgacaaaaggcttaaaatcaccataaagatctgatgagagtttatttgctaaggaaatttatttattgctgtggctaatgatattttaacataataattggaattgtgactggtaacattatgccaaacctatcatgaataacatattgacaaatttctatcaactttatataactcctgaaacacttatattaataacatatatctatatacatataacctaaagaagatatagcatcagttcttatttgacagtacttcctctgtaatttaacaaatcaaactaattaacataacatctctcttttacaaggcaagagacaaatcctttgatattttccaggaaccctctgggaactctcaatgttaatttaaagtcaaagatacgttatgtagaatttgatttgggccgggcacagtgcctcatgcctgtaatctcaacactttggaaggccgaggcaggcgaatcacctgaggtcaggagtttgagaccagtctggccaacatgatgaaacctcgtttctatcaaaaatacaaaaattagctgggcatgttagtgcccgcctgtaatcccagctactcgggaggctgaggcaggagaattgcttgaacctgggaggcggagcttgcagtgagctgagattatgccattgtactccagcctgggcagtaagagcgaaactctgtctcaaaaaaaaaaaaaaaaaaaaggaaaaaaaagaatttgatttaatttgggaaagtttgtcaaaaatgtcagaaggttttaaacactagaatcacacatcattataaaacaatacttatatataagtattgtttattactttattacttataaacaaagtaataaaatattttataagcacatatagaagttacatagttgtaaataaaactgagtacttttaacattgaaaggattccgcttttttaagtaatcaaaataactgataaaggtaacatgaaattgttcaaaataactgataaaggtaacatgaaattgttctaacatacaaaaccttgattttctaggcagattacttaaaaactgggggaaaaccctttcacgatatcgttatcaagagcagacaggtaatccaagaaaagtatgtcattttaacagagaacacagaattctaatatggcatgtgttctattaatactaaggctttgtttgtttgttttttgtttttaagagacaaggtctcactctctgttgtccaggctggagtgcagtgtagctatcatagctcactgcagcctcaaactcctgggctcaagtgatcctcccacctcatccttttgagtagctaggactacaaggatatgccgccatgcacagctaatttgcctaatttttgtggagatggggtctcactgtgttgcccagcctggcttgaactcctggcttcaagtgatccccccacctctaatgctcaaattgctgggattacaggagtgagccaccatgcctggccactaaagcttattaaaaaacaacaacaacaaaatacttttgactaaatctgtccaatcttagccaactctaccacacaaaataagatcctgtttccaagattacttttccacaaacctgtagttttaaaaaatatattcagtttttgtcctgttcttttttctctttctctttggcacaaccagtcattcttactttaggacaaagtgacactctttttcccttaacaaacccacatccttcattcttttcctcatcaaaaaacacattctacttcccttgaatactttgcatatagggttttttcctgattagatttttttgtgtgtgtgacagggtctcactctgtcgcccaggcttgattgcagtggcacaatcgtagatcactgtaactttgcactgctgggcttaagcatacctccacaaccaactaattttttaattttttgtaaagagttctctgttgtaaagactcatctacttgtaaagacgagttataaaaagtttataaccttttatgaatataatttataaaagtttataactttataaatataaacttttataaattatatttataaaaggttataaccttttggttataaaaggttaaccttttggttataaccttttataaatattatttatgaaagtttataagttaacgtgctttcatctatttaattcacttttaataattatgcttggattgctcatgaaaatttcatgagacactgctcaaaggtagatattctcttaaattttgttgttgacaaatcagacaagtatctaaaatatcacagaagcaaaaatcctaataaacaaaaaccttgtttttgcctttttaaagtgtatacatcaattcatttttattgtacatttgattcttaggttgcatttatagttttattctcataaatatctggtagagatagcataagtttgtttgatgagtaaacctaagtggaaaacaattatatgtcgtattatgtttaatgctgacaactctgacaacattcctgtttttattttaccaacaatctttaaaccagttttatttaccaaagattatcccagatcacatgaacctaaaataattaggttagttttcatatttttgagagttttaggaatacctagtttatacaagcactgatttttctttacatcaattaaatggagcccttttgtataattttctatctggagatagaaaaatatcacaaatctatgtcatgcatacatacacacacacacacacacacacacacacacacacaaacagattcaaataaagatcttacaggtttcatttgaaaatttctgcaatgagtcaataaaacatagtaatgtgaactcaactggtttatataaaatcttgtcttttcgccagcttatacttttattcaatttgtgattctggcatatgggacaaatcgaggttagctactcaatatgaggaccagtgcttttcaccaatatttggggagggtttttttttaagattttaattgcccttctgataggtaattttttttatttttctttttccacaacaaattcagatcttccaatcataagtagtataatggcagctgtggacaaaacttcagacaagtgactaaggagacatctagcagctgttcagttttctccaaactctgtctgagaaaatacaatacccaatctatttccaattagcctttcttttttatttttcagcagaccccctgaagcccttgagaactgagattcctaaagttcaagttactgaggggctggagtgggaagggaaaatgtctaacaggggtagatagagggatgcaggaggtaggggcttggagagaggaatatcaaggattcaagggatgtgcctttccttcaggtataggtagggtacctcttacatgagagtcttaaaatctgcttcagaggaatgccattaagtccttcctacacgtgatttctcacatgccttcagcttagaatattcagtataccaactgaatattttgtgatagcatgtactgaactcttcattagttaaaagttgctaaagtttaaggaagagagcatttaattctcaccctatcatattaaaaattgtatttgaataccctgaacgtagagaaaaagctgggcccagaactaaaataatatcagggtacctgatattggaattttgaactgaattgtgtctcctccaaatttatatgttgatgcactgattgccagtgtgactgtgtctggtctttaggaggtaattaaggttacatgagatcataaaagtgtggctcttcttatagggccacagtcttaatgcaataggacggtggccttataacaagaatacagactcacctccttctcttcctcatgacaacactgcaagaagatggctgtctttgagccaggaagaaagccctcatcaaaacctggccatgctggcaccctgatattggacttttgttatgtaatccacccagtgtatgtattttattacagcagccctacctgattaacacatctgccaagctgaaatgttggacacctgtcaagtttaaggtgtatgtaattgctttcttcagtcttgatatagataggtctttatttagttctaatctttttttcccttcatatttgttgccctcactggaaaacagtatgttttatgtagcagtaagagccttgtaaataatgtttttcaagtgaggacaggacagatagtgtttttgtttgtttgtttgttttgtttgttttttgacagtgtcttgctctgttgcccagtctggagtgcagtggcacaatctcggctcactgaaacctccgcctcctgggttcaagcaattctcctgcctcagcctcctgagtagctgggattacaggtgcacgccaccacgcctggctaatttttgtatttttcatagagacagggttttaccatgttggtcaagctggtgacagatagttttagttgcccccttcctatgaaaatacagaatactgaatccagtttttgtgtattcaattaaaattccactaatgcttcagcttttttaacaagaaaatatttctgttttgaatgtttaacacagagtcacaagatagtcatgtatgcatgcctggtattgaaaaaatcagtaaaaaactgataacttactgactatccaaattgttactatactttgatgtttgtattgtaccatgatgataaatctggtccttagcatagtaattgttattttcataatctctaaatcagtttcttctgggttctgagatccaaaaagatgaaacaaagactaattgttgactgaaagaaatataagtaacagctactgctaacacattttaaaattagaatgcataaattaacaaatagtgccaaaaagtaaacacttttttgcaaggcaaatcatatgccttatctactcccgttcaaattaataaaaatacactatttataaacatgtactactgtactttccttttagctttatttcagaaaaatgtggaataatttacacttccacctctcaggatgctgtcagcagtagcataatagcaaaagtagaagcattttgaaatttaaaaaaggcagaaattaattaaatttaaaacaaattaaaattaaaatatggtggcattataaagatgtgttctgataaaagtctagtatattttactattttgagaagcaaatcaactcatttatgaatccttttaatatttttctgtatttaattgcatttgctagagcagtcttcttctagggatgtttaagatccctttactattaatagctggaaaatgaatagtcagagtactgattgatgatatgatgattttagactattattattttgcatttatatagcatattgcctcatatgtattcaaatatttcataaaagcagttatcagaataacaaagtctgtatttgcacacaagtattacaaacaatttaaagatacacagattgaccctccctcatctgaaaatctgaaatctgaaattctctaaaatctgaaatttttgagtgctgccatgatgccacaggtgaaaaattgcacacctgacctcatgcagtgaattgcaatcaaaactttatttcaagcacaaaattattttaaaatattgtataaaaatcatctttatgctacgaatataaggtatatatgaaacataaatgaattttgtgtttagactttagtcttatatgatttggctgtgtcccccctcaaatctcatcttgaattgtaactcccacaattcccacatgtcataggaggaacctggtgagacataattgaatcatggtggctggtctctcccatgctgttctagtgaaagtagataagtctcacaagatctgatggtttttaaaacgggaatttccctgcacaagctcactcttggcctgctgccatcttagtaagacgtgacttgctcctccatgccttctaccatgattgtgaggcctccccagccacgtggaactcttaagtccattaaatctctttcttttgtaaattgcccagtctcaggtatgtctttatcaacagcatgaaaatggactaatgcagtaaattggtaccagtagtgtggggtgctgctgaaaagatacccaaaaatgtggaagtgactttggaactgggtaacaggcagaggttggaacagtttggagggctcagaagaagacaggaaaatgtgggaaagtttggaagtccctagagactcgttgagtggctttcaccaaaatactgataatgatatggacaatgaaatccagactgagttggtctcagatggagatgaagtacttgttgggaactggagaaaaggtgacacttgttatgttttagcaaagagacttgcccctgccctagagatttgtggaactttgaacttgagaaagatgattagggtatctggcacaattgatttctaaacagtaaagcattcaagaggtgacttgggtgctgttaaaggcattcagttttaaaagggaaacagaacataaaagtttggaaaatttatagcctgacaatgcgatagaaaagaaaatcccattttctgaggagaaattcaagctggctgcagatacatgcataagtaataaggagccaaatgttaatccccaatacaatggggaaaatgtcaccagggcatgtaggaggtcttcgaggcagcccctttcatcacaggcccagaggcataggaggaaaaatggtttcacgggctaggcccatggtccctgtattgtgtgcagtctagggacttggtgccctgtgttccaaccactttagccatggctaacaggggccaaggtaaagcttgggatgtggcttcagagggtgcaagccccaagccttggcagcttctacatgatgttgagcctgcgagtgcacagaagtcaagaattggggtttgggaacctctgcctagatttcagaggatggatggaaatgcctggatgtccaagcagaagtttgctgcaggggtggggctctcatggagaatctctgctagggcagtgcagaagagaaatgaggggttggagcccccacacagagtccctactggggcacggcctagtggagctgtgagaagaggatcattgtcctccagacttcagaatagtagatccactgatagcttatactgtgcacctggaaaagcagtgcacactcaatgccagcccatggcagcagccaggagggaggctgtaccctgcaaagccacagggtcggagctacccaagaccataggaacccaccttttgcatcagcattacctgaatgtgagacctggagtcaaaggagatcatttgatttgacgtaagatttgactgccttgctggctttcagacttgcgtgggggctttagcccctttgttttggccaatttctcccatttgtaagggctgtatttacctgtaccctcattgtatctaggaagtaactaaattgcttttgattttactggctcataggtaaaagggacttgccttatctcagatgagactttgggctgtgaacttttgagttaatgctgaagtgagttaagactttgggtgactgttgggaaggcatgattagttttgaaatgtgaggacatgagatttaggaggggtcggggtggaatgatatggtttggctgtgtccccacccagatctcatcttgaattttaactccctcaattcccacatattgtgggaggaacctggtgggaggtaattgaataatggggttgagtctttccaatgctgttcttgtgatagtgaataagtctcagctgatctgatggttttaaaaacaggagtttccctgcacaggctctctcttggcctgctcccatccacatataaaacatggcttgctcctccttgccttccaccatgattgtgaggcctccccagccacatcaaactgtaagtccattaaacctctttattttgtaaattgccctgtctcgggtatgtctttatcagcagcgtgaaaatggactaatacatatccccaggatatctcattatatatgtatgcatatattccaaaatccaaaaaaagttgaaatttggaaaaacttctagtccaaagtatttcagataagggatgttcaccctctgtctgtccaaaaatcatgaacgaagatctagtttgtgtgtagaaagttgcagtttcaccctaaaaagcaaaacaagctggataagtcatataattcaaagattatataatcaaaattttggttatagcgatctacgagtagttgcctgaggtagagggaatttactagaaagggaaatttgagatctttcttggatgatggaaatagtctatatgttgcttgggtggcagtttcacaattacataaaattgtcaaaatccatcaaacataacatcagagatcattattttttgtatatatattaacttgatatgaaaatctgaatgtggtttaatatgattcaatttgcatttaatttaaaatagattaatttagcaacagtagcaacagtgaaggtggaatacgttgaaaataaaggttatgacttttgtgggcactgatagtcaatgggttgtcagaaagaagagtagtaattcccattttttgtgtggaaccatggatactggtagaaaattttttcagttacactagttctgatctgatctcccactatgattgtataaagcagtgaaaactcatttaatattcttccaggactttcatttatcaatgcctaccaggcagtgataatcaggatagccatatgctttgtctactcttggttaaattaatggaaacaacaacaactttatataatatggtaactatactgtattgtggtagtcaaagttagattcatttagcttgctgcaatgcatagggaggctgtgcaaggagctaaggtattttggtacaagaagttactaggaattcatcataggattcagggttgtgcttaaacgtggtttccgtggactcagtgtccttagagtctgctaggctccatgtgggttcttccttttgtgtcagcctccaggaaactcactcaagcctttgaaaatcaggctcacctatttgtttcctgtctctctggaatcactatctttactcttgagtttaatcgtttgaataccaagctgttgatatatatatcttctgacttttttaggtgttttagaaaatagggaaaatccagtatctttattccttcttggtcagaaataaaagttctcatattttttttactaaaatgttggggtagggtgatatgtggatagacaaaaaagttaatatgccagtgcttatttgtaaaacataaagcttaaatgaagaaaagtaatattaaaatagttatacatcgttttttaaacactatgttcaaggcatcttgatctgtggaattatgtattttagctaagttgtactaaatagtactgattcagatatacaaatcataatacttatcagctaattgaaagctccttgagaggaatatttaatggtttaattttgaacatactacatattttaagtatcaaatgttcagtaaatatatatgtggaatacatgttttctgtgtcagacactgatatggtttggctctgtgcccctacctaaatcttacctcaaattgtaatccccatgtgtcaagggaaggacctgtaatcttcatgtgtcaagggatggaggtgattggataatgtgggtggtttcccatgctgttctcgtgatagtgagttctcacgagatctgatggtttgataaggcagttttgcctgctcttgctggctctctcttgcctaccgccatgtaagacatgccagcttccccttctgccatgattttaagtttcttgaggcctccccagccacatggacatgtgagtcaattaaacctcttttctttataaattacccagtcttgggtagttctttatagcagtgtgagaacagactaatacagtaaactggtaaagtggtgagtgaggtactgctatagagatacccaaaaaggtggttgtgactttggaactgggtaacaggcagggattggaatagtttgtagggctcaaaagaagacaggaaaatgtgggaaagtttggaacttcccggagacttgctgaatggtttttactaaaatgctgacaatgaggtggccaatgaagtccaggctgaggtgatctcagatggagatgaggaacttcttggtaactggagcaaaggtcactcctgccttgctttagcaaagagactagtggcattttgcccctgccctagaaatctgtggaactttgaacttgagggagatgatctgaaattggaacttatgtttaaaagggaagcagagcataaaagtttggaaaatttgcagcctgacaatgtgatagaaaagaaaaatcaattttatggggagaaattgaagcccattgtagaaattttcataagtaatgaggagtggaatgtgaatagccaagacagtggggaaaaatgtcaccagggcatgtcagagatcttggtggccacccctcccatcacaggcccagtggcctaggaagaaaaaatggtttcgtgggctgggccctgagcccctctgctctgtgcagccttgggacatggtgccttgtgttccagctgcttcagctccagccatggctaaaaggggccaaggtacagtttggtccattgcttcagagggtgcaagccccaagccttagtggcttccatgtggtgttgggcctgagggtgcacagaagtcaagaattgagttttaggaacctccacctagatttcagaggatgtatggaaacacctggatgtccaggcagaagtcgggtttaggggcagagccctcacagagaacttgtacaagggcagtgcagaagggaaatgtggctttggagcccccacacagagtccccactggggcactgcctagtggagctatgtgagaagaggaccaccaccctccagaccccagaatggtagaacactgacaaccagtaccatgagcctagaaaagccacaggtactcaatgccagcccattcaccaaagctgcccaaggctgtgggagcccacccattgcatcagcgtaccctggatatgagacttggagtcagaggagataagctttcaaattgagtgactgccccaatggatttagaacttgcatggggcctgtagcccctttgttttggccagtttctcccatttagaatcggtgtagttaccaaatgcctgtgccaccattgtaacttaaaagtaactagcttgggtcctttttgagatgcagtgttgctctttcgcccaggctggagtgcaatggcacaatctcgactcactgcaacctccgcctccccggttcaagcgattcttctgcctcagcctcccatgtagctggtactacaggcacgcactaccacacctggctaatttttgtatttttagtagagacggggattcaccacattggccaggctgctcttgaactcctgacctcgtgatccacccccctcggcctcccaaattgctggggttacaggaatgagccaccgcatctggccttgttttttattttacctgcttataggcagaagggacttgcctgtctcagatgacactttggactgtagacttttgaattaatgctgaaatgagttaagactttgggggactgttgggaaggcatgattggttttgaaatgtgaaaagagatgagatttgggtgaggccaggggtggaatgatacagttcggctctgggtccccacccatatcacatcttgaattgtgatccccatgagtcaagggagggagctgtaatctccatgtgtccagggaaggagatgattggatcatgggggcagttttcctcatgctattcagtaataatcagtgagttctcatgagatctgatggtttaaggcagttttccctgcttgtgctaggtctctcttgcttgtcgccacataagacatgcctgcctccccctccaccatgattgtaagtttcctgaggcttccccaaccatgcggaaatgtgagttaattaaacctctttttttttttttgtaaattaccctgtctcaagtatatctttataacagtctgaaaacagactaatacagacacctagcatttcttattagaattcataatatttattccttccctgagcttaagagccattttcaggtaagatgagaactaacatctatttatataaatccaataaaatatatgaattttgattacaaatgctaattttcactcagttttaagcttctatttcttatgctagtttctcttcattatgttgctatagatctactgattatccactttatgtctttctaaatattcctttatttactgatatattaaaatttttgaacaattaactttatttatcaaagactaacataattcctgatctcttggtagttaagtggggaaggcacatatctatcaaataagcactctaatttgtatataattaaggctgaaataactataccagaattaaggataaagttttgtaaagactgaaataatctattaagtctcatgcacagaagagacatagttcaggaggtattttggatgaaaattgccaaagatattgtagctgaatcccaaacctgagaaatattcttggttttttagtatttttccttcatcaccaccgccattgccaccatccctcttcagtctagtccattaccaaatcccattagctccttctccaaaataacatcaaatccaactatattatctattctaccatcaccctggtttaagccaacatcatctctaacttgaacttgcagtatttctaaatatctgtttccattcctgtcatcctttaatccattctctatatagcagccagagaaaccttttattaaccgtaaatcagaccatgacatttttcttcttaaaaccttggtggctctctataacattcagaatgaagtccagtttattcaggataggctactagaccctggttcctgaccttctctccaatctcatctcatcaccattttattatttatttatttttctcctcactctcttcctacaagctatgctggctgccttttcattgcaagaataaaccaagctccatactattttggtgcctttcagtttttgctgtcctgtacctagaatgtttttctccagttttttacttatttggctcatcgatgttaaaatcagatcacctcttcagataggccttctccaataaccttgtctaaagtgacctcaagttattgtattaacttattttctccctcatttaattttatctccttaagttctgtgaaagctatgaattcattccatttatctttgttgtagctatctttgttggcacttaggtgctcagtaaaaatactttttatgtggatatttccccagtcttcttagtaaagtctgaactataatgaaggatcataatcatagcaaacatttatgtagtctccatataaattaataattgacagttgatgatttctgaaaaccataatccgtattcactcagtaagtgagtattttatattatagctgaaaatagcttacttttaaaggtataaagtaaaggataaggactcatacacacttataaagtctaaagttgttaattcagttcaacagataatttacatttaatactgaaattcactatttactatgttcagtgttgtgttaggcaagctgtctagcttaaaggacactaatgttcaacatgaattctaaatggagtaagtaattggagatctggtatagaaattgagtgaaatgcattattaaaatccatgaaaaccaacaagtcttagtagttattctttacaaaagccataattaagacccacacctcccaaactgtgcaccagggtaccccagactgccatagaaaactcttagggataccataggctttttttaaattttgagggaaaccagcaacatctgtcagatactatgtaaagtactatctcaaggtagttcgcagtttcagtgttagattgtacctttgatgatgtcacatctttatgaagctgggttttgcacagttaactgtgagaaaaagcaagtactacaggaaaattattgtggaagaggaaaggagggcaacagtatccaatatgattcaaaggtttaggatatgtacagggcccaatagttgtacccatcccattagtaagtaattgtagttactattaataattatttaaaattaatatgtttttactttcaatttgtatctattatttaacagctactaatttgttaggatataaaacttaagttgtttggaccttactacttaataaacagaactattagatacttcttttactgggtgccatgaaaacattattgagacacccagagcaccttgaactgagaaagtttgagaacttctgatatagccaaattttattttattttatttttatgattcaaatatcattttattgttaatagcatctttctggagatctggtcttcaacagactctctagaagaaatttatgtttatgataagtgggagactatactatagaagcatagagaaagagaaataatatttactgggtacctactatgttatagacattatttttatttcttgtttaatacttatagcaatcttaagatatataatgatgatcttcccattttatagacagggaaccaaaggtcaaaaaaattagatattttgctaggttacacagctaactggatggtgcctgaagaagctaaaggctttttatggcaatgactaatgtattattttcaacttaagaaagttagttggatggagtgacaaaggaacaaagatctactatattgtggattttattactgtaaataaacactgaaggttacttttttttttaaattcttagtccctattattcatgcaagtttttcatgtcatttgctggatcattaaatttgagtatatttggtagtcttatttccataatagagaatcagtgaagattgttttagtgtttcacatagttaaaattgtattttggtcacctacaacttgataatctatagaagttaagtactaccgagttagattttcattgaattttttattttaactgttttctttcttttttttttctttttttttttttgagatggagttttgctcttgttgcccgggctggagtgcagtggtgcaatctcggctcactgcagcttccgcctcctgggttcaagtgattctcctgcctcagcctcctgagtagctgggattacaggtgagcaccaccacacccagctaattttttgtatttttagtacagacggggtttcatcatgttgtacaggctgatgataacctgaactcctgacctcaggttatccacccgcctcggcctcctaaagtgcagggattacatacgtgagccactgtgcctggcctattttgactgttttcttgcctgtgtgccttgtaattataaagaaatttctggaacccatacaaagatattttctatttgcacttcattttctgttagcctcttctgaaacttctgcagtgttttgaattatctcaaccattctccacatctcttaacctctgtttcttattttctttctttttatctctctttgctgaattctatatcacttcttgagacctgtcttccagtttatgaattttcctttcatctgtatctgatctcctacagtcttctgagtttgtttctccagtcctaaaattattatatgtttcattcatgggaaccctggttggttattttcaaatctgcctagtaagttttcttacattttgtacttttctaggcatattaaacatattaatgttttctaataattctaatatttacagtatttttaggtctggttctgtagttcgtcgtttctacatatactttttgtggtagtatcccctttcccttccccttcctcttcctgttctcccttcctctttctttttccccttccctttcccctctttcgggcttttgagtgaatggagttcattccttcatggagaaatttgattctcccatgcacatgggatactgtcaatgtgaaaccactttcaattttggggtggtgtggattcaggccataaccctgcacaaatgtggatttgtggttattaattctcagggaagcccctttttctttttttttcttttcatattctacccaatccaaggtagacaggcatgtatctctttcaactccctttttggagttttggttgtttttcttagtttatccttttgggtgttactgactgcatctgaattttatgtgatatgacttcacatccatattgaactctgaaagcctggcttttaagcactgggctctttaataccaaggctgtaggccacacatcagcagataccaccagagtccagcaaatactggccccagaactctttccttttctggatttatgattcttttttgcttacagcctttatgaattcttttagtttccaaccagccaaccgtgtgcttaaataagtctttaaaaatgtgtattatattcacactttttagatgtggtatgctagaagtgaccttaactgaatatgttggtctgctatagtacaaaaaaaagcaattcattaaatattttgaatgacagcacaggattctgtgctgactcaagttagagcaagttacacactttagaactcttctctgaatttgctgtcactttacccaaaagtagaattagaactctttggctgccctcaccatagccaagtgactcctaatcctccagggaacatgtaaaatggtaaaatttgcctgaaaaatacagctgactttcataagactacagcaaattttgaaaggtacattggagcagtagtagtgataggaaaccaattgttaggctttctatattcattcttgaacggttaccccaaaagagtatcctaaaattcaagttaaaaattaaaacactgttaatttaaaactgtcttttctgtttcagtttaaaatgttaaatcaaaacagactttcttcttaccctaaaatagttacataagaacagtctgttgtcacagaagtcattctattataaagttactttattataaagggtatagtctctatttaaaatgttaagctacaaatatttatccttttgagccatctgtactgctaaatacccataagtattttagactaagatctgaaaaatggaaatactttaaaacctttgcattgttgattcttgattttttttatggcgtgtgtcttgctttgagcagaaatagattgatgcagacagcttacttgtaaaacattatgttactgtcatttaaaaaaatagttttaaaccctctgatggaaaggggcatctttagatgaagtaatttcattaaaatatccaattcagaatctaagtaaataaacttaaatatataaaaattcttcacttaatgtatttattcccataataaatatgttaatttcataaatttagagctctgttaggtgaatttattttattattttaaatcattaccttagctaacccagaaagtttctattgagaatgtttgttccccactttctcctcatgaaatcattttaatactgtataataccaggaaattgattaatgtcattaatcaactattattatggatatatattttattggatgcttatttcatatttcctttttgggtggcgttctattgaaacatgtgagaaaatattagtaacttgtctactctgcttacccccatcttatataaaccccatttccagaggactggaaactggaaagaagaatacctcagggctgaacatgacaggggcttaagaaaagtatctgagaaattataaccaaaaactgagcctagaatgaatttgcaattcaaattcatattgtctgcactgtataaaaaaatttacattttttcttacagcttttttttttttttttgagacagagtctcgctctgtcacccaggctggagtgcagtggcacaatctcggcgtactgcaagctctgcctcccaggttcatgccattctcctgcctcagcctcccgagtagctaggacaacaggcacccgccaccacgcccggctaattttttgtatttttagtaaagatggggtttcactgtgttagccagaatggtctcgatctcctgacctcgtgatctgcccgcctcagcctcccaaagtgctgggattacaggcgtgagccaccacccccggcccctgcttttttttttttttttttaaacaaaaccatcaatggaaggaaaaacactttaagtgtatgaatttagtttaaagtagtctatgatggatagtgcgttcggacaactgaccaaaacaaatgcagattctctggtgaattcactttgtcctaaaattcaaagaaataccatacattatttaccactgaacacgaaaagctacaaggaaatgaagtactatgaataagaatcatcagaaacactaagcagctgaatcaaccctacatagacattaaatattggaatgattggatatagagtaaaaaacaactatgcttacttaatatgttaaacaaaataaaactaaaaagcaaaagcctaaaaaaaatcaatagggaacagcaaactgtaaaaatgtcctagcaaatttggaaaataatcaattagaaattctagaattggaaacaaataatctaaatttaaaatcacatggagtataacagcagaacagatacaattgaagagagaaatagcaaagtgaataataggctaaaagaaattattgagaatttatcacaaagagcaaaaattcaaaaacaagaaagaggttcaaaactacactgtttcatgcacactggtgtatttatgatatatctcacaaaaatgtctaaaatataatcaaatatatggtcaaatatgctcattcatctttagagctttctataagaagaaaacaaaaggaaaaacattatgtgcaacagtaggggaaggatcagagagttaatagttcatccattacaaattatgttactataaatacttaacgtcatgagggaaatatttaccttaagagtattacatttatacattgatctcaaattcaaagaatagtaagatatgttatttatttaacgatacatataaaaagaaagaatatcttatttaatagtagagcttacttctgaatactagggatacaggtactttaaaattttctttgtaggctctttgtatttcccagttgttttaaactgaacatttagtacttaaaaaaaaaaaaagccagaaagctgctaataagtattaaaaagtggtacttagtgatgtattctagaacttttctgtgctatatctgtgcttttcctgtggtaagtgcttatcatatttttaaaatgactgatatttggctcttatagattcttaatgtatatttaaatgaagtggatgaataataaaagttagtggaaaatttataaagagtaaggccttgaatatttgcaacacactgaactgttgattactggggatttaagctgagagtcttcatttaggtgcaatttagtaagtgtcttagttccttttgtgctgttataacagaataccagagattaggtaatttataaagaaaaaatttatttcttacagttctggaaagccgggaagtccagtatcaaggtgctagcatctggtgagggccttcttgtggcatctcatggcagaaggaagaagggcaagagagcatgtgtgtgagagaggaagaaattaaacttgcagcttcaagcccttttataattgacattaatccattcatgagggtggagtcctcatgtcctaaacacatcccatcaggtcccagctcccaacattagggattcagtttccaacacatgctttttggggaacacattcaaactatagcagtaagcaactttgaagacgttcttgatttgcttattcaatatgtgtaagatctagcaatatttatgagataaatataatatgcaaataattttgttttaatttattcatatgataaatatttattgaatgtcttttgtgtgctacacgttgcactagattttggagatgacttgtgaaaccatatacagtctttgatgagatttagagcatagtagaggatatatatgtatgtatgttacatgcatatatgatttattcaggagtataaggcaattcaatattaggaagtccattaatataaaaggttgggggaaatgtggagagtaataccagagacaaacaactataaaagacatgtaagttgttgtctttgggcagaatcactatgaaatgatggttggataggtggcagctgttgttacatcatatatattttatcactgtcttatgttttcaagtttgtacatatgttactttactaaaaataaaagttaattttctagctgacatcaaattatttcttcctctcaagtcctttgtagctactgtcaccagcagaatatcccatagcctccttctaatatctcctcaccctggcagcctctgatacagggataaagtcctttgagttggctttggctcagttaccttcagtattgtccaattgattcatgataaaaacccgttgtctttatcatgctaaatgaccaaagtgtaaacttccaccttactgtcctttctccttgccttgctatcttcattggttccagtgagtctttcttttttagtcctcttgagcaaaaacaagcttttccacaattccaagggatacatgtcaaacgctcagaatgctttattgaacgctcttccttgacaccatctccctaaaaatgtcaaaacactctaacaacacttttccaaaaggaactcttttgccttgttagatttcaacattcttatatcccccagggtggtgtcacaagtgtcaaaaacagttttgagtctcattgtttacagttccttcatagacaatataataaatacctcactttggccttaacattctgatacatgttaattgttacactattttatccattataaagcataccacaaaattagaaactaaagagaattagattttttatgtatatatatatgatatcttcttttaatggataattatgcacattcctagtatgtgtgcagtttgatttggagaccattatattgaagattccgtcctgtttgggcaggattgcatatgcccctgagcctatatagctcttgttatagaaatttattgtgttgatttttttcactgttcaatatcccacccccatagtagaattgatttttagaagaaacggtgacagtttttagcagccatgatggtggcctagggttgaagaaatatgtgatgtattgttagagtccaagccatgctgttctattaaaatactatttttcttcctgctctttttgaagttgattttatttctgcttattttctaagcctgaatttctggccttcatttgtttttgttcttcttgtttttgtttttgttttgttttgtttttgagacggagtctcgctctgtcacccaggctggagtgcagtggcgcgatctctgcttactgcaagcccggccttctgggttcacgccattctcctgcctcagcctcccgagtagttgggaccacaggcgcacaccgccatgcttggctaatttttttttgtatttttagtagagacggggtttcaccatgttagccaggatgcatttctttttttttaatacttaagtttctttttcttgtttaagaaagttggagttaggactgttgttcattcacaacaaattgacaccactgccttaatatcataaagactctgtattgtttcagttgtttgctcattgggaaaatactccagggtgaggcctcccttacatctgagggacctgattccctgtgtagagagttctttttttttttaattgttccagtttatacttctggtagacttttaatcttcccccccactttaaagtcccagtatgccccactataaattgaaacattgtgttctagtctttatctacaaacttagagaaaattaattacttttcaaggtaacatattcaattttattttcttttttcttagatcactccagtatatccagcaaactcccttaaactaagcccaaactggtgttgttgcctgttgcaatttccttcactagagcatccagaaaagcttacttgcctttgcatataaaatctcttactttgggaggccgaggcgggcggatcacgaggtgaggagatcgagaccatcctggctaacacggtgaagccccttctctagtaaaaaaaaatacaaaaaaaattagccaggcgtggtggctggtgcctgcagtcccagctacttgggaggctgaggcgggagaatggcgtggaaacgggaggcggtgcttgcagtgagcggagatcgcgccactgcactccagcctggacgacagagcgagactccatctcaaaaaacaacaacaacaacaaaaaaactctttaattgctttaaaacagctaaccaagtcttatttcctttatcttcttgtatttttcttatattaccttggcaaaatgaaaaatttggggatttagtgtttgccaagtcaccatatggataaatcaccactagtgaagaataaactatatccatattatgttactttaaatgaaacgattacatttcatcattaccctcagaattaaacctgttatttacactactacttctcatcctttcttctaataggctccaagctttctcctttttcatctttcatctatcccaataaaaacataacttccaattttaattagaatagctatatataataggttgaccaactgtgtatcttctgtagccttctgcctataacctgattataaaattgctttaactaaagtaagttactgcctattctgagttactctattacacaaaatttaattttattacgctactttcttttccatattattttcctcctagcctcttccaattctttgtcttcttgatctcccttattaatccttttctcagggaaggaagatctgatcagccaattcactccaagatttaagtgactagtggttggaaatctgttcctcttcagcattacctgtaatttaaacaaggaattaagttgtattggctttggtgaggcacaacgtgtgtttgtatatgagaatgagttctttatagcacccattcagtcacacaaggctacctacttgtaagtctaatgtttagagtaaacagtgaattatctaatacattttgcatttcttacaccttgaaagaatgttgataaatttccttatacaagtagtctgatctgatgttagacaaatagtgaatactcagttttattgattaattgagtgcattttcagaatactgaaagattaggaattgtggttgactgagcattttgttaagatgttattagagacaaatacaaaaaaattctggctctctggattggactctgtgtagattgattccatctgtaaaaggtgcctcatctttgacagtagatattttagtcactgttacttgttagagattcaatatagcaatgcaatttttttttatttacttataaggatttatgataccaagttgtatttgacatttggattaaatcctgaggggtaaggaagattcgtccctgtggtagaagtttctaaagtcttaagtcaaatgaattctacttacactttagttagaaggccatttaagacaaacgtgccttaaaagatcaagtttttcagtgttaaaattctacatctcaatataggttatgaatactacattaagttcatttggttatgaattcattattttcaccttttgctgctattgttatacttcaactctcttatttttacaactttttattttgaaaactttcaaactttaaaaaaatgttgggacaacagtataatgaacagctgcactctgcacacctagattctcatgattgagaatacatgctgtatctatttatatctctgtcttgccttctctctatatataacttaaaaactgtttcagacatagtgacactttacccctgaatacttcagcatgtttccctaaaattaaggacattgttcaccgtactcttatcatatgctggaaatgttaacattgagacaataatatcataaaatataacatacaaacctatttttagatttctccaattatctcaaaatattatttatagattttttgattcagtattctgtgagggattataaatgataatttgatagtgatatgtcttcaccattttgttatatattgtcagaaatttgatgtagaataattcatatgttagcaactgtggaaagtgttgccaattatgaaaaaaatgtaaatttagataatttagaaatagtccactaagacttttattatatagttgattatattaattaaagtaacttgaattccttgacagtttacttatgtataatgagtgttcatgatgccctaattgaatttttatttttttaaaatttaatttttaaaaataataataatacagtaaaaaaccctttgtgatctttcttaatagtcacatcatcactctaccctgcctatcacagatctgttttacatcactatagtttgtgtttttaagaatgtcaaataaatagaatcagaaagtatgaccagcttctctcagagtagagtctctgagatatatccaagttgtgtatgtcaataatttattcatttttatggtagatagtattccattgtacatatataccatagtttgtttatctactaacccattgaaagacatttgggttgcttccagcttttggctgtcacaaataaatctactgttaatatttgtatataagttttggtatgaacataagttttcatttctctataaatacccagatgtacaattgctggctcatatgataaatgtatacttaacattataaaaacccgccaaactgttttccaacatctgcatcatttcagtattaggctcaatcaattgtcttatcccatgtgaatttgtatcctgtattactttataagactctgagtcttatttagatcctgtggaaaatattgatatttttgttttggccttctgtggattgtgtggttctaaccttggctctattttacaagactttggtgtgcaatttggatctgtcatgaatgtgtaccctctagtggtcactctgggaccagcttgtagatctgttcttagctaaggcctttaaatatttgatatgctaattagtatcaaatccataaatgggcagatccagggtgagtaaaagttcaaaacaactttatgtagttgctttcctggtctcccttccctaagtactttctacttcccttggggctgttttttttgttattgttgttcttcaaaaaagaaattgtttctttctgcagttttacgacatcctcacaccatttagcactggtgataagatgccaccaaggctacatggtgggaagacagggacatagggaaaaaattctacagggtttggtgctgcccttttggcattgctgcttctctgaaaggtaggtcgacctccctcagagttttgactcctgcagtctctcatttctgtcttcttttattttagctgccatgggactgttcagggtttggggcatagaaaaatgaggaagaggagagggggaaacaaaataacctggagatttctcctactctttctctgtctgcactgtaagtgttcagaaaatttctcctggacctcactcacaccacatagtgctcagttctgggtttctggcttcagaggtagtggaggaaaataaatgttaaactcaacattggtattcttccctcatctgtctactagtgttaacttttcagagttttcagataagtctctagccaggttttttagttgaattagcatgagataaagagagtctggtcttatttcatcttactggaatcaggacccctaattgatttttaaatggtattgttgatacaattgtcaggccatttatttcagtatttcactaagtaacttctaaactgtgaaaaaagtaattataaaataaacatcaggtatttttgttcttatttgtatctttgacatgagataaagtttgtggaagatttaacaagaacatcataagaagttgactataaattagatgttaattcattaatttattcactccacagaaattaaacgagtactgactcttggcctgggattgcagatattataatgaacaagataggcagagctccttctcaggacgggttaatagatttgagacagtcatttatagtacattgtaaaaaaaaaaaacaaaactgccccagagttaatgttaaaaattgttttattattttttctttaagataaaacttttaaggggtcaggactctggtaatgttgaatgtacattaatgcatttatgtatggacatagctgaggattttgttaaaatgtgccttaaatgattacataaattaaataagcaatttgttcagcaggttaaaaggaagatatttcatatttttgtaaatgaacacatgaaattttttcctttaagattttaaatgccaaattatttacttaggtagtgaactatagtgttaacattaaataaaaagagatctacatatctactcctatttctgtattaataaactgtgatgatgtatcaataagtaggatcatgtgccattaggacttgaaataatggaatatggtacgtcctaaagcttattttgtcattcatctagccaataatattaattacttaatatcactgctcaagctatcatctttgagaaatactgatttaacaatagtttacactaaatatgtaaaaaataattttaaagtcaagcaaaccataggttaattaccccattacttgagaatgcaaaaaaaatacttttactatagtacttattaataaactcatttttaaatttaaattgcaaaagttatcacaggctttctatggtatatggaattataataacatacttttaattgatgtttgttggaattcacagcatttatagactttttaaatagactttattttttggcagttttaggttcatagcaaaattgagcagacagctcagagattttcccatataccccctgcacccttacatgcatagcctcccccattatcaacattctttaccagagtggtatatttgttgccattgaagctacattgacgtatcattattacccgatccatactttatagtaggattcactgttggtgttgtatattccatgggtgtggacaaatgtattatggcaccattatacaggttgaatatcccttatccaaaatgtttgagaccaaattgtttctgattttggattttggaatatgtgtatatatgtagtgagagatattagagatgggacccaaatctaaacattaaatttatttatgtttcatctacacatggcctcaaggtaattttatccaatattttaaataattttaggcatgaagcaaagtttgcctaaaacgaactataagaaagcaaagatgtcaagtgtggaattttccacttgtagtgtcatgttggtgcttaaagtttttcaggttttggagcatttcagatttcagattttcagcttcagaatactcaaactgtagtataatctagagtagttccactgccctaaaaatcctctgtattctacctattcatccctttctcctcacaagccaccagcaaccatggatatttttaatgtctctatagttttgctttttccaaaatgtcatatagttggattcttatagtgtgtgtccttttcagataggcttcttttagttagtaatatgtgtttaagtttcctccatgtcttttcatggtttgatagcttatttctttttaccattgagcaaaaagaaatgagttgtttatcatccactcacctactgaaggacatcttcgttgtttacaagttttggccattatgaataaagtctgtataaatatccacatacaggcttttgtgtggacatagttttcaattcctttgagtaaataccatggattatgattgctgcatcatgtggtacagtgtgtttagttttgtaagaaaccaccagactgtcttccaaagtagctataccattttgcattctcaccagcaataaatgagacttcttgttgtttcacattcttgccagcctttggtattatcagtgttctgaatattgaacattctaataggcttatagtcatatctccttgttttattaatttgcattttactgatgatatatgatgtggagtatcttttcacattattatttgtcatctgtgtatcttctttggtgatgtgtttgttaaggtccttggctcatttttcaatagagttgttcattttcttattgttgagttttaaaatctctttgtatattttgtataacaattcattatcagatttgccatttgaaaatattttcttccagtctgtggcttgtcttttcgttcccttcacagtgccttttacaaagcagggttttttttttaatttttaatttttgtgagcatatagtaggtctgtgtatttgtaggattcatgagatatttagatataggcatacaatgcgtaattgtcacatcagggtaaatggagtatccatcacctcatgcatttatcctttctttgtgttacaaacaatccatttatactcttttagttatttttatatgtacaataaattactgttgactatagtcacccagttttgctgtcaacagagttgttaattttaatgaaatctaacctactgtttctttcttccaaggatgttgcctttgctgtcatatctaaaaagttattaccaacccaaggtcatctaaatattcttctattctaggagttttatatttttatgttttacatttaggtctgattcattttgaattaatttttgtgaaggctgtcaggtctgtgtttagattcattttttttgcacatcatgtcttttaagattctgagttctttcggaagacattccttggctgggattccaattttggctctgcaaggacatatcactactctcatactaaaaatcagacttataattgtagtctctgttttccaagtcaggaaataaggaaaggaccaggacaccagtagtagccatggtcttaaggctccaaaaagatgtagagaggaaaatacataaatacattaacttagtggaggtgagggaggaggatgaccttggtgccccctcacttttttaagcacaggtaaagttgattcataataatgtcaacatgtacttctttaattttttggtagcaggaaaaaggtaaattaaagcttaccaatgttttgtaaaattctaagtatcactggccctcttgtattttatcaatgctgaaaatgtgatgcttgaatccaaaaacaaatgaaatcaaggtttgattaaaccggttctaagacttcattactttgctacttctgacttactgccacatattactattactcctaattgtactaggttgctttggtttggattccagcaaacgaggtaagttggcacaagtgacctaaaaataaagtttttgtactgctgggatatcatttggctggttttctaattttgttgggcttggatcagaattaattatgtgttattttcatatcaatgtcaagtctgtatttatagcattctttttttttagaagtcacagaatttttaaaagtagcagaaaaacaataaatgatattgaaaaaattttagtacttacattttcgtcatgatcttctaaagcctcctaaaagaaacattgctcttgtgaatggtgctgcagtgaacctacacattcacgtgtctttataatagaatgatttatattactttggatatatacccaataatgggattgctgggttgaatggtatttctgtctccacgtctttgtggaatcaccacactgtctttcagaatggttgaaccaattatattcccactaacagtctataagcattctgttttctctgcaacctcaccagcatctgttatttttggactttttaatagccattctgatggctatgagatgatatttcattgtggtttttatttgcatttctccaatgatcagtgatgttgagcttttgtttatatgcttgttggctgcatgtatgtcttcttttgagaagtgtctgttcatgtcgtttgcccacttattaatggggttgtttggatttttcttttaaatttgtttaagttccttatagatgctggatactagacttttgtcagatgcatagtttgcaaaaattttctcccgttctgtaggttgtctgtttattctgttgatagtttcttttgctgtgcagaaactctccatttgtagagccctgcaggatagatttagcataattcttgaagaccctagtattttcagaatggtcaatgagcattggcttcaacttaaagtcactagctgcactagtccctaccaagagagtcaacctgtcctgtgaagctttgaagccaggcattgacttttcctctctctatgtgaaagtcctagatggtatcttcttccagtatttaaggttgtcttatctacattgaaattctgttatatagaatagccaccttcatcaatgatcttagctagatcttctggataacttactgcagcttctacactagcacttgctgctttacctcgtatgtttttgttacagatatagcttcttaaacctcatgaagcaacttctgctagcttccaacttttcttctgcagtttcctcacctctctcagccttcatagaatcgaagagaattagggccttgttctgaattaggctttggcttaaggaaatgttgtggcttctatcaagaccactcagactttctccatattagcaataaggctttctctctcttgtcatttgtgtattcactggagtagcacttttaatttttttcaaaaactttccctttgtatgcactacttggctttttgccataagagaaggttatctcagcttttgacatgctttcttctctagcttattcatttctagcttttgatttaaagtgagagatatgtgactcttcctttcacttgaatagaaaccactgtagggttattaattggcctaacgatgttgtttctcaaggaataaggagacccaagaagagggagagagacaggaaaatggccagctggtcgagcagtcagaacacacacatttactgattaagtcccctgtcttatatgggctcaattgatgttgactccaaacaattacaagagtaatatcaaaggttaattattacagtttacaatagcagacatgatattaatgaaaaagttttaaatactacgagaattactaaaacgtgacacagacgtgaagtgagcacatgcacttggaaaaatggccccagcagacttccttgacatgggttgccagaaaccttcaggttgtgaaaagcacaataaagcgaagcacaataaaaaaatgtgtttcttaaacaacaagactataatggacaagaaagagctgagactagagacaggagaccaacatgttaatcttaagtcaggaatcctaaagtgaagcaataggagtggttaaaaaaaaaaaaaaaagagaagagagattgatttaataaataattgtaatatagaattagtagcattgaatcctgatacacccacagaaaatatatacaaacgtgtttaaataatgaaaatttatggtagattctgttattggccctgattttcaaccatgtccgtcaaagccctttgccatataattttttaggaacccactgttgggggtggagtggacttccttgccttatgaatttgtatttgaccacttaacttgttgttaccaatggatagagcccctgggtatatacttactctcttgtacatccaccatgcaataagaatatgtgtgacagtattttggtgtcaggagaaggatgagagatacatgggggagagctactcccaggcctggaccagataattcttcagttagccatgtactcatgaatgaacccagctgagcccagcctggagcagccattttttaagcagtgcacagatttaggataaataataagttatgattgttttaagcccctgagttttagggtggcagtcatagctaactgatataaagtttctattctgccaaaaaaaaaaaattttaaagaaagttatattctattctattttcacacatcaattgatgtgaaaacaaaatataatctactgatccaacaggaaaactgcttgcattattggttttatttattagactgccttaatgcagcaatcacgcagctagaaagggaaaaataaaacgaatataatttataaaaatagctttattgagatataccttatatatcataaaatttacttattttaagtgcacaattcagtgatttttagtatacttatttttgccactgtcaccacaatgtaatttcaaacatttccatcatcccaaaagaaatctctgtgcccattaccagtcactttttttctctcccacctccagcttaagactatgtaaccacaaatctacttcctatcactatagatttgcctattctagacttttcatagcaatagaattatacaacatatagggatttttgtgtttagcttttttcactgagcattttttaaggtgcttctatattgaagcatgttttagtagttcttttttatttctggatagtaatccattatctgagtttatcacattttgtttatttattcatcagttaatggatatttgagttttccactttttgtctattatcaataatggtatgaacattcatttacaagtgtttgtacaaacattatgtttttatttctcttagataagtacttagttgtagtagaatttctgggtcatatggtgactctgtcttcagcattctgagaaacttaaagttttccaaagtgactgtgccattttacactcccaccagaaatttatgagggaaaactgatagtaatttaattatactgaatattcaatttatactactagtgactttcatatcataatacagaatgataactatatataaaagataataatcagataatctgaaaataataaaactgtgaaatgtacttctctctatagtgagtcatatgtgtaagttatgcagcaggtgaagaaatgtgtaagataggccttttaaaacacaatcttaaatcttattaaggttttctagagtaatataaataatgcgataatagaaataagatctacttattttctactattctgtaaaattattaaataattaaattttctttctatagtaatcttgttacaccaagctcactttgtactattgtgcctatacagaaattacactaatttttcctccattaaaacattaaaatagccttttgacttttatagacttcagagaagttgtcattatatctcaagtgctatgaatgtgaactgtgggaatgtgaactttactaagaatcaattatatagcctaagttggtgttttatatttgtttttcctgcactgttatggaaacctgtaaaatatgttaacattgaactatttggtcttatttagacagtattttatcttacaatgctgtatgatgaaatcctgcactcaaataaaacattaatcagcagaacttaaataaaaatatatgactgttaattttgtagtcttcctacttgcttagaaattaaatttctaataaatctttgtctctgattttgtgcaaaacaatgctattggctggtgacttcactgtctaagaatatggatttataaaggtatagagagtatcggttatatagaggtatcaggtaaagttcatgcaagccaaatatttttaagcattcaatggtgttttcttgtaggaattaaatgtatttattagcttgactttactgactatgtttgcttaatattaatctattagagcataactgcataacatgggttttaaatgaagcttgctgttactctaaatttatgtcacaaatgtggctctgggaaatttttcaagtttgtctcagtgctttaagccttataaaaatgagcaagtaactcataaataatagacagttc

SEQ ID NO: 8 - DNA, 7118 bp, Homo sapiens
aaagtagtatttaaatcctcatctcaaagcttctatcagtaatagatatgaagcccaaagcagtaaatgtttaaatgactactttacatctcttaaatgcagtgttatgtcctggctatatggtaatgacatcattaaacagaaatcctttgagccgcagaaccaagatgctttatagtaagttctatgaagttacatagtcaaagagttcactgttctttaagttagactcatatccgcaattttatgacaggttctgcttaaataattgtagggtagtggtaaagcatggactttagggtcaataatctgaagatctaaatttgaatttgtcgtgtctttcattagttagctgacattctggatttcagtttcaagacctttaaaatgggaataatagcaatcatcttaaacatgtccaagaaagagtgagacaattaaataaatacattactaagaagggctataaatgaaatgttattataggtattagcatcatcattatcattcattaccctaatcattatcatctttaagcaatattaagggatgacacttacagatagactgagtcttactctctgggtcaagaaggttatttcaaaatgcaagttactaaagtatattatatatgcaaaacatttggcttattaaaactcaagtgtcatggctcatagccgagacctgcactttcatataaatgtgatttgatcatatgtatcatattcaaaaatatctattagtcctataacgttagccacagtggctaatttctataatagcttcacattttagttacttaccaacataaatatttatttcttatttatgttacagtaaacttaagtttgcttgggtggaaggttgtctctttttcacgcaattatttagagttccaggcttcatccatctaatggctttgttaaagtctagagtcttggagtgtaccactgactccgttaatctgaccggcagataaaatagtaaagaaatcatggaagcttgcaaggaaagtacatgaaccaggcctggaagtggtatataccacttccatgaaaaatcctactggtttaaaatcggtcgcatgactgcacctaattgcaaaggaagccagaaaatgtagtccacctatatgctctgatggaagataaaatggatttgatgagtcttgccagcctctgccatagggttctagcatattacaataaattatgaatttaattgaccgaaagacaaagcgcaacttaatggtgtcacaatcccatgttagttataaaaaataatgtataatctattctcccctttatggttactgtaaaaattagtagcaccctagttaattcaatgccagaaagcagctgtcttgagagttcatggtcttaagctttacatgcctgggctctatttttggtccagtggagttggtacctctggggcctgagtaatcccgtgttgcagcagacagagttcctctgctgcagtcaggccttctcatcagtgtatacccctgtgaaacttccagactacacagaataacctggctttctctcctggatgtggatgtggacactaaatgctcttcatctgaacgaagaggtttgtgtttcataaagattaagctaactatgaggaaaaaacaggcaaccagactcttctgagattttctgtctgcatatagacatcaatataaacataggtatatgtttgttcagtatggcttttattattaacagaacaagagccagctccctgagagctacccaaggtcctaaaccacctctgatcaaagttatctcatatctagggtagcagaggactcctgatttttcagaggacctattcccgtcatatcttataaaatgtaatgattgacttcttacatacaagctgctaattttgatatggtctaagctgatatcagtttacgctgaggactttttcatatcccaacataacttgacctttcatcccatttgattgcatggtctgttcatgaccagccctgacctgtgataaccctcctttataatattctggtgttaaggatgcccaaccttgcgctaaagtaacctgatagacccagaaatgctgccagtacagctattttatcaggtgggatttagatatttatgcttctgtgatcatgtttatcaaaaattccaaaaacattttctcatgaggataacataagaaaggagggaaggggctgagcacggtggctcacgcctgtcatcccagcactttgggaggccaaggcgggcggatcacgaggtcaggagatcgagaccatcctggctaacatggtgaaaccccatctctactaaaaatacaaaaaataagccgggtgtggtggtggtcgcctgtagtcccagctactcgggaggctgaggcaggagaatggtgtgaacccgggaggcgtagcttgcagtgagccgagattgcaccactgcactccagcctgggtgacaaagcgagactgcgtctcaaaaaagaaaggagggaaaggagggaaggaaaagagggatgattgattttccctgccttactcacaggatcaaatatgataatgcagacaaaactgttgtgatgatatagagtatttttgtcatctaactcatctaactccatcaaataataggatagcttggttttgagaaaacaagtgacaaattatcatacttatttttctcatgaaatatccttcatgtgtgatctttatattctttggaaaatctaaaagacttacagttagtcaaagtaagcaccaacctaagttccaatctaatttcagaagtctgaatcattattttaattctttagggtactggaaggaatttaggttcaagatagctgtgaacaatgtgtttatatagtaaaacaagatttatttatttgttatcactaaattccatttaaattttacaatagctattattacaataacacactattaaattacaactgcatttatgtagatacaacattcctcaaaaatgttgtttggtatttaaagggcattattatgattatcagaaagaaattttgttaaattgcatttaagatatcttaaatgtttatctagttgattggttgatttattgacatgagtagaatattttaaattagtaggctacctagttaaattaatgaatttttatctttagtatcatgaatgaaaatgttgcacatgttgagaatgaatatgagacagtctttaagtcaagagcattacaatctgattgggaagattattctattgaatatcatttgtcagttactgtgaatagaatggtgaatgagacatttaatttgcatgtacttgtcatatctttcctactaggatataagcttcaagtttcagaagatgagaaatgtgtttaacatctccctctctctctttttgtacagctcttgattgtcacaaagtccgatgtgcttgtagttagcaaaaatagttggataagataaataaatgaatgaataaatacacaataacattttgtagagaggatgtaatagatcctaggaacttccatttaacctgtgaaatctctccacacatacagttcagaggcaaaatgttctggttttctaaatcctcgtgatcacatcactgttgtcagtttgccttaaagaaaaagttggaaaagctcatagaggctagttgcttttagctgtgaatctccaaatacttgaacatttcagaatgaagccaaacactgtttaaaatatcagcaagtggttatccatggatggtgggattcacggcttaatgtttgtttatgttttcatttatttattattcttttgcagaggggcacagatagatccattatttgtgacacatggtacaggcatttgaaaagattcattgatagcaacatcacagcaagtaatacagaagtccatattgtttttccatcaagagttatgctgaaactagcagagcttatgctatgaaaagccccctggtagagaacctcttcaccctaacagcctacatatgtgggaaagggaagcagggcatatctagatgagtatataattgggggagcatcttgagaaagacaatgatctttttcaaaagggccaagcctcgtgatctcagcctctggtatctgcctgttcttccaatgagttctctcaggtctgcagagctagctgcttgctcatttattgaaaaggactggaaggagcgtccagggccatctgcatttgtctctcctcacatgcatcttctaaattttccacaatcatcatgttcgtaataaaaacatataaggtgttttttgtttttacaaggtaaattaaattgtgtatgatattttttattctttaaatgtcgtacacaaatgcatcatcgcactttagccttaattggccaaccctgggtattatcctgactaacaatggaagaaattaaagaatcatgagtcttcaaagtcagcttttgaagccagcctcaacctacttaattacagttgtgcgtgtgtgtgcatgtacgttgcatattttttaatggaatcttcatactagtcatgagaatggatagtcttctatttttcttttaattttgcgtataaggagagatggagattatgatagaataaacaagttgctgaatgaaggacacacagttaagaagtgacttagtcttacctccagtgaaacctgtggaatatatatatatatatatggaatatatatacacatatatgtatactgaactttgcaacaatttacttgatttacatttggctcttttacaaaaagtcagagtgagaaagagaaaattccatagaattagaatattctaattctaatttatacaaactatcatgggtttatagcatctgaaggcacccatttgagtaggggggtgttacattgactaatattgacctatttctgagaagacatgaaagttaaagggtcaattgagtgttgttgttttcaagaccagtttagctcctcttttcattttatagtcacatttaggaattcatagcattcaaagccatgataaacagattatgcaaaagtaagtaagtggatagtgactatagttgcattttatgttaactgcatccttaaaataaacattagcatatcacagcttttctagagaataatttcagtgatttcaaattagcttgtttcagtaatttcacataatgcaacccacagagtgcagtgaaaagaacagagtgaggaccaccagacctcagcttaaaaacactcctcagctttttgttacaaaaagaggcaggtagtgtaattcttccttgtaatttctaccattcagtgcctatgtaataataaaatgagaaagaattgatagaatatgctaatccaaaaacataaaccattatctttataaggaaaattaaaatacagattagaaacaaaaaatatctctgaacaaagtcattaaaattaaaaactaatttaacaagggtttaaagatatgtaatgatatagtataaaagctaaattaaagtatctaaaagtaaacaagtgttgaaaagatctgtaactcacttattggaaatataaaactgcatcaaagcgaaaatagtgtaaatagctaatagaaaaaggaaaggtgcttaaagaaatgtaacctagaaacaaatgataaataaaatgacagcaaatatgcatcagaattaaaatacaaacaaaaatagttgaaattcgaaggtaactattttctgtactttccatctcttaacacattttcaccctctgtagggtcaaagacagaacagatataagaagagtgcgttaaaacaatttacctgttctcatagagacaggaaacagttattaaataactaaacatataaacataaaatatttgcattttatacttgttttatgtaacttaaactgtttcccatctgcctggcatggtggcgcacatctgtaattccagcactttgacaggccaagaagggcagatcatttgagcccaggagtttgagaccagcctggacaacatgacgaaaacccatctctaaaaatgcaaaaattagccgggtgaggtggcgcacacctgtgatcccagctacttggagggctgaggtgggaggattgcttgagcccaggaggtctaggctgcagtgagctgtgtttgcgtcactgcactccagtctgggtgacagaataagacgctctctctctctcctccctccccctatatatattccccatcctacctcttgctctagtcactgctgtagtgatcagtttttcccctagacagagcctccttttgtgctctgtaaatcctccaatgacccatttctgcctcctgccttggggtttctgtaaggctgtggcaagtaatgccagaaaaacctgacctgcgcatgtacaaccaaaaccagaagcacaagggagttaatgcctgtgaggctatccttgagcagtgggggttgggacctgatgtgaaaaatctgaaatatagtatatgcaggttcacagaagtcccattgggatcaagaacctcctgtagtgtcgactaacctgatcaaataacactattttggctttcttcccattcatttttgactccctcagctatcactcactttatagataaagttcagagttcaaacaagttatgtaacttactcaaggtcaccctatttgtaagaaacaacagcatctgtcctcaatgccttcctttagaactgaaggcacttaaaaatattttctacttttacctctttaaaaagaggtaggtttaaaaacctgccttctgttctttctccccattcagtgacttcaaggtatgcatgcccctgtctgatgtgaagatgtcactggcgactgcctattacataaaaccttctcaaatatgttcctataaaaaatattattccagagagcacatggttgatccaaacgggctaatctctaatgctggaattctaggtttctttgttcctgaaattggtcaagtcttttccccccaatatccataaccataatatgcagtttgtcactcagggaactccacacaggcacctatcacagtttcctggtaataaaaattaagaatatagttgctcccatcttgggttggtttcaagtacatcaatagaacaact

SEQ ID NO: 9 - DNA, 7581 bp, Homo sapiens
tgcactccagcctgggcgacagagcgagactccgtctcaaaaaaaaaaaaaataaaaataaccaactatcatataaattattcggccctttattgagtatattccatttatccagcagtgtgatttctggctgtctcagttattcagtatataggctcagatcagagtaagcagaagaggactttgaacatcagagagcagtcagaactggagaatctacttgcagatgagggatttattacaggtctagtgactcattgctgtttggtatctcatcctccaggggtcctccaggtggtctgggtttgttgtgggatggtgggttctgggcatcatactttctccatggctgctgattggcctcagagccagtgttccaaggaaactcaaaaaaaaactgcagggtctctgccgacctcacctctgacattccacatcactcctgctgcattctgttggggaagcatgtttcataaatagaaattggactctacttgtcaatggaaggagtaacaaagaatgtgcagtcatctctaactggtcacacagataatgcagaatttaatgttaatgcagtagaatataattattacatacgtgaaggtgcttttaatgtttctgagaacaagttaaagcatgttcaaagaactgtttcactaaaggaagcaggctatcacatatttttaaaagattttcattgaaaaatttaaaagtaatctttaaattctcagttatttattaccacgtacatatatatgtatgtgtatttatgtaaaaatatatatacatatgtgtgcatgtctatgtagatacacacacaaatatatatggtatatttatgcaaagatcccactgataaatacatgtatctattttatttattaaatttattatataactaaatttaaatttctaaaaatgtagtaaaatttttattattgaaggcccaaagtaactcaaactgttaacttttataatcgaatgcatatttttatcttgggattgtttaattttaaaactatttattcaaaaataaacatataaaaataatagtaaaactcacacattcatactgtttgtttctgctgtaaaacaaaattggaaacaacaggaaattgattgcctaaaggaaaacttaaattaaatataatagcttaactattatgtgagcagtaataaagttgaaaatgcatgccctttgttgtaggactttgagccaactgttattttcattgaataatttctgatttatttatctagtcaatccgaaatcagcagttatccttagaaatatgtcacatattctattatctccaagcatgaattatcagatcttagagaaatttccaaatagaaagctatatctatgaaagtcaaagtgaatcgttaatacaggcttccattgtctataaacaatgatcacttgagaattaactgttcattaacatgcttcatttttgaagccaacagtaaatattatttaacatgaaaataatttttcagttttacttttttggatcctagattcttgtctgatttttacttgtgaaacatatccctaacccagaaagtatcattctatgcatgtccaaatttactatgaggggtaaatgaattaaagtgctcccagagggattagaacctgagggcaatttcttcttctttttcttcttctatttttttttttttttttttttttgacaggtctcactctgtaacccagattggaatgcagtggtgcgatctcggcttactgcaatctccgcctcccaggctcaagtgattctcctgcctcagcctctcgagtaggtaggattataggcgtgtgccactactgcctggctaatttttatatttttagtagagatggggtttcaccatgttggccagcctggtcttgaactcctgacctcaaataatccacccgcctcggcctcccaaagtgttgggattactagcatgagccacgatgcccggcccccatttcttcttgtagaagaatagattacatcaacctgaaactgctttaagagtcaaaatgatgcagctattcttgcaatgttgggtgatcagggtgatgattgtaatttacttttgaattttcaaatgttttgttgacctaaactataagtaaagatgcactgctcagagaagccagtgaatatcagagtagaaacacaagcctgttatctcatgcccggaaaaaaagtaagaattaagtatgttaacttcttagactataacacacatttaatttctcactgagtattagttttccatggtgcatgtttttatgtaaggagaggaaaaatccattttcaaatccaagtcacatttctctcttagtaatcatattattaatatcagttaaggagtattttatttaaggcaacaagtgttaaaaaataaattcctaaaggtgtcatggctcaaacatgatagaaaattatttcttgctcatttacaaaactggtactttcggttggtaactcttttcaaagcaataattcaaagactctagctcatttccccaatgtctatggaatcctcatcattggcttctaggatcaccatgcttatctgtactagactgaagaaatatggagaattgtgcctggaaagttttcaagggtcagtcctggaataaatgcatttatttaaaactcagtcacatgaccatacctatctgccaaggttccagaaaatataatcctgatccatgactaggaagaagataaaataagtttgatgaatagttacccagtctccaccatagcagaagaagcccattctatttgagattcagagatcggcaaaataaactcagtaggcaagaggcatagagaaggttggaagtcctatagcagcttaattaaagcgccctggccgggcgcggtggctcacgcctgtaatcccagcactttgggaggctgaggaaagcagattaggaggtcaggagatcgagaccatcctggctaacacggtgaaaccccgtctctactaaaaataccaaaaatgagctgggcgtggtggcaggcgcctgtagtcccagctactcgggaggctgaggcaggagaatggcgtgaacccggcaggtggaggttgcagtgagccaagatcgtgccactgcactccagcctgggcgacagagcaagactccgtctcaaaaaaaaaaaaaaaaagcatccaatcagtctccaacactcaagaattatttgtgagattcttatagaactaaaatctgtcactagctagttctcctgtcttctttcatggcacctgagagtttgaaaaataaaaggttatgaattgtatgcatgccattttttttttctgtattgtatgcatgaaaccatcaaagatggaattctttctacctgtagatatccatttctcctccaagagatctcaggtcccatgacaatgtcaccacttctgctcctcctctgcaagtgtaatgaagagggtatttcagtggaagcaatgtattactttccctctcttggattatgacttgaaagaataacattcacacatttgtgaacctgttcatgccccacttcagttatcagtattattcctcattgcttccctgcacatgtaggttaatatcctcactcaccttttctattcttgcaccccttccatgcaggcaaaatgttatacagttttcaaccctcattgatcacatcccaaactccctccactttgatcacttgtagtagagtcagtgtctctcacccataagactttgagttctcattaaactgtgaagtcagagcttattacatttttatctttgcatccctagtacctagcaaaatgtctgccagtggccaaatgctcagaaattactggtaaatgatttgaagatttccactgactatgctggtctaccctgttctgaacttcacatcaaaacctatatgttgagagttttcattatgacaaaaatatactgtggtcaacatcttgaatgtagtgttagttatgatgatatataccgtttctaaaatttctccatatgcacattgaaaatgaatacattttattacatgtaaattcttaagagatgtaattttaaaaaagagctactgaaatgctaaacaagacagaaaaatgtccctcgagattcttgctattgagctgacgaccaaattcaggcacttgcagagtagttgaccttctcttaagaaggagccctcctctgtgccctcactataagaaggagcctcccaacattagattttctcttgaagagccctttggactgttgttctgtctgagagctactggagaatctctttgatagctttgcttttgacggttttctctggagaaaggtctaatagaagcaaacagttaaaacccttttccatccttcacgttttttaaaaaaagtctcccttttaatatgattttctaactctgtagcttctttgtgtcattttgttcctacaagtgttcatatatacttttaggtcacatgcatttccacacacaatctgaatgtttcctacaccatagagaaggtgttagagactggatacttatacaatgttatttaggggtcggggaagagggagactctattccttaaaacaaggaacacaaaattaaaaatataaaacatgatataaaagtaaatattggccagggcgcggtgacccactcttgtaatcccagcactttgggaggctgaggtgggcagatcacctaaggctgggagtttgagaccagcctgaccaacatggagaaaccctgtctctactaaaaatacaaaattagccaggtgtggtggcacatgcctgtaatcccagctactcgggaggatgaggcaggagaattccttgaacctgggaggcggaggttgtggtgagccgagatcacaccattgcactccagcctgggcaacacgagtgaaactccgtctaaaaaaaaaaaaaaaagtaaaaacaatgtaaatatttatctatagtgagacaagtaatcaaaaccaaaatatggaggcttggagatataggtccctttcttccaggagctctcggtaatttactagaaatgcttccacagaaatacttttgatttaaagatagatttttctttcacccagaactttctctaagttctaccaaattatctcaatttgattgtaatttaaatggaaaacataaaactacaaacttttagaatataacatcgaggcacatttttgagccccagggcctgctgacatgttcttagacatgataccgaaagcataatccataaaggaaaaaaaaaacagaattaattggactttatcaaaactaaaaatatttcatctacgaaagtaaaaaatgtatgtatgcacaacaatctgtacatgattgttcacagcatttctatttttaacggccctaaactggaaaaactaaaatactcctcaataagtgaatagttaaacaggttgtggtacatctatatcatgaaatactgctcagcaaaaacaaaagaagacctaacaacaagaagaacaacaaaagtgttgttagatgcaccaacttggatggatctcaagggcagtatgctgagtgaaaaaagccaatctcataaggtcacaaccttcttgaaataaagacaatacagggattggaaacagattagtggtggtcatgggttaaccatggctgtagtgcagggagaggatgggtctgagatggaacagttttgcatttagattgtggtagtgcctataccttacacatgtgattaactgatataaactatatacatatattgtatcaatgtcaatttcctggtttaaatagtgtgctatagttacgttaaatgaattcatggcagaaacttgatgaaaagtacccaggacccccctgtctttgcaccttctagtgaattcataattatttcaaaataaaaaatttaaagcttaaatgttagcacttacacaagtggattactttattacttctgggatatgtacaaatttgggtcctcttagtgtctccatgattttacatgaggttgttctaacataaaaaaaaaaaaacaaactacgtaaagagtgtttttaaaagtgagaagaaactactgctagtttgagaaagggctagatcctaatcagtaaatagaaaatcagttaacattcaaatcatgtttaattattttatcttggaatgcacacgattactgttttattttttactttttagagacagcgtctagctctgtcacccaggctggagcacagtggcatgaacacagctcactgcaacctcctcatcccaggctcatgtgatactccaacctcagcctcctgagtggctgggaccactggaatatggcacatacctggcttttttgtttgtttgttttaatttttcttgtagagatgaggtctcattatgttgcccaggctggtctcaaactcctgggttcaagcggttctcctgctttccagcctcccaaagtgctgggattacaggtgttagccaccacacccagcctatgattatgattttattcattagtctatgtaccaatatttaaaagaagaatttgtatcttgcatgtgtgcacaattataccttacacataaatgagtttgaaatggtaaaacggcaaacctctagactatgacagccaaagacaggtatttgatccttgaaaatagaaaataatataggcaatgacttttgcaaaatagtgagatatttccaggtaacatttattctgaaggatttgctttcctatcactgcaaagatggccttttcaaccctctcaccatcatctcatttgctgagatgagagagaggagagaggggacaaatggatatacagatatatgggggctgggggagacagagagaaactgtgttttctggggcaggcataggtaacatttacagatacctgtccaaagtacacacatatatttctatagtcctagcattgcacacgtattactctaaaatgctggcattttctgtcaatctgcttggtagcaaatgctgaggaacaaaccaatcactggatctaggagccaagaactaacagagactctgtgctttatgtgtgagcatttaactactgtagatggagacctgcacgtatttaaattgaatatcagtcctgtgtaaagagtgattattctgatgcttctccgcatcagatataaagttatatggagtccaaagaccatcaatagaggattactcgtagcccatctaattttggaaaacaatagaggagttttctggtgtgaggtgaacagcctgctgttttctttgcctggaatgcattttcctcctcttccatgcttcacctccactccccttacctagttaatacccactcatggctcaacatttgctcagctggtgtttacctacgaagccttcttattccttagatgaaaataattaccccatgttccactgcccagtcagagttaaacagaacttctttttttttatttttctttttaagaatatagagtctttaatgtggtcagaattaagttgctatcagtttaaaatagcctgttacaagtgtattttatataagcctcatagtaacca

SEQ ID NO: 10 - DNA, 14061 bp, Homo sapiens
gtgctaagtgcattacctacattattgtttcttaatcctcatggacatggctaataaatgacagggctctaattcaaaaccaggtctttctgacatcaatgcctgtccttgtaaactacactgtatatgaatttggctcagacacatatctcacattttgccctagtgaaacaaagtgtattttctccttttgaccttgggtgaagagagttgaatacaagtctttccatttgtaacacactgtcatcagtagcacaaggcctccctggttttatttatttttcccttcatccctaattatatcttcaatggcctttccctagagatacccattacaatagcttttatatatatctttaaaaatgcatatacccttgtaagatatgtaacatgcttttcttgttatttatttaaaatttattttactggcagcatgctgtatatcttaatgcatttttttaccttttccattcaacactgtttataagatctttcatgttgctatgttttcatttagttggttttctgtaactgctgcatagcatttctctgtatgcatccaccacatctttgcatctgttcctctagtgctaaaactctgcttcaattccacaattaccaatagtgtggtgtgtggccctgagcaaaaattgcttggggatatattcccaaaagtggtgttcctgagttatagggcaaataatgcttaatcacaccaaatactttcagattgctttccagaagggctgtaccagttcagattaccaccagccatgcacaagaaaaatttctaaactgtctctattcttgacaatacttggcattatcacctttgtactcattgccatttgacacgtataaaattgtatttcataagtaaagttcttctgcaagtttggaaaaagttgatttggacttgaacatgccactaaggctgcttaaaatgtcttagatgggatgctgattgagtgaatgcagaggcagaggaggagcaggctctcatttgagccctccttgcaattggtttatgtgtctcttatgacaactaacattgttttgcaatatgcagtgattatttgtgtacttgtctgcagcgagcaccttttggattgtaaattgcatctttcttccttacctgtgtatgccctcaatgctttgcttgttgcaagactccagtaagtgttttctgaaataaattgtctgatctctcgaaggtcctgcctgacaataaggggccattggctatgaaagggtggtaggatctaggagtggaaagtcacagatgattattttctattctaatagggtgatcggtttatttttttcttttcttgactgttttcctccctactttaaccagaggtgcttgcattaggatagatgaactatatgaaactgctctggtaaaaccaaacttttgaacatactggatttttccccctaaattgacaactaaaaatcatgccatgctattgactcattgtcctcttcagtaatcttctggttgggattgggaagggaaatttccagaactacaaacacttctcttagggactcaggtcccaaccttgctgggcagagtgcatgatgtgtttcataatgcatgagtgtttatttaacaaacagcaacactttttaattaaactgttgttgaagatacagactgtataacctttctccaaggcctggatgctcactggcccttccaagatgctgacccctcgctagctgcaggcctctggggcagtacatgctgtgagagttattacaagccagctggattagagggccacctctcttgaatcattcagaagctgaagtgcaggctctgggatggagagtttctcaatatgccaaagctattggaatgcaggcaggtctggagacacttagctggaacctgggggaaaagagtgttcaagataacttcatagaggaaattccctaccgcttttggctttaaaggataatcattggttcttgctggtcttgtactactatttcctgagctactctgaaatagaattgcttttaggtttcaggtcttcatttatagagctatatccctaaaagattagatacgtctcagggatgtttttcaggatgctttttcgcatcatggtgattgtattagtcaggttagacttgattatgctgcagtaatacattacttcccaaattttagtgacttagaacagcatagctttacttcttattcatattacatgtttaacactgggtaacagtggggctatgcttatcttggacgttcagggacctatacgctcagaagcttggctgctttttgatgtgaccatctcgacatgagtctttagggttttctacagcagagaaagaacaagaaataaattgtctcttaaatgttcttaccattttcattggccaaagcaggtcacatgatcatgcttacctataactttgtagagaactgtaatttttctgtcttctcagagagaaaagaggactggaaatgacagagaatatgaataacatataccacagtttcattgggcatgagaaaatggtgatactttgatagatctcagaaaattacatacactcagcaccatatacatgcccttgaagagaagagaccatagactcttaaaaatgtaagtatctcagaggagattttggccagtgaatccaaattatacagcttggaagtctacaggtttatgccataggggacacagaggggaaaatgaggaactaagatgggaatcttgcccacacatctccttcaaacagggcagtataggaaagcatatacttccaaaatgatatgattttcagtcctactctacctcgaacactcttcctggaacatactccaatttgtcatcggctcctcttaaattcagcactcagtcatgaaaatgttctttcatacctggtctcatcagtgtagaggccagaagacctgttggttttccttgctttggatttgttattttggcaattaacgtttctgacaatcatactatacctttgactcattataagcctcatgtgggtttctctactccaaggaggcataggagtttaaaataggaaaacagtagtacgttgtgatggattgtatttttcaaagaaagtcacaataatatttcccatcccatgcactcttctgcaatgtatccttgacattctgtcatcaagattaagaggtagactctctctctaccctcttgaatgtggataggccctatgatggcttcgatcaataaaatatggtggtttaacgctgaggcaggtggggcacgatgtctcacgcctgtaatcccagcactttgggaggccgaggtgggtggatcatgaggtcaggagattgagaacatcctggccaacatgatgaaacccagtctttactaaaaatacaaaaattagtcaggtgtggtggcacacccctgtagtcccggctactcaggaggctgaggcagaggaatcgcttgaacccagaaggcggaggtttcagtgacccaagatcgcgccactgcactccagcctggtgacagagtgagacttatatctcaaaaaaaaaaaaaaaaaaaaaaaaagtgctgaggcagtgaggcagctctggaaatagcccttaactggcttggcagcttctgttttctgactcttagaagccagttgccatgtaagtaatgtgactaccaaaaaatgaccacactgtgagaagcccaagtgtggtggagaggccttggggaaagagataacccatgaggcaagaaagaggcccaggaggtcccaggcatgggaatgaagaaaccagcttgcacatcctgcccaggctacaatggactgtaaccacatgagaggttccaagattaaaccactcaattgaccccagccaactcatagcaccatgagaaataacattgttttaagccactatattttggaatagttttcttaaaaatataaagtgatagataaccataatagaaatttgtgctagaggaaaatccttaagactcttgaaagccattttgtctaacaaagagtgtaaataagatatggccttaacgatcctaagtaatttttctagttaagaaataactgtaatcagttgagtgtttttccactttatgtgacttcagttgaggctgcaatcatttggtgtctggatgagatgggacatccaaggtacctcattcacataaatagctggcagttgatgagataactcagccagagagaacctatgcatgatctctccatgtgaccaaggcttctcacaggatggcaactgggttccaagaagggctatctgaagaaaaactattcttagaaaaccaggcagaaaaaataaaatttcttatgacctagcttcaggagtcattcattgtcacttttgctatattttgttgatcaaaagcaaggcaaagggctctccaatattcatcgattaggggactacacaaagggaaatattaggagtcatggtttattggggggctatctttggagacaagctaccttgatggatagagaaatgataacggaaataggtttgatgaaaaacgtggttaatctgaattgcagtaggtctgatggttggttggcaagttgtccttattctggtgtatgggtgaagggaataagcagtgagttagctcttacctagatccatcccctagaaagtaactgtgtccagttatcaatgggcagggcttgctgggcgttaagcacaggtaacctctagtcttttactatgtttctgcgacagtggcataaaacagctttttaatgagacctactgagatgcactgacagatctcttcctttccttttgtgtctagcccatccaccttcatgtaaatgatttatcaagaaataagacctaggattttgagatgggtacataagagcaaaagagaactaggatgagatcattctcttttgcctgcccttcagcattctcaatgcaagcaggttggggttctaaaggaagagcagggatgactggaaccctatagcagtgagtctgaggaatgggatcatgggggacccagaaggaggaagcagaactggaagatgtttccattctgtgaaagtggcttttggctttgaggcagcaacagtaatatttcatgtcttccgtggtgtctcctacctttaaatgtcagtctctgcagctgccttatctcctgtagcacatttcaattaggtattccaaattatactcttttcttccaggacaaatatgccagaggtgatatttactgttacagcagcatttaaaatacttagggggaaaaaatcctagtgaatagcaatttctcccttataataataataaagcacaataataatggagagaggaggtgaattctggctttgatgccaataactggctgacttaaagtgaacatcttttgtctccgccctcttttgtccccctcctcctattcccgcctcagtgtgaaggttatagtgtttggctctgtcaagagcaacctcacacatcttcttcactggaggctcacaaatgctcctcagaatgtctatttaactatctctaggtaggactgggctctgactgggctcctacttcacccattacctgtttcttcctttgtcctgagaatgtttgcatgaagccagaatctctgtttgtttagaaatttaccaggcaccactgcttactcctcacctatgggacattgtaggtcctgatggaacaccccggcctcctctctaggaggtatatgggttagaaacttatgtattgtacctttccttcttggaatcaagtccttggcctggtaatgaaggtccttcgatctggtctgcattttccagctccatctcctactaatctttatatccttatctactgtttccctaggctgttgtcttcacggccgccatggtaggttttgcctatcatcccaaaccttgtgcaggcctaccacagtacttgacatatggtgggggtctcagtcagtattctcccctatatttagaacccttccactagatcttgtcttcatatttttgattcctgctcagggatcagattatgttccatgtcctccactgagccttttctgacctcctcagcgcactcagtgccgttccctctctgaatttctaaagtgctcagcagcagcagcactcatttggcacttggtatatactatcttatgctattttgtatgaccatatgttgtctatacaactacattataagcacctgatagggataactgtgccctgtgtgtttttcctatccctttgattctaagatagttccttgaacattgaagatgctcagttaatattcatttattaagtagatagatcaaggagtaaatgaaagcaaggatcctaagaagcctgccttttggtgccaatctattcaatttggaattcacaaacttacctaaaacaaggcctttcaatttcctgtttcccctgtaaacagagctctaccaccaggatttctcagaagctctttctccacactgaaccctaaaactgaaggttcaggtagagagcttttccagtgtgagagaatttttaaagcatctggggtttggcacatccagtgctttgaaaatcaaggtgtcttgatcattgggtgaaggggattagaacagcaggctgtgttttcaagttcaagtccataagcagacaggaatagaatcccacaagagtttgttctgtctctgccatttactagttaatctctctatgcctcaatttccccatttgtaaaatggatttaataatggctgtctaccttataaggttgctatgaggtgccagtgtgataataaacgtaaaagtactttgaatattgcaaaacactgtatgaatgtcaggaattaggcaggcaacaactatttcttgggggtttgttctgcatgtagccctgcactatgtgtagatagaggcctctgtacattacagaagactggcagaggcattggggattcatcatggctggaattctggttctcagatagatgaaagctggaaaaagtattatagcctagcaatcacatctgaaaggttggcagcaacaattgagtcagagaagacgggaggtgaagtattggcaaaaatttgaccctggtcattctttgaacacttcagatttccacagattctatccctttaacatttctgaacgttatgattttgcttcctccccacactggcagctctgcctcaatgaaaccgtgttgcttttttggttgatcaattgtgcccaacttcctgatcatacttgtcctgagagcctgtgttaagctcatgccggctctcccaccccgcccccaacgccggccaaaaaaaagactctctaaaaacaggtgcccccgatgatctcacactgctgctggcattggcagcagcccagaagggccaaatggtgacttcaggtccagggaggctactgtcctcagctctgttttcatgtaaatgtcgctcctgctgaaaggaagtggatgcaaaaaaatatctgctatggaagcagaactaccccagactaaaatgttggtttttttttttttctctcccccttttcttttccttcaagttttccatgtggcatcagcagctgagtaagggaaagctaagaggtttaagtgtgctggggctgggtgggctagattaataacccaaagccttccaagctggcggtgctgggtgagacaggccaaccagaaagcgttaggttatggggagccctggccacagagccagaccctaccagggtggaaggtgaaggagcagcgagctctgcgtgcttgccccgagcccccaccttccttccttcctcctccctctggtttctttcctcccattttatcgagtccctctgagatggctgcgcaccagtggctccagcctctgaccgttgctgccctctgctgggaagaaagctttactcggtgtggaaagtgctaagctctaccagggaccagcttaatgcagaccaagtccacagtctgtggctagtgtgtgatttggcccagaggaaggaaggacaattcagaaaacccttgcaccacagtgtttccctagtggtttcaggtgggggcaggactttggaatctattagggaaggattgcttgaatcctcagagttctctgttcaagaggaacatccctgggagaggagcctcctggctcctctttacctgggtcagacatgatgtatggagactccaccatggatgacccttaaatatgatggatggctttagttacaggacacaattctttctcaagggaaggtgaccaaaagaagttgggtcttgaaggggctgcaggatgggcctggaagtctcttggctctaaaggaaccatcatagaatggggattctgagcaaccaggaagcagcagaaaaatatgcaaagccagatgggagtggggaatattgcccattaatgggcaagagtacatagaaaggtagataataaactggcttcaccacttctcaactttccccagagctggctgtgccagtaaactgtgctcagctggctttggatgagagaaggacaagagggtgcctatctccagcatggctgtggggtcgccctgctccatctctggatcttcagcctagagtgcagcccagccaaacaagagcgatgacctcactgaccacatgtaattctgcttgagggatttattttcttccatgagctcctgccaagactcttggttaaagctaatggggctcccccagccagtgagtgtctcctagttatatgtgtaaacaacgccaggcaggaaataggtttcctgttcttaatgggcttgttaaacctcttatcgagtggggtttaaatggctttattatgaataataataatagtaaataaacattattattattagtagtagaaaaattatgatgtcagccctgactaccccttctcattttaatcttgccaacgtggaggtctttggcctctaagtgcacaggaatatggtgagtgacactgggacttataactggagaagatggcagaattcatcttcgttgcctgcagctttccaatcctgagcccttttccactttcatcgtgtttccatctccatcattcctttcattcagggttttcatgatcttattctatcagagaagatagaactacacatccctctccttctcagttttatttagcattgaaagccatggacagaggttctgaggttaaattgaggtatcgggtagaggggattttggagagagcagtggatgctggtaggggagctcagttggaagtggggctcatgttctgatcttcagtgccgaatgtctgtgtccctccctcagatttacatgttgaaacgtaatcaccaatgtgatggtattaggaggggggccttttgggaggttagtaagtcatgagtgctttgggattagtgctcttataaaataggcccaagggagcttgttcaccccttccaccatggaaagacagaagaagaactagaagccaccatctatgaaccaggaggtagccctcacctgatgccaaatcttccagcaccttaatcttggacttccaagcccccagaattgtcagatacaaatttttgttgtttataagctacccagtttatggcattttgttgtagccacctgaacagattgagatatccagtttatagctggaactggaggtataccaggtatcccagactttggtaatttatgtatcaggttcactattttcaccataactccctacaacagtattgattttctttacaccgattatcttgtttgacttaagtagatttggcatcatcttacaagcaatatgtctttgaaatcctgggttcaatgtgttagccaggttttttactgactgcatattgaaatgaatatctaagagctaaatattttttcctaaagttcatcatgtggcaaatgtgtcacaccctccagggaaaacataccacaacatctggagacactgctatagggtagtggttcttaaactttagtgggcatgagaaacactggcagagcttctaccagaaacactggtagatagctgtgctcttccccagagaatctgattcagcaggtctgtggtgggaaatatgactttgcaggttttttttttttttttttttttttgagacagggtctcattctgtcacccaggctggagtgcagtggcgcggtcttggctcactgccagctctgcctcccaggttcacaccattcttctgcctcagcctcctgagtagctgggactacaggcgccagccaccacgcctggctaattttttgtatttttagtagagatggggtttcaccgtgttagccaggatggtctcgatctcctgatctcaggtgatcttcccgcctcggcctcccaaagtgctgggattgcaggcatgagccactgtgcccggccttttctttattttttgagacagagtctcattctgtcacccaggctggagtgcagcagcgtggtctcggctcactgcaagctccgcctcccgggttcacgccattctcctgcctcagccttctgagtagctgggactacaggtgcccactaccacgcccagctaattttttgtatttttagtagagacggggtttcaccatgttagcaagggtggtctcaatctcctgacctcgtgatccacccatctcggcctcccaaagtgctgggattacaggggtgagccaccgcgtccggccgccttttatttttttttgagatggagtctccctctgtcacccaggctggagtgcagtggcacaatctcagctcactgcaacctccaccttctgggttcaagcaattctgcttcagccttcaagtagctgagactacaggcacccgcccccacacccagctaatttttgtatttttagtagagatggggtttgaccatgctggccaggctggtctcaaactcctgatctcaagtgatctacccgcctcggcctcccaaagtgtccagaactcctagactcaagcgatcctcctgcctcagcctcctgagtagctgcgactacgggcttgcacccggaaactgcagttctaacagttgctcaagagatgttgatatccaggggccacactggcagtggcactggcctggagaataagggcctgttctccatttccacatgtgaaaatttcctcatttgaaaatggggataatgtgtgctgtataaaatgaaataattttttcttggtgccaatctgtctatgcaatggaatgtttgtgtctccccaaaattcacatgtggaagccctaactgccaatgtgatattaggagatagagcctttgggaggtaattagatcataagggtgaggtccttagaatgaaatccatgcccttagaaaaaggaccccagagagttccctcaccctctttctgccatgtcaggatacaatgagaagtaagaagtctgcagtacagaagagggctatcaccagaagctgaccatgctggcaccataatcttagacttccagaatgcagtactgtgagaaataaatttctattgtttataagccacccagtctatggtacttagttatagaagcccagatggagtaagccaacctgtttggagtgtttttgagctgtcatgcttttcaggttcagcttaaagctcagatgggaaatacaggaacttctgcaggttaattctggttctaagttcaagtcctaagaataagcccattatgcaattctgggtggccaagcagttctccagcagcccccaggaagtattctatctcacagaatcctggcaaaaggagacagtcttctcagtctggtcaagggctatgttgagtgtgagggaacagaggtgaatgtcccttgctgtgctcaccatgttctgagagacaggcagacaaagcgtaatttacaatttgattaagtgattgcattggtgactttttaaagccgcccagtagttgagccccctttctgcatttggaagtttacccgtatgagtctaaaagggagacagggccctcattccatgactgaggcccccaaagtctagtctcactttcctcagtctcagtgagccacagaagccaggctcagtgtctgggaggagaaatcctctctgatggtggcaggggtggggacagcagccccgctgggccctgtggggacagtcccagcagcagacagtcccagttgggcttatcctgtgatgttggcctcactgtcttggcagcctctggcatttctgttctctgttcatcttccacatatggttctcaggttcactcatcaaatcccttcccatttcacccaatcaataatgctgaactaataatggtttttagagcagggaagtggcacaatcacaacttattttaaagataactgaccactctctggagcatggattggaggatgagtgactcaaggtggggtgactagtgaggaggtgatgaaggagatgagaggaaagaggaagaaacactcacagagtaaacctggccatatctaatgactggaagcctgagtttctcttcaaactcagaagagaaaaatgaatttatggttttgggcgcagctttagttttgtctttggggatgagtatgtattttgttgggaaggtggatgccctgaagcagggttgggaaacaagattagaggtttttgaataagactgtgtttgaatacagcttggctatggtcttctccatttcaagtctgttcaacttaacaaatattgagcccttactaggtgtcagacattcttgggtatttagaatacagtatattttgattttggtgttgaaaaaggtgtggaggtatgcagggaaaaatctcacatgcttttacctacacacacacacattcacgcaacacaaagtgcacgcacatattggtcttgaaattccccaaggaccaaaatggacccatgtgatgagtctgtgttataacagggaatctaccgtaggttcttggctaccttttgtgaaccttctgtcttctttcctctcacttacaagtaatcccctgagtttttacctcctgaaccctgtgatttcaagggttcacaactaaatgcttcttatgctgagcaaatgtatacactgctaaaaccatatactcactccttgtggtgtgtttgttaggaagctgccacttctgtcttctccattctttggaaaaggctgtgagtaaacacagagcactggctatttacatacctagctcctgcttgctttttcaaagctctttgttcaagtgtcagtgctggtttgtaaaacatgaacagagttggggtaaaaaaagtaattacagttcaaatctggtgtttctactgacatgatactgagctgcctgactgctcttctttcttatcccttctctagttctgtcttttcagttgcaagttcactctgtctctgtctcccctctctctcccttgctctcactctcattctcttgcttgctcttctgtgtgtcagaaagctacacacatgaaaggtagctggcctcatagccactgggtagcccatccttgagagcctggccaccttcagtgtgtcgagatgccagggccctctatggctttttgcacagggaagttctagtgttttcagtttccagagcccacaatgagctgtcctccaaatccagatctaaaaccaaaccttctcttggatcagaccaatccagaagcactctatagtttcaggggtgtccaatcttttgacttccctgggccacagtggaagaagaagaattgtcttaggccacacatataatacactaacactgagatatagagtaagctcagttgttgacatagcaagtttgaaattacagcagaacttccagaaaacatcacaccagagttttctatccttccaactatattttacattttttgctttcagaggctatgcttcttcttctttgttcttctcttaattcagcccatgagcacatggtagattatgaatggatgctttaggaaccatgtagatggaggtttgtgaaaatttccacggaacatggcagttgagaattggtgactgatat

SEQ ID NO: 11 - DNA, 6323 bp, Homo sapiens
aacctgcacatcctgcacgtgtaccccagaacttaaaaaataaaaaacataaaaaactataatctgaaggaaaattaactgggtttgagttttatttgtatttttttgtttcaaagttttattataatgatagaaatggtcacaaatgaaataattcatttcttcaggtaaagagtatcctcttttgaaaggcaaatcttcctgcttctagaggaattcatcttagtgaggatttatgcaattagatgacacttcttcctggtaattactttatgtggaagtaaggagggccatctttatggtggtgggaaagggcaggtacattgcagaggtatagaagtttgaagttcattttttttttattacgtttttattttttcatttgcacataacttattgtttaggaaatttcactagaaagatctctgtcatggaatatctgcctagggagtatagagaaaagtatgagaatcatgggaacactgtttaatctggagatctccagcctggacatgagccattatacaactcaagcttttatgcttatctgatgagttatatttatatctcagcttcacttctaaactttgaaattactttactacataatttttgtagtccattgtagttcattttgaaatttcatccctaatgtcttttccagttctgcaattctgtgatctgtcatcttctgaactgggtattacatgttctctctcacacacacctatgagatgatatttccagatgtttatctcttaagaatgcactagccaacaagctttaaatgatagacagggatggttcaagtacaaaaagcagtttgttaagtattagattaataaaagcgtttatacaagttaattttttaaaaaaaacagatgaataagtcaatcaaaatctcaaaaataatgattgaatcagtgcaacttctctttctcaatttattaatgaaatatatgcagacttcaacatgcatcatgcaaaaatttactgagatggataatacagacatattgaaatggataatatcaatgtaaatttctgctaattcaacttttcttttgaaaaaaaaaagaaaacaattttattgctctgatgagtagattcaattaaatcaaatgtccccatgggtgtctttgaacggtagtgatacctaaactggaaaggaaacgtaccttttgaacaatatccaggaaatgaatatgtgtctgtgatgatttttaggacaaaatagaaaatatacaacaaaaacttacacacaaaatattggctttttttttttaggaaaacaaatcaattataatttctggaaactaatcaaataaaggagctcactccctttagagtataatgagcttcatttgtcttttgtccccaaaattctaattagattgtcttccattttctctcttcccttctctccccttttctctcaggcagacacaatctcgatacccagggtattttaggtgtgagctgacttaaatctttgtatttcaaactgcttaatcaagcataaatggacacagagtgtttcattctcttttaagaatgtattatctcagcccagatgaaatgactggctctttcattctatacctctgtcccccttcttgctctacctaatttccaaaatagattgtggttcttcaaaacaacttgctgcaaagcacataaaaaaaaacaaagagctttgttaatgttatctttatattatcagaagcaataatgtttccattatttatgacataccccaccacacagaaaatcaatgttaataaccaaggaacacaaagaaaatcccttattgcttcgtgttcacacagaagttctaagacagaaacaggctcaagttgttccttagatctccatacttcttagaatcccttgacaacattcttgtaagtcattttgacattcaaaaggagatacatcaaaaaggttctattttcaaaatcattttcctttttcttttactgacagtctaacaacacctatcacttcctacttacctctcactctcttcatgtgttgtcctccaaatctgtggataaatcatgtgacatattcaacgacataaaaaggaaaagagtcaagtattcaaacagaaagggttgactgagcaggtggcctaaaatcaatcctaaaatctacactctagagagtaaaattatattggagtctgatgtgatatgaatatcaaaatgtagtaaccaaggaccttggattcaggacaatttagttcacattccatgctatcctttccttgatgtgtgatattcagcaaattaccaagattccctgagctgtcttctctataaataagggctaccagtacctcctttaaaaagttactgtaaaataaacatgtaccattaatgtaagcatatagtagacacctaataaatggcagcaaatatgattgttagtattaaagttggcagtttagagaaaggagaggtcatatagcttttagacatactggtacacggtaactccttgaagaataaataggatttacagagtagaatgaggagggcatttctatcaattggtgcacttaggaaattctaatcatctatttctaataccatacccattatgagaaggcacttgaaaggtgttatgatagtcaccctatttgcagcccactacctagtatcaccgaaattcattttaaagtattattctttgtttaacagccaagaaatgaaatgggaaaatgatttcaatagttgtactttgtatgtattcatatttatgatggaattacaaagagaagtagaaagtcttgtccaaagagaaatcattttttaaaatgctgatcctcaagaacacttgtgataaaggcagataattttccttgcccattacaccactagaaagtgtgaatagttcatttgagcctgtaagattgcttccttttatccctgacacagtatcattcaattatgttcctaagtctgttgcattaattatatcataagacttaatatattagcttatcaagaacttctcaatttaggtaatgagagcttccctgagaaaaaatactcaaactgaaaactagtaaatctactcatactcctctctcttttctagaaaaggtcatgggtcatcttcagaagagtccctaaaataagtgatgagccaaaattcatataaatttctttcagtcaaaacataattacaccgataatctactgaaaataaagaactttattttctaaaatgtgttatatttgctatatcttatgtgactcagggcaaatctctgaacttctctgaagcttaacctgttctcttgtttgtcagagtgggatgagagtaactgtcctgcttctcccataaagtctcaatgaggacaaaaataaataatagatgcgtaaatgctttgaaactatatatctctatgcagatattattattaaaatcaatattaaatggatacgtaagccaaagcaagcaagattaaatgaggtcacgggaatttttttaaggacaagtaaaaaagagacctttaaaaatagcaacataacatgtattcaataaatatttattgaataaaagaatgaatgaattttagtatataaataaaacatatttgagtaaaaatatcacacatataggtttttcagtcacctataaggttcctaatagtgaagtttaaattgaacattgtcttgataattttatttaaaataataaacagaatattcatcgttgagctcacaatataatattttatactgtagataccagaacctctataactacttgtgaaaagaatactgaataagtgtatgaacaaattcgtcactcaaaacaacttctaatgtaggaaaagaaatttcaaacctatttatttttagcagccacattaatagtgaattattataaacacaccatttaaaatgcatcaaaaactttctagttggtaaatattaaaaatcagtgtacatgatgctaaatggtgggcacaatctttcaaaatggaatatgaatctcctcccagaatattaaaacatgttttttcgatattattgtttgaattatatatttgcattaactcttcctagaagcaatatatgcctatggctgaaattcagttcatttatgcaatctcaggtaatctcctggagaatgacatcaagtataacctctgttttgacacaaataaaaatataaccaagtcttcctagttttttcaagctaatttttccaagagtgtaaagaaagattcattcattaaaataagtagacaaaattgcttttccataaaaataacatactatttaataatgttataatatttagttgatactaacaataattaattaatacaaataataatttgtaatatttgtatttgcaaattgctccatcatacatcaacatctcattcaagtcacatcaaggttatatatgtggtacaggtattatgtccagttactcatccataagtgtgaggtaacatctgtgctatttaatatgctaagcctcagtttattcatgtaaaaaccaagctgaggttaattatgaatagcattggagatagatgtacatgaacacatattttaaacactttcattaaatttaaccatggaaaatataatgttcgtgagaaattatatgtgttaatacaataacagtctgaatatttcctagtgatgggtcacatgatcagaaaatcaaaggtgcataagtcaaattgggtatttatttttttatttcatagaattggagagtttagacccttagcttaattataggttttcactgtatacaaaagtgatccaaaaaccagattaatatgttatttttactacataaacaagagatccaagcacagtgcttatcattgatcaattttgtaaatcaatgagaatgtggatagttaagggtctggagaattgttgagaacaaagagtgagtatgatatctttattcttactccttggcttcactttacacctctgttgatcactgtttccatttaagcagttggcctgaaaacagaacctactttcatggtgacagttacaaactccacagttttactctctggccagagaaatctggatagatcttagatttctataactgacctcaggagtccaagaattctctgtttcttagtcaatatagttcactttgcagcttagtctttatttttttttcaatattttaacaatatatcttgcatctgagtcatgcggattgagcaaaaacttccataactggagcaatccgaatatagtattttgagagcagaaacagagattcaacgtacaactcataatcataaaaatctaggaaagctttgtagttcttcaaaatctgtgactgcatggaacttaggaaagttcagcaacaggaaatgaaggaagttgccagttgttgtccagcaactagcagacaaaactctggaatttgtgaatgccaacacttccttcaataatagcaatgcccctgattttttttcaggcttcaagttgtgtgtgttatgtgatgtcctgtcacatcagtagaaaagtacaatcatgtgacacaccaaaggcctgacaagtttggttcctatgaattcttcaatttccaaaactccttgaactgaggaagtggataagccaaaaccttcaaaaatatgtctacgacctaagcgactcactatattttaaaaaaatcaaactgccataggaggtttcactttcttgtaaatgtccccgcctggcaatggctagtaacacaaagacaatgatgtcttccttctatactttgtgaaaaggtttgacttttaagtttcagaaagacaaattttctcataaatgacgcaatggaaattggattaaaaagctgtctcagttggctttaataaactaccaaagtacttttgtttcgttgttccattctaggcagggaacacagcaggttttaatggtcagctaccactaaaaagctaacagactgcacgcaggcaaaacattaatcaaaactgtgaaatagtttccctttagttccctggatctccccaatttgtgccctttctgcccttttccaccctttaaaagctcaacatacctgagttctctatactttattttcttcttttacagtggtgctcacccttgagagcattcatttttatatggagcctagtagacttaacccaaaggaatttatgtctaaatgtgaatttttattgcaaaaagtaagtgggcaggagagggacattctagagttagtgaagtaggaggcaggatgtaactgcagaggtggggcttagacaccacaccaaattgaggactagctaaaacaggacc

SEQ ID NO: 12 - DNA, 10249 bp, Homo sapiens
atgatttgagagtgagcaaaagggtaactgcataacactgcagcactggagaggtaactgtcagtgatgaaataagactagtattcgttcaaggtcattagcaacattgagttgtgactgttatggcttactctggtttattttttattttaactatagatagagatttagtctgaagaaaagcaagatagataaagtaaaatagtgcaccttttttcaaatgagtaagaacacaatgaacataccagttagcaacagcccagcacttagaacttctaaatgaaatgcaagagggtgatgcagatgacaattttaatagtgctatctaattcataacgtgttagaatatataaattctattgattgcaatttaaaaaatcaactaccaatgcttctttttcaatggcacctgcttgctctcctaattaacattaggtaaaatggagagctaggggaaaagaccaagacctgtttttagtagctaaaaatatgtttattaaagaacaaattttgaagttgtttgattaccgattttactactcagatgcttatagataactttgcatacagtattattaaaatccagtactgaccaggcatggtggctcacacctgtaatcccagcactttgtgaggctgaggtgggaggatcacctgaggtcaagagttcgagaccatcctggccaacatggtgaaacctcgtctctattaaaaatacaaaaaaaaaaaaaaaaaatagctgggcatggtcatggtggtgcgtgcctgtagtcccagctactcaggatgctctggtaggagaacccttgaaccccagagggagaggttgcagtgagccaagatcatgccactgcactccagcctgggtgacagagggagactccatctcaaaaaataaataattaattaaatccagtactgtaagataataaatttgtgttttctgagccactatgtttatggtaatttagtacagtggcaataggaaactaatagagacaccaaagcttgaatggtttattaactgcctggtcctgaggcagccccctctcatgacggggcatctggagaaagactagctaaggcgttctccagtagtgtttactatttatcttctttcctacctcttcttcactgcagagcgtgacagagtctgggagactgagggggcgggggcacaagccctctttgttgagtggctaacagctcagtgcagacaacaaatttaccaggaaacctctttcccctcctccaccagggcagaaggacacgtctgagagcactaggcgggcagattgagcagaagaaagctgggaaactgctccacatggggtgattcccctgaggttttatttccaaaattaaatttgtgttgctttccagggtgcgctcctatgatcctatgatccctgtctattgacacacgttttgtgcttatggttgcctacctgactgatatttctatttaatatgacactttagcagctaattcacaacaagcattgcagacatagctctttgtggccgtcaacttagatgattaaaaaggtgaatatgtaagtgtgtatgtgtttacatatacacccacacaaatgtagacatatacacatgtagtgtgtctccttgacaattttttttttttttgagacggagtcttgctctgtcacccaggctggagtgcagtggcacgaactccgctcatttcaagctccgcctcccaggttcacgccattcttctgcctcagcctcccgagtagctgggactactacaggcacctgccaccacgcccggctaatttttttggtattttttagtggagacggggtttcactgtgttagccaggatggtctcgatctcctgacctagtgagccgcccgcgtcggcctccctgataatttttacccacaatagtactcatactatctccacaatttttcagtgtacaagtcttatctttattttgttaaaacgcattttaattttttaaattacctctgataatgttataaattattttcttaattttttcaggttggtcattgctaatacatataagaaaacagaattttcaaatagatttttacttattccttttaatttagattaattttatttcatttcttgcttaattgctctggcttaaacctccagtataatgttgaataaaagtgacaaccgagggcatcctcgttttgtttctaaacttagggaaaaaactttctgtctctcactattaagtatgttgttagttatgggcattttgtagatgctgtttatcaatttgaggaagttgagaaacttttaaagaaatgttctaataataaaccttagtttgctaattactaaaactgtataattattatattaaatttagaaaatgcagacatgtagaaagaagagtatttttaaccaaccctaaatagactaccaaaataaaaccatcagtaacatccaatttggcacataaccgaaggaagatatccgagttcatggtttatctactatttttcattttggacataatattgtatttaacatatttgtatttgtaatttttccaatattatattttatgtctccccaaatttctagaaatagtgttatagaatcacaggatataaacattgtgtgtacatgagtgcatatgtgtgtgtgcatgtgtgtgtcaagctgtttcttatctattatctatgtataattctctctatatgtctatgtatataaatacatatataacattaatatttattttcaagaattcttgttaaattgatgcccttcccagaggtgtgtgttcttgccaatttttggcatctttaaaaaatgtttgtgaacttaactagtagagattgtgtagaagtgttgctttgattggacatgtctggcttaaaatatagtcatgtcactcacaacggaaatacattctgagaaatgtgtcattaggcaatttcattgttgcgtgaacatcatagagtgtactttcacaaaacctggatagcacagcctactacacgcctaggctgtacgatgtagcctgttgttcctagactatacacctgtacagcctggtacagtgctaaatactatagacaattgcaacataatggtgtttgcatatctaaacctaggaaaggtagaataaaaaatgttgtattataattttatgagaccaccatcacatatgccatctgtcttggaccaaaacgtcattatgtagtgcatgactgtattagtttgagcttcttattttcccgtttgtgtaagttatttaattttcttcctttgtgaactgatgttcacatccctcatgtttgttagttttccagtgctttcttttacattgcttgagtcccgtatatagtaaaagcactaactctttgtctaacacacctataagaagactgattctttcaacataatagaaactatacttccaattcagtggcatttccttcaacatagtcacagtgggaaattacacttacttcaatgatggtcccacttattaaaacactgtaagatatttttactctgaaatagtctttagagctctcatgcaaaccataggatcagctcagcccttttttaaatcattgggagcctaatgcagtgtagccatcttgctcattcatctattccctagacttggttttgaaatgacttctggctatttcttttttttttttttttttttttttttttgagacagagtctaactatgtcgcccaggctggagtgcaacggcgcgatcttggctcacttcaacctctgcctcctgggttcaagcgattctcctgcctcagccttccaagtagctaggattacaggcacccacaaccatgcccagctaatttttgtatttttagtagaggcagttttcaccattttgaccaggatggtcttgatctcttaacctcgtgatccgcccgcctttgcctcccaaagtactgggattacaggcgtgagccaccattcccggccgacttctggctatttctaaactcaaattcttcttgaaagatgaaaatttgctgccagtaatagtatgaaaaatatgagacctttgttccaaagtaaatttgttagaaagagagactcttctaagcaagcttagtgttattaggaaaattggatctccttccagctatgactgcttggaatgctaaaatattcattatattttctgatgcatttaaatacatatgtatataaatttaaagtaatttgtgtaaatgcagatggtttgtggcttgttttttttttttaatccttcattttccatggtcagttcttacgccttcacattcgtactattaattctttacacttcttcaataaatttactcaaatataaataacttcagaaaaatttaaaatctacccccgcaaaagcttcaatatctgaagtttatgtggagaatgacttgaggatttttttttaagaatagaaggtataaaatatttttattaggttattttatctataatttctaaatcaaattaacagaaatttattggagatatagtatatgtaaggttatatattttgctaaccaaaaataaatgattaagactaaaattcttggacccagaatgtacatatcatgaagtctttgtgcatcctgagatagtaactcagttaccttatggccctctctttaaagccttttttttcggcatgttgcctcatatttaaaaaatacaggcaagccaagcttttgtgtgtttcctcaaagaggctcctgccctgcacatcattagaaatgtttccctttaaactttctatttttccaaagaacttcgatttacactggcttacactcttctgtatcattctctgatatcaccttatctgtacacgacagatagtgtctttgatagttacatttctctagagaagagaacaagttttgaacatcaaaccaagaaactcattcttttggggaactgggagatgggtttgcagaaatgttgtagaaaagaggcttccagaaaccaaagatattctttgcattctttaacactttgcagacccctgagagtgacctgatttcagggttgatttccttcagggcagccactttctttcatgccaatgccagagttaaagtacggagagaaggccagtcttagagcagtgcttctcattctgtgactatacatcctggctccactggctgtctatcatttgttcagttcaccttctctggcaggaagaccagccagcctggcagtgttcttgttggcataatagaactgtcatgggttcatctgtagccatggacaaggagagctaatggaagctggaaagagtggattccagttggcatattgaagaagcttaactgaatagttttcaaaacaagaagttgtggaataagagttacagggagatagtagcacaaaaggaacgaggaagcagaaagactacaaagagaagcagaagggcaatcatggagaataagaaagaaatgtttccctacatctattgagtgacctggccaagtttagttaaaagacctggggcattgtataacaattggtagtgtcgaagaatattttacttgggaataaaaggagatcagccgccactcattcacacattaatcaaatgtctaccatattacttataacttaatttctgtaattacattactgaagcaaaaatgctgaatacacaacactaagagctggtagttacatggaggagtaaaaaggtaaacaatttaacatattaacataaattatggagctggaagaaacacagaggaaggacttgaacttaattggcagtaggggaaggattccaagaataggtgacagctgagctataatagtggcgtgaagctatttctttagagaaaatttctggggaacacgaatgaccagtgcacttttgcttttgggtacacaaacaggacaggcacacaagataattatctgctacaatgaccttgcctcatttcatcaaatccatctaaaataaacattatttggaagattcgtttttctatgacacattaagttgtatactggtcatcatgttgaccaagtaattttgaagggaataagaagaaaattaatatgaagtgtttattacatgtccagttccaccttacctgtcggaagtctcaatcacactaccgttttataggtgaatattacaaccatttcacacacatagaacagagcctcaagtgagttaagtagtttatggagggcacataaagaaggtgagtgttgggccatcctgtgaaagacaaaacagtgcctggacgcagagaaataccaagtctagatgaagagttttcagagtcctcggtgtctgaacatctgccactttctagctgtgcaattttctggaagttacatgacatttctcagcttctgaagtctgctttggaaagaaaaaacatcatccaaaagtactgtaaatacaaaggaccagagaatgttttgcctcattttttttagcatctgtagtaaaacctgtggtttaataagcacaattctgaatagaagtttagcttccagggcctgaacacaggcaaaactgttctgctcatgagacaggtaaaaataatttggtgttgcttcagactgtgcctagaaacagcaagataactggaagctgaaaatccatgaattgaccccttcttacaatcccatgcatctgtggtaaagttactgaactcataaaatgcttggataaagatgttttgttttcacaatgaagtagtgatgctttgggcctctgtcaaggtgaagcagaactagagaaagatgcacaggctcagatctcaaagagaaaacaattagttctggacccttgacagggccacagaactgggtgagccacattgagcgaggtctccagggaaaggagagccccagctgacatcttgtggaatgacacaaagatcacagtagacaaaggaagcacattttcaatgtaagcgaattcttctatgaatcaatacaatgagcttgaacgagaactccttgctctcagggacttctgaaaatccagcttcagtctttgatccccttgtttcaaatttctcactaaaacaacaaaaacagaccaaaaaaaaaaaaaaaaaaaaaaagatgaaggccattacagcaccataagaagagagtgtgacatttaatctaatggcccaaaactggagattttttttctttgtttttttttcttcagattattaggctggaggagctaaagcatgaagtgaaattctagaatcacacatgctctgcaaacagcaaggttgtctgcctggaagtagcatgctcttgggtcagacaggcaatgcatattttacacagaaaactataagcctgtcccatttcaggtctgctctcaggcaggcggagtgagaatttgtattatcctctctccgtgcatctccatgatacagtgcctcaaattcttatacgaattttctcacttctagagcactatagaacagaagcagtgatatctgtacaagctttaaacaagagaaagaatccagaagtggaacattccatcaggaattaacagtctacaacagttaaaagtgtagacagtactggagacaagaaggtgcataacaaggtttctgggtattgtagtttttcatgggctccattttaattgtgtcacagagagagtcagtgaggacaggtcagatcacatttcagttgaagggagttcatgcatttgataaatgtgctgtagcctggacatttgtccaagagttataagtgacagtatgccacctgtcaggcagatgaaaattatctacttcctgagcaaaaataatgaaccataaaaacttaacaggattccagaagacttgactatgatgaaaccagatacaagtatataaaaagaaaataaagagaaagagacgctatgttgttgagaattaaagaacaaaaacaaaaaacatggattaaattccaaatgaatgaaaagacattaaaatgaccaggtaaaaattattgtctgctttgtttgaggcagtaaaagacacaaataacactgcggatgtttttaaaaaggtgaattaaaacaaacaaaaaaaatctttgagaatctagttcagagcacaagagaactagagagacagtgatttgggatctttagtaatgtctactgacaaatctccaaaaacaacgaaaaacacactttgccaaaggaaaattaaatgtattggacctgccataataaagagaaccttactttgtcagtcctggtagtgtctagaaggcaggggcagatatttttagtagttagggcccaaagtgtattattttaaagctaatcttgccagatgggaaattggctgggactggacagagtttttgacctaagatctttggattgatggccacagaaaatcaggaatcttgacgtgagtctctatgagtaagctgccagtcttgagcaaaagctatttgagccagttctcagttttatcttatgaaacacgtatttcctggggcaaggtctaagccactcttgcttattctgagtattgtttaacacagggacaaaacatgatcttagtttcagctctcaataggtaatctagttttcatttctgactagatttttttatttttctaatttaaaaatatgaccagattttttatatgtagagttttcgtcaataattttgcaagtatatagcccggtttttgataagcataatcagatcaatcttcagtttaggaggtcactcccattgagtctcagagatgactcttgaaccatgagcttggtcttctgtagaaatagctattcttaaatcaggtccatggtctccatgtcccatatcaataatatttttccttttcatttaaaaaaattttctaatactctatttataatataatatatttaatatttctaattacatatgctttgtataagaaatgaatgatactttcaaaaattaaatatagatatttaagtagatgtctacaaaaaataattaggggataaatgttccacagtgtttattaagtatatttttctgcaaaatggaccaagtaggtggattttaaaagtctgcttttttcatttttcacatttctttaaggaacagaaataatgtttgccattggtagaaatctcattttaattttacagaaatacaataaaactagcttttagatcctcttttcttaccctaaactttcacaagggtttgatcagtgtgtgagggatggtgttgtggaatggagcagagctggtcaatgtgttagcaaacagcctcccaagcagcaggcaccctaccctcccactgaaccaacttttccatgtcagccctgtatgctgcatgatttgtctttggtagaaatcctgggaaaatcaagtgactttcctttacttcattttgcaggtgagcccagaggttcaactttcatcacctttttgggaagtaagattctcctacttctactttcaggagtgagctcaaagtcccagcaggcaaaaagcctgcaacattgtgtgggttttacagccaggatccattattatttttttctgagttaagggatctaaacatagaaaggaaagttggacatttgtaatttgcatttactgaaaatgataaaaagtcatggatattgaagaggaaggaggccatttctatggttagaaagactgaccctgtgagctctgcttagcctttggaatatctagtgtctaaaagaatagaggcaatgctaagatgttgtaacacgtctgcaaatgaaatggaaatgattctacttttctcatatattttataaatctgtgagtgttaagagtaggtaagaaaaacaatgcttacagataaaatatagttaaaaacattttcctctttctaagccttggtagtcatatagtttgaccaaatgacagaataaagattgtcccatgatttgaaaactgtcttcagtacaaatcttataaaaatatgataaaattataacaaatattttagaaggtataaaaataaaagataatatcctgcttctactaaaatatggacatactcaattatcttaacactttactttagaaatatgctttgacagatgtggatccatagaacctcaacatcttttttttttttttttatactttaggttttagggtacatgtgcacattgtgcaggttagttacatatgtatacatgtgccatgctggtgcgctgcacccactaaatcgtcatctagcattaggtatatctcccaatgctat

SEQ ID NO: 13 - DNA, 10249 bp, Homo sapiens; identical to SEQ ID NO: 12

SEQ ID NO: 14 - DNA, 19521 bp, Homo sapiens
caatcagttggccttatgtcaatgattttctgtgaacctctaggcagccaagggctcccgctagtccccatactaccataacccacagggttacgaacatgaaaatagcatatataaacataaatggtaatcagaacagtgtttgggatatactaagccttataggaaggcttgccaacatggttattattattcccattacatccctctagtccaataacattaatatggtatgattatcattccctattagtcctaggcacctaccctagactagtctactaatattgtttgtttgaatctaaaaacaacaacaaaaaataccttctacctggtctccctgcccctcctatgtcccactattagcccacaaagcagaaggatttgtctttataaatgagaagttacatcattgcttcttcccagtttaaaattctctaaatggcttccttttacatttatatcattttcagagtctttattgtgaccatggcctatatggcttaaccaggtctggcccttgtctacctctgtgaactcatcttcttccattttttaaatcttgtaccttgtgtcccaggacagacttcttatttctgttccttggacttgccaagctttccagcatcttcaggtggcctttcacctttgcagctgcctcctcttgcaatgttcttcctctgatcttcacactgctgtctcctttttattttttatattacacacaaatggctgatgtcagaggtcttctcaagtaaatacctctcctacccctagctcacattctctctgctactacctcaataaacttttcttatttacaggcatatagttgcctgtttgcttatttattatttcatttaagtatatgcttcctgtgtctgcccactggggtggggaccaaaaaaactgatctaatccctgtgcaaagaacacgtttggcccatagaagatatttaatatatttactattattaaatattatattatttatatataaatatattaataatatattaataaatatattattaatatatttaatattaatatatatctatcgactaccagttctacaggtaattgtgatgcacagccaggtttgtctattttgaactacctaattttaaataggaattaatgattaacaaaatgcttatgcacagcactgtaattgtcatcatttcatggaaaggtataattgagtagaaaaagctgttattcaccttaacacatttaattgccatatttttctgcacaaaataaatcattcctagaagcggccaagttctttcaaccttgaggctatctagctaagtcatcagcacatgcttttaggcttaggactctcaggtggtggcgggcctgttctccccctggctagaagctgagtatcagagatgccatgggagttgggagtgagccaagggaacatccagcttcacttttagtcaggtgtgcagttggtccctgagtggagagaagggccacgtgggagtgtcaggagtggggcctgcagacaaacaaatcatgtctttcaaggaacatgccatgagcaaatctggggcctgagtggggcaaatgcccaggagtagggaacagggaagactccagatgaagccagtggatcctggagggcaggtctgggaagatcccttgaatcagtggcttctggtggggtggcagaaaggagtgatcctttcgtagaagggacctgagacatggcagtgctgttgagaatggtgagctttgttctaagtcaaataaacagtctctgaaacagcagccttgaaaacccaaacttttaaaatacatagaaaatgctacagtcaggcactgagaagttacataaaatgtgcaagtggcatccagattgtccatgtgtgccctatgacaccaatatacaccaagtgatttctcctccaggcaccaggaccctaaacacaaattacaattgaagcccaggggaagcagtggctgggtagtgagggtaaacggtctactcttcaccatgaaaagctggcaacagctgaaaccaacgtactcagtagagaaaatcaggctaaaaagagaaagagagagagtgtgtataattataatttttataattttgactgttggccctggaggcgtttttaggaaggtaaaggtcttaattagcacaatattttgctgagcaggcggatgatatggaatgagcccatgacatggcatgcagagacctagacagctctgcaaattaaaagacagaacttggctgtgggagaaggtgtctgagggagaggagagtaagtgggacagagctggccacgttctaaggcgggatctgggaactgaggagaaaggctactgcgaaacgccctgcaaccaaaggactgggaggaaacagaactatcaaaagacagagttgaaggcccttagcctccagaatattctgccatgaccccatatccttcctagggttggattttggaaaaatcaagtaaagggggctctgtttcataagaggttggtgcgtggagaagaaagaggaattgattgacgaatgtgagtcggaacttaccccagaaatggtcacaagagggaataaataatacaggggtggcagctggagggtgatttgcttagacaatattaacttaattttcaaagtcaggggctcctcaagttgtttttgaatattactgtcacagtaatcaagaacgtaatatagaagtcatctctgcatttcattttccacaccttcttagaacctgttaggggagcaggaattaaagaagactgctgtccaccaccctgaaaatcattcctttctgtgatccacaacaccaggggccaagagattagggcatacaaatatggtcatttcaaaaatacgctgatggggtgctggtggtatattggtgagcctagctgccttccaaaaatatgctaatagaaaaattctttgtttttttaaaatcttgttgtatatcaaatttttccaaagtaatttttgacacattataattaattcccctgcaatcttccaggggagcatttcattaaagcataaaaatccacatggggtctgtgaccagctctgactgcagtctgtcaaaatcagttctctattttcctacaataatgtttaacccatgcaaagatcctagacactgagaatatggagcaaatattttaaaataaaaaaaattaagtagcatataaaattcatatgaaaattgaattacatgtatgacaaaatgacatctatatataagaagatatatttatatatatttacaaacatatatttgtatttcttattttacatactttattataaaatgaaataatcttcttattacctgttcaagtagaagatagtaagatgtgaaggcaaggagaaagttcatttaatattgaacaaagaattttaggaaacaagcagtgacactatgactataggaaaattaaaaaataaaatagttttatgaattaaaatagtgggtcttaatggcacttacagatatcatctattgcattcaactaatgctggaatcaagagttgttgcctgaagtgtaaagaactctgtggaaggaaaaaagatactgcttctcttttactcactacagtttaagaaacattcgctgccaaatacattttttaaagacctcttagcttaatgaaataaaatgtacttttcaatgttgtctctaacaacaacatgaactaagattaattttctctgtagtcataaacaaaaactaacaatttaagtacactgttctctgggagtaagaaatgataatatcagctctttcctattgtgaatctagttaattcaacctcaagataaagttatgagtttcttaaaactcaaataggaacctcagtttcccttgagaaagctttcctatcttttatagtgactatctttaaaaaatgacgaaagaatgagaacccttggggagacaagggtgattcctagctctttgcccagagggagttgctagcgattcctttagttgatatttgttctgctctgtgtttgaagctacttgcttacctgtctgccttcggtcacacctgtgtggagtagcccaactctttcattcacagtccttatattgttaatcactgtgcccaggtaagtaggaacaaaattaaggaaaaggagcaggtttggtgtggatgaatgaaagagactatgcaccaggcatcattttaaaaataattacacacgtaatcctcgttacttccctgtaaggctaattactattactatccccatgctttcagctgagggaacagaggcatggggagcctaagtaactttgatggtttcaaatctagaaagtagtcgaacagggattcaaatcaaaccccaagaattgagcttcaaagtgcataatctcaccattctgctttattatcaccgaggaaattagtgtaaaatggatatgctcattatagacaatgtggtagatctgaggtagaattgcagaaagcaagcatagaaaacaaggcccctccaggtctttttgtttttttgtttgtttgtttgtttgtttttttgagtctgtcacccaggctggagtgcagtggcgcaatcttggctcactgcaagctccgcctcccaggttcacgccattctcctgcctcagcctcctgagtaactgggactacaggcacgtgccaccacgcctggctaatttttttgtatttttagtagagacggggtttcaccttgttagccaggatggtctccatctcctgacctcgtgatccgcctgcctcggcctcctaaagttctgggattacaggcgtgagccaccgtgcccagcctccagctcttcttcctttatgctagtagagttttcaggattctgtagactctatggtagaactgcgtttttagatgttgggtgaaggccctttataagcttatcgaaaggacgtaagtgaactcatagaaaaaaaaaatctttgctgagtctttaagcatgtgacatttcaatcaagaactagtaactagaatggtctttgatgactgctataaaaattcatgaattaacacttgaaataatgtcgaatgccacgaagtaacagacgggtgttatcatatcccggtctggaggtctctggaggatgtcagtgctccaaaaatctccttaagtctccttagccagtttcagctcactgttagatgctttacacatttaattcctgcacgttttttttaaagatatgactatactgcttataaaatctctgtgtgtgtgtgtccaatcatctttacatactattaaatattttgcttagtcattcattcattcattcattttaccagttactggggaaaacaaagtaaaatatcacatagcctcttcccccaaggagcttgcaattttaggaactaatccagtttgagggctgaatttaagttaaaatcaattactgccctatgtactccttttaaaacaacattaggtcaagaccctttcagtgctaactttttgctcattgtagacaaatctcagcaggaaatcgtagatcatattagtctgggagaactcaaaagggaagatttatactcactcaaaaccagtgccaataaaagaagcagaatactgttatttttcttgaagagtgtaaaaattgcttcatttcttacctctagagctttcaatctctctaatagcaatttggtcttttcttttccctcatctgtactgctgctttcactcctcgaatcctcatcaaccaccatgtgaagatcttccaaagcttccttatgttttctctcttcctctgacagcttttcctgaagcaagaaagaattactgttttcaataatctccagtgaaaaataagcatgagtgtgaggctgaaaaggctggaatcattctcctgcgtgtgcattcttccggggctgggagtttgctaaacaaattctgagaggggtttattttaaaaaatgaagtagatatttttactgacccctggaaggacaaggccattgggttgccatctctcaatgcagttgtcctttgcacagttggagaagtgactaagccagcaaagccataggtggagtcatgtggttaatccaattttatctgcacaatgaaactcagctatactgcaaactgtggaaaaatacatcaattttgataccttcatttgtgaaaggcatagctcctcaagatagggtcattaaagtcactggacatgcagccatttaattaaaagaatataaaatatcacaaaatactgaaataagagtgatttcagaattcaaagctcacacctattagttctttcagctcaataatgacacaacttttaaggatccctcagtccctttctgtaacactgttcagcattcgtactatggccttgaggcagacataaaaagttattttgtcttgactcactgttggaagcccctcactcaaccttgtctctggaagctttttgaaagttgagaagtactaagttaagcctcatgaatagctcttgttttcaagggaaaaagaagtatcaagagattaccatattaaaaaaaaaaggatccattttgtgcatggagactcttgctccccacaatcaggtgacatccttccattacactatttaattctaaacacaatgctgcagaaatctttgctttaatgtagctggttgtcaaccatctgaacaaaactggattatcagtggtaaaagacttctctatattttaatactaaactaagatctatttgcaaatacagaagcacaaaacgtatcattcttaccctcaaggagctcatacaatctacttagaaaagaagaacataagaagaaaaaaaaaaccacggcgttttcaaactgtgctcatcaaggtactttgaaggttccaaaaatatttaagttactttttgaaaacaaattatgaattatgtaaaaatatgtcttaatgtatatgtatacatttatacatatatatgtatcagtgtatacgtgtgtgtatatataaatcactttagaccacaaagtcagtgaattcatccatgtgaacctgttatgtacagatttcaggatctaatttctcctgtcatctctgtatatataaatgcatagttgattagaaaggttgtagttctttatgaaatcaggcccaagcatgtgtaactgtataccatgtgcaggtgtgagttcagctcagataaatgccaggcaagtttaagatgtacatccacaggccaggaaacaagtccaggtcatggtagcatttttatagctttgattttttagggtttggtcacctgtcagacttacatttccaagataaggaatatgaagtttgtagatactgttcctaaacaaagaagtacctttacttctcttttgtggtttgggatgactgtaagtaaacactaacttaggttgatgaagcaagctgttttaaaattatcttcattttacttttctgtatatagtttttcattcatcactcagcatatgccacttatattttatacatatacatatgtatatatgcacacatacatatatccacacatacacatacacatatacacagtcacacattccttaggagatttcatcattgtgtaaacatcatagagtgtatttacacaaacctagatggtacagcctactacacacccaggctatatggtacctaggttagaatcctatataccatgttactgtactgaatactgtaggcaactgtaacacaatggcaagtatttgtgtatctaaacatatctaaacataaaaaaggtacagtaaaaacatggtataatcttacgagaccaccatcacacatctttataaggtacatgactctttgtgtgtgtgtgtgtgtgtgtgtgtgtgtgtgtgtgtgtatctgtagaagtatcctgtaataatcagagcccaatagctaattaaaacaaagaaaagccattggggtggtaaatgaaaagccaaaagactttggaatgtgacagccagatttcaggtctaacatttatttagcagtttggcaaatgatcttacacaaacttcctttatttttggaaatggagactcgctctgttacccaggctggagtgcagtggtgcgatctcagctcactgcaacctccacctcccaggttcaagcaattctcctgcctcagcctcctgagtagctgggattacaggcacctaccaccatggccagctaatttttgtatttttagtagaggcagggtttcaccaggttagccaggctggtctcgaactcctgacctcaggtgatccaccctcctcagcctccgaaagtgctgggattacaggcctaagccaccacacctagccttggacaaactttttaatttcaataagtcttgatgtctttgtctcctaaactcctaaatgaggctaatgtcaacatatatacactcacataccatatagtgaattcgtgtcattcacaatggttatgttctctaaaattttcatgaacagtacaccaacttaggaaatgtgaaattattgttcctaggggacatacagagttaggttcctgtgagcctctggtcacattttcattaaccagccattatataatcttgttttatgtgtatttctatttaaagacaccttacatttaacatatactgttgattcattcacactgacctaacagccaacagcactgtaactcatcctgaaggaagcttatccgacacacatgtattttatctgtagggcgcatcacagcctgcatgtggttaggaacaccagacagcacttaagcactacactcagggccatgtcaaacagtgaaatcaccaacaaaaagcacaaaatacaaaaagcatatcactaaatagaccacaaacaggatactagtttattgcatgaaagctaaaacaacaaggcacagtcagtgctgccttgctccatctcagctagtaacgtgaaccttgggtgactaatttttcaccattccatgtatgttcacgaatgaccacaaaagtgacacaagtatggatttttgggttgcaaatacatttttgtgagtagaaaatttgcaaatgcagaatctgcaaataatgaggagccactgccctatcgtacacacacacacacacacacacacacacacacacacacatacacacacacatacacacactcttaaagtacctagatacagtgcccaagtattatgatgtagaaataattaaagacaatatggattatgtatcagtatttagattacataaaacgtcagggtcactttacataatttgaagaaagggcaatcaatgaaagctgtgagacatgattctatggaaactgaatgtgactcatactctaacacagtgatacaacttaaatagttagagaggcatagggtcggtgtttggtgaaagagaaaattttaaaaggctcctagtcaagagtaagttttgtccttacaggtttataaggaaatcagtttgattataatagagaaaagctttttgagagaatagttgaataataggattggggagaaaaggagggggagaggatgcttggaaatgagacaaaaattcagatacaattcactcatttgttcatccaacaaatgttttgttaaacatggattactggccatttgctgatctagctaatggagtatggaaaacaagacaaagttcctatattccatgaaattatattctaatgttggtaaacatgacaaactccaaatcaaatctgtaagtaatataaggtattagtagctggtggtaaatgctatgaagaaaataatatcatctgatagagagtggtgtggttaggggcaatgttagatgtgctaacaacagagtgaggctgagtgaggaggtggccattacagcaaaggccaaatgatgaggaggaagtagctgtgcagtggtttggggaagagcattcccagcagaaggactagcaaggcaaatactcgtggcagggccaggcctgccttgctggccagctgagggagggtctgtggtggagcatagtgtctaaaagaggaaggctagcaggaaatgagatcagaaagagagctggaccatagagggtctttctaggcataggaagaagtttggattttattctaagtgcactaaagaggaactgaagtctagacgtaggggagtggtaggttctgatttacattttagaaacatcatcctgactgctgcaatggagaatgggctgtggaaggaaggagctaggagactagttggaaagtctttatacagaaggaaataaaaatcaggaatattttgaagggattgaatcaggacttaccaaaagcagtttttacggtggttcagaaactaccacagatgatgggtcagatgccctgaattcagtgcttagattttacaactttggaactttctgggaaaatcattccaactttttaggcctcagtttcccccagagataaggtgaggagttggactcaatgtctcttccagtgttaaagttctaagaattcaattaagatacagttttcagaaagaaaacgttgtcaaggcactcagtggtagcagaaatgacaagagaacagaaaaaagcacctctacattttgtaataagaaggttgttagtgggaacttgagagctgtttgactaaagtgtgacaatggtacccaaattgtcagtggttaagcaaaaagtaaaaagggagaaaatagaggcaattttctcagatgctcatttgaaagtttggcagggaaggaaatctaaagaactgtagctgaagggcattgtggaggcaagtggaaacctttttcaagatagaaaaaaatgaggttgtctgaagaactaaaaagaagagggagcaccagagagagtagcaaaggtgggaatgtacgaagagatttctaaagccaagaaggcaggggatgaagggcactgatagaggagccaaggtttggaaaatgcagctccctgtaaaatatcactgacttatttacttatttattttgagatggagtctccctctgttgcccaggctggggtgcagtggtgcaatctcggctcactgcaacctccgcctcctgggtacaggcgattctcctgtctcagcctcccgagtagctgggattacaggcaggtgccaccacaccaggctgatttttgtgtttttagtagagatggggtttcattatgttagccaggctggtctgtaactcctgacctcaggtaatccacccacctcagcctcccaaagtgctggattacaggcatgatccatactgcgcccatccccctgtaaaatatcacttacagtttaatttctcagttagcatttctaaatcattagtgtctagcctgaattcttagagaacaaggaattgagtacaagcagctcatttgggagatgcaggaaacaccagtagggaggtagggaagtgactcaaggaaaggaagaattatctgaccccagggtgagagagctgaggtgttggtgtcccaaccctggaggagtcattagttgaggccagctcttgaggcattcatttcctggctcttctagcctgctggaggcagtgaggctctgtgtagttctcaagtaaaagtgctctctgacacagatccttgcagctggaagtcgcagggccactttgaatggtcctggggtgcaggtactgctgatgtgctcgtgacaaagagagtttaaagctgctctgatgtaacgccacccaggaccaaaagccacatccgcatgctgctcacagactagtcactgacctaaaggcatacttgcctgtgctctacatgacaaaatgccctgatgcaaatccagaaggtggggttctctcttgtttcttaatcatttaagattaatcttttgtttcttaatcatttaccagtgagagcattagaatataaggtaacattgagaaagagagaaaatggaagggacgtatttagagtaagtgaatgagcaaaagaaacaaataggtggagacagaggtagaggaaagacctgagagagcggagagaaacgtggctataccctatccacagatcaccatagtccattttagatagactagcagttggatttatcctacactcataaaaacacgacagtattttttaaaaaatcaagtgtatgggttctatccaaaaataaataacttattttaatcagaaaaaatatcacaaattttaggtcctttgccaattaagaatctgagatatacacagcaaaaaggatatcagacagagaggtcaaaaatgtgtagtgctaaatactgtgtatttgtcttacgaacctccaaaaaggaaataagaaaaattagccaggcccactcatgaggatgtcaaagttgaagagaataagttgattctagaggtgacctgttttcatttttatggagtttaatcaagagtgaattctataaaagtgaagctaccatacaaacaactttcactccccacatatttcatatatgattgagaccataagcttgtttacctcaacaaataccagctagaactcagaaagctaaagatttaggagctcagtttgcatcgaagggtttatattaaatttcaccttgtcgctacataaagcaatccttagagctgtaagtttccctaagtggtatctagggtaatgattcacctttggcagagcactcaccttttgttctcaagcagtcaacatcatcaggcctatgtaaaataacatcaatcaacacaaagttctggaacgcatcaagtgaactcagatgacagcccaggaagcttggttagtcctaagagaggacagcatggctcttcatggatggccagctgctgctcagtctatacccttccccaaaatgtgtaaatgtgacttctccatcttctagtcactggctttccccattccaggacacaggaggactcaatcaatattccataaggttattttgtaattcattaatcaagctattcaattaatatttgctgagcagttcctacatgctaggcgctgaggaatatgccaggcatacaaaagtgaaaaatacacgtgtggcccctgttctcatggagcttacagtcttgcagaagaagatagctattaatcaaaatgtcaggagcaaacataaaatagcactgtagtgtgtcctgtgaggaagagtttcaaggtgctttgagaacagataatagagcgatataaatgagaggttgggagaggtttcccagaatgaggtgagatccgagggcacagtgagaccaggaaataaccacgatgtgagaagaggggagggcaactgagaagtccaaaagtaggccagggtctctggggagggagatgaggctggatgggcagatggggctaggccacttgtcaaggagttttgtctttaccctcagggaaatgagaagtcactgaatggaatgccactgactattttcaagtatggcagcagtgagggtaacacagtcagatttgagttctgaaatctctctctgatatggtgtggatgggttgggggaagttaacacagatgtcagaaaaacaagatgctgctgcaataggctatgcgggagttgaaggaaccattattaaaacaacagtctcacaaaatgagaacccacagtttgtaaggcgttccataattctgattcttcagtatgtacttcctctaacagtgacaagcaacatttccttatttcaatgtttctcagagagtgggccatcagccaccagcatcagagttgacaggggctgggggaggagaagaagtacggcttgtttaaaacgcagattcctcggtgcactctggccctagtgactcacaatacctgggagtggggacaggaatctttcattttagagaacactacaggtaattctaatccaagactaagtgcgtctggacaaacacacttgagcatagaacataaatcacttttactttagataagcttttgaggttgcacatttgatttaatttctattattaacaagtaaaatgaacagataattaatcatccaaagcaacattccctggagagtaagagtgggtgtggccattaatagtatactggaacagtaggtgtaaccaaacaagctgatacacatttacctatagcttgctaaccctacttcagtaatagatgtcctatgcaaactactctaccttcaagtgatgagagacccctcaaaatttatatttgagttctgagactctggggctcactatcttatgattgttccttttcatagaagcagatggtattaacagcctgtaactactttcagtggcttctagagcaaagggcattgaggctccaagagacaggttctatgtttgcaacaatgaagggaaacatgtctacaactctcttgcttagaaagccttagtaatttaggctgggcgcggtggctcacacctgtaatcccagcactttggaaggctgaggcaggtggatcatgaggttaagagattgagaccatcctggccaccatggtgaaacaccatctctactaaaaaaaatacaaaaattggccaggcatggtggctcacacctgtaatcccagcactttgggaggctgaggcgagtggatcatgaggtcaagagatcgagatcatcttggccaacatggtgaaaccccgtctctactaaaaaaaatacaaaaattagttgggtgtggtggcatgcacctgcagtcccagctactttggaggctgaggcaggagaatcacttggacccaggaagcagaggttgcagtgagccaatattacaccactacactccagcctagcaacacagtgagactccatctccaaaaaaaaaaaaaaagctttagtaatttaaaaacaatgcctgcttgccccttgttttaattaaataaagagagaaatctgcccatcagtgtcccaaatgaggtagaaaagtggcaacttgttgtcacaataggctcacaatttctctcctaagaaaaataagaagaaaagttggaacattttcatcccaactccaatactcagttccactgggtggatataattgcctagttttgtgtacaaaggcttaacctcaacacggtggcccttctgccttctacaccgtcactggggagtgactctaggtctgtctgagtctaggactgtgaagataactaaagaatcccaaattatggcagaggggataggcagtatatatcacactcggacacaccttggtatttcatttgacagtcaaccttcttgcggatcatcaagcaccgtctcactaggatctaaaagtctattcttctccagggtagagacatctagccccattttcagtaagccttagaacaagtagaagaaagaaatctgcattccctcctagctctgccactagccagctgtgtaattttagttatcacataaattctctgtccctcaatttcttcatccataaaataaaatgcacaaacatagactcactcaaaggtctcttctcactttaaatttatacaactttgatcatctgtaaaaactcaaccttgagaaataaatacttaaaacactgctgaagttcaggggtttttaatacataatttcattaagattagacctgcctagaagattccctgcataataaaactttcgtgcttcttttccagaagtgtatttctatcttcccatttcctcaccttcttggaaaaaaaaaaacacaaaaaaacaaaaaagaaaaccttctctttttgctgtgtacttttcttgggccctaaggttaaagctacctgtaagaaacaaaaggccagtgagagtttagtgaaagatactcctaacactttccaaaaatcatgcctaatataagccctttctaatggcatttgcttatgggaaaatagtcccaagtagctcttggttgcaaggccttaaaaaaataaagacaattcactcatctatttttattattactaactctggtggtggacacaaagcatccatgtagtaacactgcacctatcctgacggtaataacagctaccctctgtttccaactcactcattattttctgatggggactatccttaaatcttagcactgtagggggaaaaactctaaagtacttagttttttaacttgatggcaaaatgaaattacagggatatgaagaaacatccaactttaggaactagtcatttgtagaagttaaaacagaacttgttcattttgaaaatgtaaccatgtgtcaaatccacctactaattcatagcaacaatataaaaagctataatttaggactgttcacatgaggcagagatcagggtggtgttaaaatgaaatatgctctttccagaacacaaaagacataataaataacgattcatatttgtataacatctcagggttaaaccaagtgagttcagacatacaattttacatatggcaagggcgatatagggcaaatattctggactccctttacagacaaggaaacagcctctaatgggttgttaggtgacccgtttaatagtaagtggcagagccagaatttaaatacagttccgattttggacgtcatgctctttccacagactcggtgacctcttttggactttgacatgcatgtacagatctatccctaacggtagtaattctatctgagaatctgtgatctttagccaagcgtgaaccatgctactggcagcgtttctcccaaggctcccaggccattcctctacggagttggtgtttgtatcagaaatgtcagatctggcctcaggtgactactagcagaatagttttaacaaaccaccaccacttccatagttaatgatgacacaattagttcaaaacataaacacataccataataggagctaaatggaaatgcagagaggccagccgtctggctgacagctgctccagcgtgccctggttgtttcagcttctgtgatttatttactcatttgttttctggtggtgaggagggtgtgcaaaatatattgtcactttagatagcacttcagcaaataccataacaacattcccagggattgctagcagcttttgttcagcacaagcatactaaattttaaagagggaaaaatagcgtcagataaatcacaggattttaaaagaacatcccaatttgttcacagtttaacagtactactgtcaggcaaaacatataaaactcttctttttcatctctggatttgacttacaaagagaactaagcacatggtaaaatccccaagattaaatgtgtatgatggataagagaacaaagtgttttctttatgtctgtaatatgaacccacgaccactgacatatcaatccacatctcctccacattactcttcactcaaaaccctcctcaacattgccgattgtcttccatattgaacagatcctgtggagttacactaataaattttcagatgatgcttttattgcctgctccatctatcggcaacacttatttccctaaaaaaatagcctcaattctaaaaccactttacataaagggaaactctactgtggaatagaatggtgtgaaaagttcccctagaatttcattaaaggtatgctccaggtggctggacatctaagaaaactaataacagaaattatgtccttgtagcccacgggtagttgtttgagtataagctgggcagatagaaaccaaaaacagaaagtaagaatgccatgtagatagggaatttcagtgggtaatagttaaacttacatgcttaagagtcagagaaaaaaaaaaaaacctcataacttaaggttgaaatttgcaattcaaattcaatccccctttatcctgttttctaaaggaattcacagggtagggaagctgagctcatggacttagcaagggccatcccagaaggaactgacaaccccgtcactgagttgtaaatggtaggtgggtggctagagtattgctgtctattgtactcacttacagcagccatgtgtctgagattccctggcagaattttaatcaaaataaatttaagccaatataaaattttctacccattttgtcacaaatggatgaacctggaggacattatgttaagtgaaataagccaggtacagaaagacaaatatcacatgatctcaactacctatggaatctaaagaagatgaactcagaatcagagagtagactagcacttagtaagggtttgggtggaagcagcggttgaggagatactggtcaagggatacaaaatttcattcagataggagaccagatgcagtagctcacatctgtaatcccagcactttgggaggccaaggcgggtggatcatgaggtcaggagttcaagaccagcttggccaacatggtgaaaccccatctctactgaaaatacagaaaattagccgggcatggtggcacacacctgtaatcccagctactcgggaggctgaagcaggagaattgcttgaacctgggagtcggaggttgcagtgagctgagatggcgccactgcactccagcctgggtgacagagcgagactccatctcaaaaaaaaaaaaaaaaaaaagaagaagaaagagtaagtatacttaacaatgtatacttgaaaattgccaaaggcatagattttaagtgttctcaccacaagaaatgataagtatgtgaggtaatgcatatgttaattagcttgatctagccattcacaatgtgtgtataattaaagcatcatgttatatataatatatatacaattttattttttcaagtaaaaattctaaaacaaaataaaaaaaattctatctctgttctctagatgaccgaggtgctcaaatttttgtttcagaaaacacggtcaatatcatatcatttttgtgtgtgtgtggcaattgctggcaaataaatagttatatatcttctaagcttattaaaatgaactgattaaaaagcaactgcttctataaagaaagaattctttcagtgtttaaatgaaataacaatgataataataatacatagctcctatggagaagggaacttctcagtccaagttcagtaagtagatactgtatgcaattcaacaggtcacaattataatgtaagactctcaggggcaggaataatgttttctatatcacatccctatcaccacacactgcacaacacagaaggcattcagcaaatgtccaatgctggtgaatatgctgatgctttacctctgatgacactgggagtgagagtactgctgaactacttaactattcttaagtactttcaacagaaaacattttttaaacaagtattttggcaccatagacataaagcaaaaaaccaataggatatttgcacagaagataaaagcaccactaaattgattttctctcttagaaaatgagattttgcacgcttatcctttaactgacaccccctgccacatgcatcttctcacataggagcaaatcaacttttaagccataaatagttgtcttccctaagacaccctgggaatttctggtgactcaaagactaactcccaatcaaggtactctattcctcccaccttcttccaa

SEQ ID NO: 15 - DNA, 10109 bp, Homo sapiens
ggtcagtcatactctccatgttttatatatttaaactggccatttcaagttgtcttcagatgtgtaacctacttcctgtacagaattaattactgtatgttgatacaacattttaatcaccacccactctggacttttagaggtagaagaggagagaggtgtagacaaccgtttccaaggtatacagcttggaggccctgaaggctttttctttgatgtgaactttctgtttcactgactcattcttggagaaaacattccgaagttgtcgaagagggcagctgggatctctgcagctgtaagcatgaatatgtagctttacgatgcttgcacagatactgaggcacaaagaaccaggataatctgcttgaggagtggcctttttgatggcagaacaaggtttttgtttatttgtaggaggcatattttatttgtagcaatcatacctatacttcagaagcaaatccttcttcataataccatcatcaaagatgggcaaagcaatgatgctgataaagaagtaaggaaaaacacaacttcttttatcactaaaataagaaacaaacaataagttttacttggattgaggaaaggaatcaaatccatttacatgagtataaaggttcaagaactgaagggtggttactgatttataactttgtaaaattgcccatggaagagagggtcccatttagaagaaataaatttgtttctctctgaaatagacacattcaccaaacacatggatccgataaataccaaatcatggaattgatcattatatcattccttaacctttgcttcaacagccacaaatcaggtcaataatcacctagcctagtgttgtcctttgtcacagcaagagcacattaaactttgaagaggaaacatcatagagtttacaatagaactgcaggactcatactaccaaattatctgtatcatgcaaccaacttagcatcattatagtttcatgagataaaataaaaattgctcattcattattaataatctgtttccagcacacagaattaaaaaacaaatacctgagaaaagcagaaatgctgataccctaaacatttatttaagtcaaaaagactcagttgagtttaaaatattgcatttcccgtctcctggtagcacggatcactgaagtgctttgagaaccccttccttcctccatgccacccaaatgctcccagtgcctgttgttgctattaagccagagataaactcaacatcagggttatctatcctgagcactgatggactcggctccaaatacaagcctgtcaagtagcttgtttacagcaagtcttttaaataatgaaactgttccctctaaatacctggccgtcagggtagcatgctcatttcactactctaatactcctgcaagactatgagctccatgggctccacaggaaatgataatgattttgctcatcaatatagtcttagaacccgacacagtgcctggcatatagaagacaatcataactattcatggtgaatggattatatgttaagaatttctccactttatgcatctgcacaatatcctatgaaatggggatattattgttcttttatttctacatttctggggattcaagttgcttcttttgtagtattttaaacactgctgtgatgaatatctttatttttgtgatctctccatatgttagattcccaaaaggagaattaatgggtcaaagaatcagaacatttttatagctcttgacatataatgcaaaatgacttctggaaaggatggaaaacagcatagcaccagcaaaacacagaaaacagttttgaccactttcccaggcataccagctattagctttttaaaagagatgataactaaagggaacaatgaaatattacctaaatatctgttataaatttgtatgactttaatgtggtaaattggacattttctctgtttatttaactagttagattttctgttttgcatatcaaccaaggaatgatttgatgtggcttctgctgtgtgaatgggaaacctttcatagatacttggagaaactttgacactacaacttctctgccaatttgataccttttactttgaatattcctcaagagaatgacaggaactttgaaaactggagtttaggtgatacttccactgttccagggatctctttattctatgtatgaattccaagagaccaggagcctcttagatagattacttacatgtgtgttgataaatatcttcagaggttttcacatgggaagaattagtgagttattttgcagagttgggccagttttacaggccaataaataatgagctaaataaatcacagtcagggaccagcctacacagagaaattgtatacctacaaaagttttagcagtaatgaaattgaaagctgtcaccaaatcctgttatctgtctggatagaaaagtgctcaacaaaaacactgatagcgtaggagatagagaattgaattaaggccaaagaaacctttcagtgaatggcagattgaagacaataactgagtaatagaataaaactttctcaggaacccaagtcttaataaattgctctgtaagtactttgggactacagatctatctaacttctttaagttcccagggctcaaggacgtttggttttgggaggaggcacctttaggatgtacaggaaacctgggcaactcataatagggcccaaggtggaatccagttcgtgtagtccagttaagtttggtattattgtgtaaatacttatacatgatttccagaacaaagcattctctcattgttccagacactcattgcttaaatacttggaatcaaaaaaaaattctaagaatgcttataaaaatattctagaataagtatttaaaaattctcaaggataatccaagatatgtttagtgagcccagtgtttacctcttccttcctttctattttgccaggtgatgcttgatagcaacataaaggttacttatctttaaaaacgctccttttcaagaaggattagtatagagagagctaaatgttaactacaggtaaacaaataactgcattctataaataatttcaaggaaagttttcttttcatgtctccctggagatcgtacttgagtcagggagaaaaagtaaagcagtaaagtcaagaacataggctgaagccagagggcctggtcaaatcccagttctatctttactcgttatataatttgggatgaaccattaaactctatattcctcagtttcctcatctgcagaatggggtttatagtgacaatatctatctcatagtgttgttgtaaaaatgaagtgagttaaatatgtgaaaacactttacaatagtgccaggcacatggcaaagtgtattttccattctgatattatgaacatcttaagagtagtttataaaactgtactgcccagtacccaacatcattccagcacatagtaggtgattagtgaacaattgctgaatgaatggttgactataaaggattttccaccaatattttttttaaaggaccacatttctttgtatcttcaaagcatgacttaattcaatacaggactgacaggtaactttcagaaacaattccagggttcagagtatgcacacctgtacgtatcagcagaatgaataatgagagagcaatgaacaatattagataaaagctaggagaactatagaagacaagtaagagtcttaacccaaatccaaaagactttgaattaatgcaagtattatttccttggcaaagccctggcctgcccttctaatcttcactgataaggccatgactattacaccatctgggataggtcaagattaagtgaagattctgatctcatcactaactactcttatattcaagtgggggttggagagtgggtgggaatgtttcagggagagatcttctaatgacagattcactcatgtaatgctcaggaggtgatttaggcctacttaatctccaggacatctgaaacaacacaatttctggaacaacttcttatcctggaaaatcccagacgagtttaattatttttttaatccctgtgtttagtagtcatatcactcaccactgaaatgcagttcttgttgctggagtaaaagagagcaatgtttttaataggtaccaaagataataggatgactaggcacacagctcacgtcactgaaaacggagacagactggctctaccaggttggaacgaagccagtctctccagggctcactgtactctaggtatggcatcatcagctcccctaccggacagtgatgaggtgagagagtaggcaagagaaagagggagagagtgagtgattaaatgaacaaatacagcaaagttagagaaggtgctggcctacaaaggttttagttaaaaaaagcagggaattttgcattaatgaaatccactgaataatcggtttaatttgagatatccacatgtggctagtggctggcatattggacagggaaggctgggtgagttcacttgatatctctgttctttttctatctccttcatggtgttctcttctctcacctgccacttccatgtcggggttcctttttggttccctgcttttgtgactctgctcactttccatggctgaccttgagtcacctcacattctacgcgatcaaaactgaatttttcgtcttcctttataaaatagttactcttcatgaatttgttagttcagtttgaggcattatcattcacccagaccctcaagcagggaactatccttgacagctcatgcccctccatcccatacatgcaattaattttcaattcttgctatatttaccatccccccactccccaaatctatccatgtagcccaactacaagtatcttctccaaactgtcatcctctcttgcctgcattccacctaacattcttctagtgcaaggattctcagttctggctgcctgttagaatcaggtaacggggagtttaaaatatggccagaacctggatccacctccagagatgcggttttattcgggatggaatagagaccaggcatcaccattttttaaagctctccagatgactttttcagagtcagactgggactcacacatctagctcatcttcctggctctagtttttttgcacctatggccacaccataaagaagcaccacagggctctttacagaacattcacttgtccactctgcctaaaccctttcaatgacggaccacaatctagaaaatgaaatccaaattctttgacattccctggcctttctagtcatgtactgacattctcggcctcacagctagttccccacctgcaggtgccttttcctacctgtgcttgtgacctcttctttgctcagatccccactcttcacctggggaacctctactcatcctgagagactcggcttcggcgtcgcccttctaggaaatctgttctcacttgcttatgagaacagattctctgtacattgaacatcctgtgcataattatatgtatgatacatcacgtgtatgttaacatgggtgcctacacctggatgccccgttgcctatgagcccgttttctcagagcatgtatggtttatacctgctgtctcctttaattattaatggtgctcccttgagtctcaagggtatctgtgctaccatagatgataaattgcagattaccctccttgtaagattgttgaggtcagtaacattgtcgtatttttcattgggatctcagtgcctaacacttcttctaaaacttggtgttaatttatgtgctcaaaaaaattaatgaaggtgctgggcacggtgactcactcccgtaatcccagcactttgggacgtcgaggcgggcggatcacgagatcagaagatcaagagcatcctggctaacatggtgaaaccccgtctctactagaaatacaaaaaattagccaggcgtggtggcaggcgcctgtaatcccaactactcaggaggctgaggcaggagaatcgcttgaacccgagaggcagaggttgcagtgagccgagatcgtgccattgcactccagcctgggtgacagtgcgagactctgtctcaaaaaaaaaaaaagaaggaaagaatgaagtatttacctgggaaactatccttttacctccagaagcacatggtaactgttagaaaggctggcgtaaaaaactgaacaaagaaacaaatggacacatagccacttgtaaaaaaacgtgattttagagagtaaactaaagccttctttctcagctgaatattactttttgtacttttgtgtttttcccgaggccctactgatgttggggaagttccacatagtcatcaggtaggtatagatgattcctaaagcagccccagccagcgtcagttctcagaagggcagctctgctttttatggccaaggatttagaatctgatgtcagacttcttgcatgtgaattttgctcctccactgggaggacatttgacttcagttaagttatttaaactctccaagcctgctttataaataaggatgttaaaagtgcctaccacatacagttcttttgagaattaaataaggaaatctatgcagagagtttagcatggtgcctgtcatagagaaagctctgaatagagtagcccttattattttatctattttacttgttgaacttacaaatatttcatttgaagaagggatttgcctgcatttaaaaatactttgaaaaatcactgttccagaatattgggattgtagagattccaacccagttcccccttgggatttttgtaacttgagttgctaatggagccagtgttatttctttcctctgcaattcagcaacctaagtccataccttgcctgttcactagtacccattagtggaaaagaaaataccaacccaggactcatatttcagtgtgagccacaggtgttgttgggtgccagcttctggcagcatggcatacaaacaaatgaatgctcttgccaatgttgggaatattactgcagtatgcctattacaaatatttacttttttagctggaatatcaggggacactagggtttctgtttgaacagtgctttgaggcagaactcattgaaacaacatggaaagctttgcataaataaattcttttatgattatacttgtaacacatcgtatcatcagactgcaaaataaaacttgagaggataaataatcccagttatttgcacataatgctagttactaatacagagctgtagataacttcgcataaagtataataagagatatttcatttttggtaaaaggctcctatcaactagcattgaaaaagcaatataatttgtgagttacaggctgggggttatagacaatgcctttggagtcaaagacacataggtttgagaaaataatgcacttaagagtgtctggcacctaaaacaaatgcaacaaattgtaactcagagtaagaatattaataataactagtattaatatattattctctagggatatttgatatagttctaccaaacagaaatgattagattatattttgttctatcctatgttattttttactgctgcttttgtctgtaattttaaatcaaccccaaaatattcacataaacttaaaacctgacttcaataatttcaattttctctgagaagttggtggatcaacacagaagtgtggaaatgaaattgaggtgtctgcattttcatgaccagcaggcatgataacttgtcctaaaactgtttgatcttgttacaatttctgctgaatactttgagtcatgcaagaatatagaatgccttttattcaaaagcttccaaaagagagatagcatccacagaaattcagagtgagctgctgaaaggcaatattaatcctgatctcgggatattacgctaaatatttgacaggaatccaaattttcctgtagccttccactaagaagataatctttcataattttaactgtgaaaggggaggatttgatcctttgaaatggaaagggtgagcctaattgaatttccttctttggtttcttattaaagatgggaccagattgaatcatattcaattaatgattgtacttggatatattgctcttttcagaagctgaaataagattaacaaagcttgaaaaagatgtcgggggcaacagtgccaattcaacacttaaagggctaggcatacaaaagagcaaagccctatttcaatgccgtttatttacatgatccttgagcaggctgggccattgttcttgaccaattcaaggactgagtagaaggttgtgtgaccttgaacatcagctatggaggcaaagtaaacatacaaatgtacatatgaatatacatacatggaaataataattaagacataccattctgacctgccctctcttctgactacacaccaaatacaccatgatccttgtcaatgatgagtcagtatacccctataatgtctcatctaggcctacccaaccacttttctgtctgccttcattgctcaggttaaagaatgtcttcttctctaaggttttatgcaagtctagtaaccatggaaccatgttttatggactaataattgtgatacaaaatataacaagtaaattagcacaattactctgaagattttaatactgggactgtccaggagcacaatgcctacataattagtctccataaaattctcccttttgtaagcgttcctcgggtatgttgtttctatgttaaacattaggatttaccacaatagacctcacattatttgctaactgtctcatgtttctgtttgtatgatatactgcttcactggtgactgtgtaaattgactagccctttatttcttcagtgtctgcatagcacaaaacacatagtaggagcttgattggtacttctccaaatgcagttggtgtgtgtgtttgggaggtgatacaagtttggaagataaatctgaaattagtatcctagctctgacccttgacatctgtgggagcctgagtacgtttccacatttgtagtataggcataaaaatacaaatagtacatgcactgtgatgatattgtaggacatttgtgcagggactggtatgcagtaggagctccatccacagtcattctgttgttgaatgaaaacactggcttaagaatgattttagaaggccaggcccagtggctcacacctgtaatcccagcactttgggaggccgaggagggtggatcacagggtcaggagatcgagaccatcctggctaacacggtgaaactccatctttactaaaaatacaaaaaattagccaggcgtgatggcgggcacctgaactcccagctactctggaggctgaggcaggggaatggtgtgaacccaggaggcggagcttgcagtgagcagagatggcgccactgcactccagcctgggcgacagagtgagactctgtctcaaaaaaaaaaaaaaaaaaaaaaaaaaggaaagattttagaatatgagaggcaatggagtatggtgctcattggcttggggatcctccatcagactgcctacatttaaaccccaattctaagccttccagttgcaagggttaaatgactgaatacatataaatcccctttgagcgcctgacacagacaaagatttagcttcagtattattaaggatgaaactacttgagacacacaaatgaacttggtcaattttcaaggtcttttaaaactcttaatctatattcctgtgaagaaataatacatgttcttgcctttaaagctccacatattagaaaacacaggattattctgagacagctctcacaccctacagacacacacactcacacacacacacacacacacacacacagagcagcagcagcattgtctaggtctaattttttccttcctctgtcaccctcatatgtgtgctaattgtagtaactgtgagtccaatcaatatatgttctgtcataaggagagaagaagctggactaggaagatggagttgacgctatacctgacattcagtttgaaacactgaatattagaatgttagtcttttccagagggtctgaataaatgacttgtctaaaatagattcctgaggaaaagatctagactca

SEQ ID NO: 16 - DNA, 6925 bp, Homo sapiens
gaacatgttgcttacacccaaagcaacagggaaatgaggctttattgcctctcttctttaggcttcaatactatcaatgttgagaaaacccttgctctccatttccatttgattatcctgagaatatgccttgtactcaagaatttctaacaaaaaatcaaatattttatttttaggaacagaaagacctatatacattaaagattgtctaatcactacaccttaattatggggattatgtggtcagttgagttaagtgatttattcagagttgcaaggttaattaaattatagaccagatttttatcctgggatctacgaataagtttcaagggaaggatgaaccttcaaaattttatgcaaattgtgtgtgcacagctgtgcatttttttcatctgtgcatttttatggaaagtggatccacaattttatcagaccctcaaaatgtccctcaacatagctgggacagttactgttgcaatttataagatatttttatatttataaaatatagtaaaatattaaaggtcatgtaatccaagcttacagccaataaatggattccttaaataataactctgatggatagcatgcaaactctaccttgtatcttaagataattgataaccaaccacctctcatgttatcatggttcaaagcttgaattaaaaaggtattcatatagctgaatcatattatttctttcctataccttctcacattggtctaagtactaccctttgcagccatgagaaacaaaatcactgttgcttactccaatgtctttcatacatttgaagtaaattcctgttacatttcttcttcggtcataagagccaagatccctcagtattctagtcaccactctagactcaaacttagagctggaagaaacacatttcagtttgtcagtattctctaaaatccatataacaaaaaacttaaaaacaatgttctacttgtgatctgacttgttgatgactatctccttctggtggatgtgttctctctttttgctggggaaatcatggtattttacggtctaactgggaagatcagagcctaatgatttttatataggttttccacctgaaatgcaacaaagtaaataatatgcagctggccattcagacccaactctagataatcacatttcaaactttaatagtcatgaggttcacctaaataaacactggcaatttccaaaagagaaacattaagcacttttatttagatgaataatccagtactttgcccagaggttgagtcagaaacaaagaacaaaaaacctcagatttataaaatgagtacagcaaagatgacttagagtataaagtttttctatttcaaatgtcagaaaaatgctcaccagatttacttgattacaaagttccaaaaaaccttttattttgcaatactcactcatatcgcaaactttagtgatgtagcaacaattatgcaaataatttaaacaaagtaaatggactacatgaaaaattcaatcctcatttctatattgattatttataccagcactccccaaagactgttagaagcaacattgatcctaccaaatgctcagaaaagataaaaggccaacaactgaatacacttcaaaaacacaccttaccatacctgcttcttgggactcccactgcaaatgacatattttagtctccaagaacccctctttttaatgacatccattagcactccacaacaccattgttccttataaaagacattgagcattgctataccatgttgatctaattaaccaattttctgcaaatctctactttactctgtgttttaacatctcaacaagtatgagtgtagactcttgggtaatatgatctcattctcctctatgagagcctcctctgcctggttccctgtgagccaaaccacaccccaaggaggagttaatataattacttagattagggcattgactgttttacctaaagaccaggatgtccatatcagatttattttattttattttttattattattattattattattattattattattattttgcctcagattgaggtagaagactctgagactgtgagatcaggataaaaattgttgttgatattcctcttccactcccggcagctggatctctaattgaactcttctgctccctagctcccatactctcacttgcaggaagatataagaacaagagtgacaaaaattcaaatttgcaaagaaatctctcttaaatttcaaggtcatattgggtgatttaattcaatttttatagagagccctgaatttggaaagaaagaaagagagagagaaagaaagagagagagagaaagaaaagaaagaaagaaagaaagaaagaaagaaagaaagaaagaaagaaagaaagaaaagaaagaaggaaagaaagaaagaaagaaagagaaagaaagacagacagactagtcacatattctgtattgttttctgagaatcctggggagtaggggttactgaggatggtattaaaatcatttgcaggtcttggctttaatatcatcaaattagccccaaagttatttgtgattattatttgcttttgagttcttgtattttaaacgttatcattaaaatatttgcaggtagataaggaaaagctccagatttgcttcaaaatgatgcagttggaaggtagagattgaaagggttagggttacacataaaatggtagttagaattgcacgatggaggctgggtgtgggctcacacttgtaatctcagcattttgggaggccgaggtggggaggatcacttcatctcaggactagcctgggcaatatagcaagacctcgtctctatttcaaaaagaagaaaaaaaaatagccggctgtagtgggggcacacctgtagtcccagctactccggaggctgaggcaggatgattgcttgagtccagaagttcaaggctgtagtgagcatgctattgtgctccagcatggaggacagagtgagactctgtctcaagaaaataaataaataaataaataaataaataaataaataaataaataaaattgggtgatgatttcatttggcttccttttacttgcctgttctcttacttgtgtgtgactgataaaatctgagattataattaaataataaagcaccaaaatctcacacagaactatcaaccatcataaataaactcatagacataagtggaagagttggaaagtttttgccaagtggtcaagatgttcactgctgtaactaagagcttccactgaagttactattatcaaccacagcactcataaacacatagcactcctgggcacattttctatttatttaagtgacttaccttatttgatcaaaaagaaaatattaaaatcaccataaaactatgtaattagtgattgcatggtgatctttatgtgatgaaatttttaacagttaatatctaatatagaattaagaatcctacacaatattttaaagttatattttcaaatccatattttgtggatttcaaataattccagtttgaatgcttgcaactgcaacaggtttctgtaaaagcttttgagtttcacagccttccttttgacagatttcttaagttatggaatgcagccatcagcagtctgtagaaaaatgaaatgctgcaagtctatttttatgcagctgggatcaagttactaaatggatcaaaagaaataatttctttgaagaggtggctgttgacaccagtgccctaaaaataagtgcaattttgtgggcataaaaatttgtttatatcttagtgaaagtaactatagatatattttctatatatacacttgcattcatgatatattggatgccattctaaacatcttttaatataccttagtttaacattgcttttaagaggaaagttgcatgctttctcttgaataattgatgtagctaaagacaattattcataccaggcttagcttactgggtttataataaaaacaatgatagtaatttacctaactcttactttgtgccaaataccagccaaatacttcccaacattatttcatttgattttagaattacattttattttaataactagctattattttcacaattgtatagatgaagaagctgattcttagagagtgtaacttgccaaagattacacggctagcatgcctctgagttaaaatttgaaagctagtctgtttaattctgaagctcttaatcactaaattttatactacctctttaggttggatggcatatcaactgatttgaaactatagaaaaaaattaggaaacagaataatcttttaaaatatctttgtatgtgaaagtaagcttgcttatagaaaatgtagtaaattgaaagactattactattgcaatagcaatagtcaaactgaagcctatagaactcaaatgcatgtaagtgtcaaaatagccaagtaataatgcgatatgatataattttttatcataataaaaagtcagaaaacaaaattcataaagagggctctatgatacaagaggaaaggttgatctaagggtacaaactaaaacattttaaataaagtttttggaaaaaacaattttaggctccgaaataagaaataaatacaaccccttcacagataataataaagaaataagccaataagcccttaaaatagaacgatatagtcttagctctggaggacaaaatattctctacttggaccctgactcatttagaactcctgcacataaatacatatatatatacacacacacacacacacacacatattgactatattgctgaaggggagagtaaaggaaatggtgaaaggatcatcatttttattatttcattaattcctgaagaaaacacatacacaaattgcaattgaagcttctaaaaaacctagaaaacagtataaaggacttagacacagtacaagtatttcctaccatgtaagtctgaaagagagaaaatcaatttttatgaaaacataaaacagtgatttgggttgtgaacaaaattatttgtctccatttgtgttctattggcttactgctctgccaaattttgaagcaaaatgaaaaaaaaaaaaaagagagggaaattatagcaaacctcccaaaacatatcccttaaactccgcaatgtatttaaactacccaggttctgttcatggatatactcaaacattgagaaattgtgggtgtactgggttttgatgctgtactttttgtaacaacttgatattggagtcaaaacatgtttttctatcttgtgttgctcagaaaggtatgagcaaatatatttttcccacaaatttcaattaattaagaatgattaaaatgtggatacttgcaagggaaacattaataaaaacatgaagtgtagacatagagataattttctctgtggcggatgactgatcatgtcattaggcagagctttgttcccttaggctctgtagagtcagagctaggataaagaatcacagatttagagttgaagaaactcttaacaataacttaacaaccattccaatccccttgatttatagataaggcaggttagtcttagaaagaggaaccggttctttgtgtgagactcaacaagtcacatcaccgctctgcgcttctgttcccaaattctttttctttctttctttttcttttcttttctttttttttttaaatgagtaagggatttcctttattattagtgagattgaacatcttttcacgtcattattgaccatttttatttttctctacaaactgattatccaaatctttctcccatttttttcttttaaaaaattaatttaagatccaagatacatgtgaaggatgtgcaggtttgttatgaaggcaaacatgtgcgatggtggtttgctgcacctatcaacccatcacctaggtattaagcctcccacacattagctatttatcgtgatgctctccctccttccaatccccctaacaggccccagtgtgtgttattctcctccctgtggccatgtgttctcattgtttagctcccacttataagtgagaacatgcagtgtttggttttctgttcctgtgttactgtgctgaggataatggcttccagctccatccatgtctctgcaaagggcatgatctcatcattcctttttatggctgcatagtattccatgatgtatatgtgccacatgttctttatttaatctatcattgatgggcattttgattgattccatgtcttttttattatgttctcacattcttaaaattaaagttgggactagttgatctccaaagtgcccacatactaaacgctgaatggtttcaaaagaaaagtgagttaatggcagacaataacctcagatctcagttcctaccttgttctcaccagtccagtttgtgttctgccatttgctcatatatttcactgtcactacgtacttatgaaatttgtaagtcaataaatggtgaagaaaagaaaaacaagaaaagtcatccacattttagaagggcaaaattgtgagtaaggagctgagtggttgaatccgaatattttcattaattccaaacaaaggcaatggaaagtgggaaggaggggaattgcagttctataagctatagttgctccataggagaaagggaagagccagcagtaatcaggactttttaaaagaactgtccaagttcaatgacaatatcatctagctctctgactctaggcatctgccaagaatcatggaatcttcatctcagtaaactaaaaccaggctagacaaagcaggcacaaagaagaagagaatcacattcaataggttagtcagtatatggtaagctagatcagccatggaaatatgcattagtcaataagtttgatacctaaatcaatggagacatggtctaataactgacctttcattttttg

SEQ ID NO: 17 - DNA, 19015 bp, Homo sapiens
tgcttactctggtgtgctttttaaaagactataaatcccattaataaagtcgaacagaagcttgaaaacaattaagaaatttaagaatgagctaaattgttctcacaaaaagaggaaaactacaattcctgctgaacaagtctttcattcagttcttcattcaattcacattagcctcaattggaaaaatgtccctgttcagttaaacaagttaagcctgatcttaagtgtatctgacttgccttctatgttcttccagccacaggaaattcctccatgccaattttttaaaactgctatcaaatcttttttttttttttttcactcaagtgcgacacatttaaatgtgaccacaggaacaaatggaaagagattgaagccttgacttgaaatgtgagctttcctctttactagtcagtaaggtattgagaaagttacttgacctcatccttcattaccttgtctctagaattaggagatcagcatgtatggtgatcatggaaattaaataaaattatatgtcagggcctattgcatttattgtctgactcatcctaatccccttattcctttcttagtgtttctttgtttgttgatttatttttgtccatagtctcatgatttggagatagggctccagctttctctgctaatgtatttcctacccctctcttcctctgtcagtgactggagaactatcttcttctgacatgcccagctagcttctacttcaggactttatatgcctgcttcccgcaatcatatatatatgtgtgtgtgtatatatatatatatatatatacgtatatatatgtgtgtgtacatatacgtatatatacatatacatatatagatatgtgtgtgtgtatatatatatatgtatatatatagagtcttgctctgtcaccaggctggagtgcagtggtgcgatctcagctcactgtagcctctgcctcctaagttcaagctattcccctgcttcagcctcccgagtagctgggactataggcgcaccaccacgcccagctaatttttttacttttagtagagaagagctttcactatgttggccaggatggtctcgatctcttgagcttgtgatccgcccgcctcagcctcccaaagtgctgggattacagcctgcttcccacaatcttaaccagtcttgtctcatcttcacatagccaactccttcttatccctttgatgtgtacaaaaatcacttcttcttgtggcccttataatcactcacatcctaaatggcatatgtgttcctactatgctccactgtagcccataactatctttcaccttgttaaattttcagcactttccactgtatgaaatgatcttaaggggttgtcctgtctctcctatagtagagtgtaccactggaagaggcagagacattttctgtcttaatgttggtatgtagtggggtctgaccatcaatatcagttgaattggcatgggaatggatgactctgtacataggaggccaaacaaataaaaattttaaaaccgcttatctgacaggatcacgcttttttcacttcggctgttgttagttttaattctctgaagttatacatggttagataaaatggtctatgaaagtcctgggtggtgatgggactagagacaaggattcaaaatgtattatagcaaatttatgtgtagaaaaaaacacgtggttaattaagacttgctttctgtcattttatgaaggtatctatgtaaggtcctagttttctccattatacatagctgaaagaaacaccagtaatgaaacgtttttgtattattctcactccaaaagcctagttatactgagggcggccaatagatctactatgggatacaatgaatatttaatttactttgatgaaaaggtgtcataagagcctttgacaacccacagtgaaaacttgaggatgattttattaactcaaacccgatagcatatgttgtgcaaactaagacatcaaagactttttaaattaatacctgggaatttcttgggagaagtaactgcatattaggattgagaacaactctaagttgtcacatattgaaatttgtttttaattactgaaaagtcattttctcttatttctggctcgggtaaatagtaggaaaaataacacacacatacacatacacaaatgatatcaaattaaaagagagaaaacaaatgtgaaaggattatggtgtgaactgtttgctttccagcatattaactgtacccatgaactctcatctcccgccccacagaaaaaaactaattattggaattttttagtgaacaggaaggatatcagagtacgatactttctgtttcccttaaatgcataccattttctctattttcatagtttaccagtttcccagtagatggcaccattgtgactcacaatgttgctccaccttgtaaggaagtattatacacactttcaatttcaaaacatttgtaaatagtgcagtatagtaacacttgcggtggtgtcttagaacacaaatacttctacagtatctagaagacatgtcaactgttgaaagccaataaatgtcacaagaacccccgtaattcctttgtatatgtgtgatttcatatcttataatttttatacatttaaattattttaataaaaatgtgcttacatacatgtacacacatatgtgtatgtatgcttataaatgtctaaaactgtataattatttaatgatttacttactactcttactatttctttctacctggattaatgtgacaagccactcagagaaactgaaaattcccatgggcttctccagttgttcttgggaaaaaggagactagaacagtgatttcagatctggaatacactggactccaacctcagattttctctttgctgcctgtattacctaaagcaattgacataacctctctgatattcaattttcccacctttaaaatggggaagatggcatatacctggctgtgttgctgttaagggtaagttttaagctgtgtgtgtgtgtgtgtgtgtgtgtgtgtgtgtgtgtgtgtgttgcaaaaataaatacagtgactgttatagagtagaagttcaaaaatggtggctgcattccgattacagcttgcattaaagttgaatattaagaacaggagagatcgatgatggtgtgttttgtaaccttcacacggttttctatatcataggatgagtcctagctttcagagatttccttgcgcctatgtctaccctttcttttggtcctagaaaaggtcacagatttaaagtaagtcaatgtggaacattaacatggctcatgcaggttctgtgcagctgtctctatgggttcttgaaataaaatagggccaaaccaggcacttcaaatggtagatttgaacaataaatgataaccactgtctctaatatccaaatcattccctactcatccttctttaggctcatagttcattgcactgtcttcttaaataactacccgaacacaactccacttttctcacttctaatgcgtacatttttagcaataggttttggttagggtcttctctgtccacatactacaactgtgagtacatgactgacccacacttttaacttggtgcttttggattcaggcagatgtttagttccaagaagcctttgagaatcatgttgtacttacagaagcactcactatgcttccttttccaagtgattagtctttcactattaattcattcaacaaatattgatgcaacactttgtatgccagttactatgcagacactaagttgtgccctcatggtccttcaactttacctgaaaataatatattttatttatttaaccaatattaggtatcaagtgttttacaaacattgcctaattttatccttgtagaaccctaggaactagaggccatagattaaagatgtggaaactaagacacagagaataagacatttacagaaaaagaagtgaaggaaggagggaaggaaaaggagagagaaagggagggagagaaagaaaaaagggaggaagaaagggaggaagagattcaaatgttgacaccctaacctccaatgcagtggtatttagaggggggtacttgggaggcaatttgatttagatgaggtaatgggccaggggctctcatgatgggatcgatgtctttataagaggagacaccagagagcttgttctttctgtctgctgtgtgaggatacagcaagaagaaagccaggaagaaagcccttgccagaaacagatcatgctggcaccctaatcttggacttcttagcctccagaactatgagagaataaatttctgttcttaaagccacctagtctgtggtattttctgatggcatccctagcaagttaaaacaccattttttgattttctgaaactggtacctggaggtagaatggagggaattaaaagaaaaggtaattagtagtgtcagcattttagcccagatattaaaatggggatgaccttcagtttcctaaatttgatgaaggatttggtgaaggatgagggatgtcattattgaaaaatatgtatcagactttcgccttttccaagaagtcagtcacagctttcagatcccaggtatgtttgaaagtgactttagtctgatcttttcatgccacttagaattcccaggcttgccagtggaacattttgtagtaacatttaaaaatataaacttttcatttcttgcctgcagtggagagagctgattcacgatgagttcctctgtccctcccttcaccatatgtctcttcttcattgttgatttcctgttgacattaaaaggagcaacatatgaaggagttagaaggaaagctttaaatttaacgataaacttttttgaaagcatggatcagattttcttacaaagccatttaaaatgcattgtaaatcatttctttcatattttgtagagacttgttttggaagtatcgatattcccttctccccagcccccaaaagattaagaaaaatataaatagatttatttttacaatgtaatgagatgagagggatcctgtgagcaagctgataagtcttgcaattcactaacatagcccatgaaatccagctctgatgtcaagaggctctaagcattttgcaattcttaacggaatgttttctttgcctccctccttccctttctccatttgacagcacctgtgcatgtgcatgcaagattgcttttcagatctatgctttggttttttgttcatttttgtcagaaaagtcagcctatgcttattagggatctacaggaattgtttccacatggttctaatggatgcatggacggaacacctccacaacatgttgctgttggcctggtgctctgtcactaccaagatttcagagttcatttcttggctcctttttgttcttcctcgatccaagttcacacttcataatacgttttaattgtcatctcaatgagatgactcaaatttatatattgatatatctgtatcacaaaaaaattgcaaattgcgtgcattgtcaatgtgaattatagatagtatgctatgaaaacaaaaatattttctaatctgtctgacttttagtagagaagtcaagatgagatcataattaatccaggcttgaattaacatagctggaatagttaacatgggcatagtccctcatctgtctttggctatttgggggaaaagaaatacatgttaaagtgaaaattagtggaggaacttttaattagtcatacatttttactcagtttcatacacaagaatattcattttggccataggaaattgccactatttgatcattttgattgaccaaaaaaagctggcaatttcaaatgatgcaatacaggtcaccatcactgcttccaggaagcttacatcctaatgttaacaggtaaataacgaaataattaagatggctttagtgtaatgagaggcagtgggcagaagggggcatgagaggctctttcagatggtctgatcagggcaagtctctctgagaagacatttgcacagtggcctgaatgagatggagccagactgccataaaggtgactttacatctgggagatctgaggcagcaacgaggcaggatttttgagcagcagaaaggaggccagcatcaatgaaggaaagaagggtggaaaatgagaatggaaatagaggtcggagtgaagtggatgtgcagaatactcaatatcattctgatttttttccccatgtggcactattaactttagccactctatttaaaattgcttattgtggtggggggtgggaggaggtggttagaaaatgtatgtttaacctattcacttgcctttatttcttgttccttaagttttttaatgctttctatgacatcgctatcccaatctctactatgcttgtgtcttctggtttacccccatgtttctttcatgccttctcccagaggagtgactcacagtttgcatatactagacccaaatttttagactacagccaaagtaaatccacgtacagacataggggaaacactgagattggggatgatcttattttgtttaatttctagaaaaccaagttaattgagataaaggaggcatatttaaaaaccagaaaaggagacttaggacaatggaaagatttaaatagatacccttagtgaacataattgaaatactcattatttacattttctgcaacatccccgaatatttaccaaagtaaagaacttattaaaaagtatactataatttataatttcaggaaattataaattataatttataattttagtgtgactaaattagaatttgagaaatacaaagtttaacatgtttacacaaatttgtcgtttaggatttaaattatatttcaaggtggaagaagagagtgctcctgattacaaatggagaagtggtagaattctcactgaccacaagaggtctgcctttgattctcacaatttcacatgggacctttctcttaaaccttcagtactatgattggcatttaagggtcagacagtaaacatttgtataccgaatgacggaatcaaatattgaaggtagaactcataaacataatgcaaatataaatgttatatgttaaaattatctttatgagtaaggaaaattctaagcttactctgtatttacaccactaagaatggatgattatgagttcatttaaatgtttgagttttaagtgtcactttgcattacatgtgtttccttaaaggaatgtaattttggctcatgtgatcaacttgatatacgaatttcatatggttaaagaatctattggcaatctctctcttcattggtttacttttaaagattgattcttctagaaaagggaatattttagattgcttcataaaattagtaaattaaatgtgtaaatgaaaccatttgttcattgtcatgttactcagagttggcatagaacatacgtggaactaatgtttttattggcacacttttccatcaactactgccaccttccaggaatgttaaattgatcaagttagtacaaactaaccataaaacacttttatctgcttatcaatttcaaagcaccttaacttcatgaaaatgacaaagttttattgttctctgacaggtcttctttctgaattagattacttacccatcataatacctatggaattccagaataaaattctagtgtagaaaaaatgtttaaagtaatttgagaaaatacatcaagaagttcaaatgattcaaaaagcccatgagtttttccataaacttcaaaaataccaggcatgttataacatctcatacaataaaatttcacatgtatgggtttttctcaaatactgtagtaaccatttattcacagaacatacatgtcattttctatttgtcgtctaatttttttaaaatgcttagatttgacaatcaaaatacagaaatctagcatgattccatagaaatctattttctagttgaaattgttttaatgccaagtgtgtcactaagaaacaaagtcaatgtgcacatctgcttttgggcatttgtatatttttataaacagtcacagaagcatttgttaacattctgtgagaggcccccctgctttcagagatttaccaggtgttcattaccttttgttttcatctctatatatcccttagtggatatttctgtatttatcaatccacctcagtaccgtggtaactcaaattttaaagtaacaatgaatgagactttactaatatcagatttgcaagtccaaataaagtgtgtctatatatttttggtttacatatttattctttctaaatatttcagttgattgataaggcataatttgtctcatgaaaacccttgtctttttcccaaaggatggtgtttgcttattttccctgaacttttggtatgttttaaacagtgtttgaagtttattatgagtgctcatgaagttttagtttagctgtagcaatttctggattgtttttgaccttcagactttgtggatacaggcaaaccttatttttttaattaatgactttgtatttaaacaataagttttaattttttcacaaagttttatgctttgtcctattttgttgtatttttgcagagttattgttactgttttgtttaaggttttttaaatgtcatttttaaaaaactcattgtccacattccagcctgggagatagagcgagacactatcaaaaaaataaataaataaacaaataaaaccattgtccatttctcctgagctttcaccaagtctttttttctataaataccttccaagtttctaatggctattatttatatgaatgaaatagtctcagaaaaaataagtttatacacgtgtgtggtgtatatctactgtagagaacaaggatcccgtttaaagaaatgtcatattgattagatacaattttaacttgctggaaattactttctaaaaatattattttccaaatcttcctgtccataaatccgtttgtaaagggaaaagccactcttaatacatagaaattccttttagtgagttcaactttaagcccctaggaaatgctttagtctttcaaatatccaaaaagttaacagattttatatgaacactttacatgagaaagtggtacttttgctgaaaacttaaagtagtaaatggagaaaactcaagtgtagcattatttccagctgctgcagattccatgctttttcatatgtccctttctctgcctgcctctccctcctatgccaatcctttgtatgaccatgagtttttcaagactcttctgtgctatccctgacaattcagtttgggatttgctgtcaccttaggagcttctctgtaaacctgtgatttttttcctattagactaatgtgtgaatgagtgttttgctcagtgctcccttatagactgtgagcttcttgagaacagggttgctccttcttcaccattgcatcctcagtgtgtagtgtggtacctaacacatggcagctgactttggcttaaccaacacatgcttgaatgaagcagctccaaacctggaatgcggaggcagtagggaaggaaaggatatcaccaggactgctggcagatgagcacagagttgagtacaactttcactgtgtaggaggcagcatagaaggggaagatttataaatgatgtatacaaaaacaaattcaaagctagtaaaagaatgagtggagaggctggggaatcagattctttagaaaatagggagttttgtataagaaaaggtggtaggggaaaaacagttttgcaaaatagtcatatttcactagatttagcagtgtgttatccaatcacagatgacctgaaaagatgcactgtgtaagatgctattaatgagaaaggatctagaggttgacaggtacggccatttgcatgctgatgataactaaaattgtaaggaacacatatttagagtagctttaggttttggaaattgattgaagagggacagaaaaagaaggagaaccttaaaccgtaacttaagaaatgagagctgggatctacagagcaggaaatgatacttggctgaaaagctacagatgcataataaaaagattacctgttatttgataatgatgataaaaaaatacaatgataagtagtgcatatgggctgggcttatattctttcatttaaaccccaaaacaactgtctggggaagatttcattgtttttcccagagaaataacagttacagagaggcaggtaaattgcccagggtctcagaactggtaaatttaagagttaggagtagagtccaggtagaggcactccaggatctgaatcttacctgccctctatagtctaagctttaaccaaacactatgtaacatttatggtatagctgtcctgagcttaagaagtatgtttatctcatttgatccttagaaaatctgcaagataagcagacttcaatcctcaattgaaaggcaaagacaggcttaaagaaaacagagattttccctgagaatccacagcctgtaaatggttgtgatccggcctgaaccaatagcttttagttttaataacatcacaggttctgtgaaaccatgctacttccttagatggtgctccttcaggaaaaggatatcaatgttggtatttttatataaaacattaagagtatgtgtttctgttaatgtacatatacatgtcctgtagcctgttagaacccatttttttcattttcaaaggtcataggaaaaattatattcttacacaataagtctgtacatccacagaatcaaagatatttggtcaaaagtttgtcattatggattctaaaagttgaaagcatatggctgcattttaaaaacctatctatatgatgtgcttatgagtatggtattttgtgtccaaagttaattaataacggctgcaggccagtgttcttgtaggagctctcattttttccaacattgctggtgtctttgaacaagtgaagtgaagccatccagggaaagctatgaatttgcattctttttttttttttttttgaaacctttctaacaatggctgataatcactactgtcaatagtcttctaaaaacttcccagtaatgattagatactatgaatagattattgctttttctcttcaggtctttttcccccaactacatatagaatgttattgaaattcatgtgtcttaatcagttgttctctatgctttttaccatgcctctcttcatttctaagtcttctgacctaaattacaaacctgaaggactgagaagagaagaaaacccattttgagttcctaccctgtgatccatactgtgctaattacttctcactcatctcatccacactaccacaatgcaaagtcagcacgttcataattgttcacagcaaagagaaaactgaggactaagtctcacagggagtaaaagaagtagatttaaacccatgtttgactcttaatgtcatgtgtttgatctccgtacttacagctcttggattcaaattttagtatgtgtttttaaagtccatattgtaaatgtaaccatgatcagaagtaattactattttgcagagcacacacacatgtacacagaatatcaaacataaatatacagagtaaaagaaatgcccgcatgcctgccactcagggcgagatggagccctgccatcatgccacatgagtcccctggtgccttttctgtcatacccgctcttgtctacctaggggaaaatactatcttgactcatggtagtcacttacttgcttttcttttcctcaaaatgtgttttgaggttttttgttattgtgaactaagaaaacgtagttgtatttgtgtgaggggaattgatactcaataggaagatatgccgagatatacttattatatattgtttgctgttctcacactaaaaaggttgggttctataatttggactcaaaagaccatttctaggcctttgagtgcccctaagtggccataatagaaaatacagtattttacaactcttggatgatctctccttccatctaacagctagactttccactgggttcctggcctgacttctgtagtattctgcatcgttttttccattaaacaagggcttccaggactataatttgactctgctaatggaagggcatttgtacagtattaattttaaatgggaaattgctgacacgttaaagtggcatctgtcctgctccccacttgaactccgctttagccctggtcactgcagttgtcagtatcaattggggattaggagggcctgtggcctgagagctgctggccagcaaatgacatcacttttcctccatactcacagagctttgtgtcttaggaagtaagtccatttgctgtggttttgttatgagctgtcacgtcctctatggcacagatggacgtttcgactttgactttcttttgaagctgcttcatggggatcaggctgcctcttaaacacatgaagtttgtggacatatcctgggcacacagaggtgcttttcaaaatagacggaaagtaatttaatatcattaaaagacttgttctcggtgcgagtttatcggttcctctgcttgattcataatcaaggcagaaattatttttttcatatgtttcaatgaagtttcctatgcaatcccaatttttgtaaatgttaaaatgtggattataatttaagtccttattctatatttggaaagacactgtcttttctaacggtaaatttagttcattcacatttccagcaaatatttatggaagaccctattctatttcacagttattgacataaatgaagcaacaagttttctgtcttcttggctcttaacatttgatgatggagaacctggaagtaatgattacgtacacaaataaatttttaagaggcaaatgagatcatttcagataacaggaagtaacaggaagtaaataaaagagggtcatgggatggagtgggaaaaggggagagctatttcagatgggaggatcagagacagcctctttgagaattgagtatttcagctgagtcccaaatgcagagaaggaacaaagaatcaactgcatttgagagagagaaatcaggaaatggaaaatccctgtgccataaatttatattgttgtatctgagtaacagaaatagcagtgagtgaagaagagggtagcaagaaatgaagctggagggtgaagaggaaccaggtctactcgatctctttaggccatgcttggatttcatctgctggcagaggacatcagtggagagtattaaaatcaatctatgatgttctaaataaataaggataacaaattatattttcatttagtgctttttaataaaaactaaaattaagctaaccaggaaaagtttatatgagtttttttacaattgtatagaacataagatgttggctgtatcatactgaaaaaaacacagactaagcagtccaggaagtacattgtaagaattactatttttagattagtatacatgttttaaaaattctttttttcttattgcttttcacatgttccgtgttgtcatatattacagtaataattttcagatttagggtatatcttacaagctagaccattggagttgcaggctcatgcttagctatgtgaatttggtcctaacataattacttgctattatgcccttgactttcttgagggatattctaagatgctgctgggacatttactcttgtatttatgtagaaatgtttttgaagacattatgcactgttttctcatgtggcctctcaggcagatgcactctctactgcagcgtcagggaaaaaaatgtgtttttcctggatagctggtatgttttaatatcaaagacagaacatgttttctctttgccaagaacacaactaaatttatagttcacctcttacttgggacaaggcttactgtgaatgaataacccttaaccttcaccacaagttacttacctatttatttatgtatcctgttgtataaaacacatttccttaaactacctagaatcatttctgcatccaataacacattgtataaataccatacaacttgctcatcctcccgcccatggggcctcgtattctcattacagtttactgctaacaatgacatcacactttctataggcctttgccttccttaaagcagcaggccatgtgtatcccaggagtgatacacacttcctttttaccacaggctctacattgagatccatatctacatgtataccatcgacacacacgcttgacactcactaactctttcctgtatgccaagtaactgtccagaagaaacccaactttctgtgtcttaacagactgtttggttgctaaagatggcgacagatcaaaatagaagcacttagtatttgaaccgtgttacgttggcagcctgagatccgatctaaggaatctacactttcctcatgtttgtaatatttttctcaggccccagaaataatgttaatgaatgggttttcctctaactcatatcgtatcttcttcaaggtcgtttctaaaacaatactttcttttactatcagaaacaaataatgcaataaggagacacttttactaatggaaaaaagttgactttacatgtcaagaacatagacttttttggaaggggatggagtaggaaggcaaggtagactaggaaaattagatgctaggaggtaacagtgtgcctctatatttaaagtaaatatttgtgttttatttttatttttatttttattttttttaaagacagagcagctatccccagagcagcctgcctggcaaaagcaggaatggaagggctgaacgcatcttttatggaagtcagataaatttcatgctctttaacatcgactctgactgcaggcctttcgctgcagtctggctccttccccagtgggaacaaaaaaggaaaagtgattaaagttccctcagtaatagacagcaggaggcagtggtcttggcatcttctacagagacagagagagagtgctttaacaagacttgcgagagttctttgaagaaaagaagttaagactggaagggctggtcgaggtccgctgtaacatttgttcatttcctctacttcatatagcttatttgacttcttggaatagcgtcaccctcttcgttaaaatgtccctgataaaaggaggaaagtgaagttgagctcctggccggggccagggttcagcatgttctactgtgagtaggagtgtttggaacttgattattgtaagacattccaactgatacaaatgataactaaatctctctctctctctttctctttctctgtgtgtgtttgtgtgtgtgtgtgtaaatctctcactctctgtgtgtgtgtgtgcttgtgtgtgtgagagagagagagacagacagacacacaaaatgtgaatgaatgaaggaaggaaggaaggaaggaatacaggagagaaatttttctgtatgttaggtggctgcgattttggctggccaaaactgccttttgccttcggtgaactggctagagctgctcactacaacccctccccatcccctaggacaaaaccactggacctttctctctttttgtctctctctttaaaaagacagaaaggaaaataaggtttgcaatcagtattcagacattcttatgactaataggattaggggcgttacgaagggatttgaacaagataattagtttactgcttagtccacagtgaagcaagaaaaatacttctgagaaaaggcagacaaaataggtcagaaaatgtgtgggaaatgaggtaagacctctcaacaaggaccacgatcaactggaatattatgaaaggactcctgagccttcattcatagctgcagactgtctgcctttttttttttttttttaatacttggccaccagaggtgtgaagcaaagtgacttacttaattttagagttaataggtgttgttcctggaccctgagtatcctgttccaagtgcataaatgctgccttcaaagtatttctcacaacgtgatgtaaggggaatgttttggaaaatctgaagagctcttatcgggcattttacaagctggaaaaaattatacaattaggagaactctttaaaaactaaaattttcttgaatagattcattactttaattgcaaaaataaatcttgaaaacataaatgtgaggggtgtgttctttgcttaattaaagtacttaagtgtttgtgctctaatttgcacagttttcactgcggtagaatatgcttaagaagaatcatttgaattttaaaaattcacaaagatgatatttttttccttcatagccacattacattctcacacttcctcctccacttcctaaaagctagtgctgtcaactgtactgttgctatctgtgagttaaggtatgcttccaaaggaatgctagaaaaaaaaaataccttcaaactctgtgtatgtgtataccacatactttatttagttagcttctgaatcttacagcaaccaccagccagatgaaagccactagaagctgttagaatgcctttggcttggtatgggcactgtgttgacttaagactggtagaggaaacagtcggcatttctgcctaatgaactaccgagtgacacaacagaggtggcctttcattatctatctgtgggtgaaaggttaactgacaagagaacttgttagacacaaaagcaattaaaccctataataacatattgttaacatatgacataatgattaacttaaataaagaagcccagatacatgttttcagattcccggagtgtggtgtgtttatattcctgtctcccatttagaatggtaggctgcacagtgttggacaagatacattgcatattcttttcatgtcacaataaaacgtcatgttattttccttctgtaaatatacgaagctattttttgccattgtatcctgagactgtggtttagttttaggaaacagtttgaaactaacctcttaaaaagggaatagtaattcagggccatgttctgttggtgggcaagttactccctgaacaaaggtgcccaaccagccagtgagtttttaactctggttttccctctgtttgcagaatcatctttgcaatttatctgcctcttcgtaattaactcacacatgctctatatactatggtggattttaagttataggtactcatctttaattactgtgagtgatacatacgtttagagggtcaagttccctaaaagactaattctgacccccccaaatctttctattaatagatggttttagaaagatttttttaaagcttcacttagtgaagactcaggacataaaatttgcttatctaaaattttaattgaattaaaaggttctagactccctttaggataaagctttgtgtcccatttggagaaatactaatatgaataacagtgtttctgatctccagggaatggccgtcatcgggggaaggcaggtaccgaccctaaagggtatgacacagcacaggttgggatgcatgcagggagtgggaagaagtgaaatacgaaaatggggaaggaggctgggcgtggaggctcacacctgtaatcccagcactttgggaggccaaggccagcagatcacgtgaggtcgggagtttgagaccagcctgaccaacatggagaaccctatctctactaaaaatacaaaattagctgggcgtggtggcgcatgcctgtaatcccagctactcaggaggctgaggcaggagaatcacttgaacccgggaggcagaggttgtggtgagccaagatcgcaccactgcacctccagcttgggcaacaagagcgaaactctgtctcaaaaaaagaaaaagaagaagaaaatggggaagggatggcttttatagtgtctcaggaaaattgcacttcaccattaaaacaagaaaagagtcttacgactacaggtagatgagcagaaaatgttgaggggtatggggacagtggaaagtattttcagtaaatggttggaatggatcatagatggaaactggcaagatataagtggaaacgtaggtagatgttttaattgggggctgaaccatagagatttgaagaaataaataggaactagaaagtctgtttagaaagctaatatggtagcccaggggaaatgtgataaggcctgaccaagaggagtgatggttgaaatgcaaagaaatgtatgaaagcaaggtgcatgtcaaagttatctaaattccaaaaattgagaacatatggcatatagaattatcttccacatatttgcttaccactgtaccatgagaatatttccatattattcattatttatagaattattaatttagttactgatggtactgaactacaatctacatatcctatcttctattagtggacatttaacttgttttatacatttattaaaataaaaagtttttttgctcataaaaatgtttggcaacattgctccttattttcttgggctaaattcctgagatcattcattcactttttcactcattagttgtgagaaagtgctgtatgtgcaaccttttgctagggaaaggattataaatgctctctggagtgtaggtggctacaatttctagttggtatgacaaccagtggtccttgcacacagcagatattgattgatcccctgcattcaaggcactatccttaactccactgggagaaaaattaaaaacatatggtcttggacttcaaggagtttgcagtttaataagacagtacaatttaataataaaatgagtatggctaagagaatacatgcttaaggcttttgagattagtgttaaaaaaactgtaattaaatgagtgtagttcaaaggatagtgctgtaagattttagagaagggactaaacatcatggactggagtggttgagaagggccacattgaattggctctggaaaaaacagacatgccttcatttagtacaggacaggaaatttcgtttagtgcaggcgaaggaaatttcatatgaaaagaacatgaataaa

SEQ ID NO: 18 - DNA, 51669 bp, Homo sapiens
aggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttgacatctcaagtatgttttcttttttaattttttaagtatgtacttaataaagattagagcatcatcttcctgaaaattcattaaaaaaatgcattatgttttggtttttagagattagtaataaaattttagagattagtaataaaatagatgatatccaaataattgtcatttttagagttcacatatttattttgtggtttgtttttccacttgttttcattcactttcatactgcattgaaaatgacagtctttctttgtaatagaagagccaattaatttaaaaatattttactcattttagactttttccttttaagtaagttggaaaaacaggacctctgtcccattattaaaaagtggtgatagtatttcaactatgaactgagaaatggagaaaaagtccccaaatagtcacctgaattctccaaactcctctcattggaatgattgctacaagttatcacattaccatgtctccaaaaggcttctagtaaatatgcatgtttctttcttagcaaagaagtgatgataacacaatgggagttatgaacacctaagcttatgtgcaagatcccaaagggaaggagctataagggagttgtggaaggagaaaaagcttaatctaaaatcttatttagaaatgattcttctcaaacccctgcttactactactggaaaataacaccaccaagactgagaacatttcagtagaggagacaccacggaagccgtacactgattttcaacactaatcattagatcacagataactagcctgcttcattaatttgcataaacattcagagggtgccactgacacacactcacagatatttaaggaaggccttaactgagccaggttctaggctgagcgcaccactagttaaatgtatgggtgacttttctgttagcacataaccatgacataacaagaaaccagcatgccatttttgcccaatgacctgaacaaagaaagacagcttgttcttggcagcatatttttgatctaaggaatctgagtttctcccaaacagcaataaaaatacccttttgagaagtttttcctgacaagagccactcattctgtttttctcctccctaacagatgcttagagaaatggaaagatctctttagcctccccttcttcacaggatctagggaaataatagaaatattaaggggttaaagacaggaaagaaaagtacatcaacctagtgatgatgatcctatagaaagaaagagtcaacacaatgccattcagaagtccccaaggaaatgtaattagcataattaactttctggattcatacattattatttattgggtcaaatattttgcagaccagccaagaagcttttgaattttaaaagtttcttggcaaatcctgaaaaattgccagtaggtatcagaggaatatatagagaatgcccttgactttgacctataaaacattaaatgtttcaatgcacgcttatgaacagtgtttatgtgtgtgtgtgtgttgatttcagtgcttactgagtaagcatcatcactatcctttccatcattgcttttgtgatcaaggaaaacagtaactattcagaaagataaatatagacacttagttgaaaccattaaagcaataaagaagttggtaaatttcttgtcctcaagaaaaatacagtctaattgagaacatattacatagacaaaaaaaatgtgccaagaaatcgtactcaaaagtaccaaatgaatatggtagagaaattactgtgtggtgctagtgaagtcaaacccattgaagactaaagtagctgggtaagaataatgcaagaagcaggacttggaaatgagaaaataaatacattctgaatgaatgaaaattataaatcagcaaatttggcaagaggggtgatggttggacattcaaggaagaacagcttactttaaatatgtgaagacaagtgtagtcagagggaacacaggatttatcaaggggattaaggggtataaatgtggagatgagatgtagtttgaaactaaactatggaggtcataaaggagggtgaccattacccaataggaaaggtggagtttttaagtgggatgatgacactgaaattaatgatgtgtggggagatgagagctgaaaggggctgagagttagaagaggcatatatgatagaaacgtcagaatgacttccagtgacttcttgaataactatatatggggaaagaattattacagtatatgctttcttcaaggagattaaagaatagaaaataggaataattaaaaagtgatattttaagatgagctggaagggtatatttgaggaacatagaatcctaagcaaatacttgtgggtattttctaaagaagcatttttggctgcagcaggatggatcctcctgatgggaggaaactaaataaatctgtctcctatgcccgctattctaagatggatgttttggaagccaaaactgttatattcttctaaggacacaaagtatccaggaaatcataagagatctacagaagatttatagttttttttccattaagtattgaaaaccatgaagtcaacttgattcttagaagtcaaccctgtaagcaattggttatgatttgggctcatggggaaatagactatacaaatgccatcatgatggtcatcaattttggggcattagttatgtataggacaccttttattcactcgaggcataaagatctataaaataaggtgtatagcagaatacctaagctaaataagcataccaaaatattgtcattcaaattgataaattataactcctaaatgtgctggtcataggtcataagtgatttgacttttattgctgtgtcatcacacattaatccaattaaaaaggccagtgcttactcttgaagattgtggcatcatttagaggtaatgagagggaaaaaaaattatagaaaaatgtcagtaaaaatatactagagtagtggagtaatatcagaaagatggtggactaggaagctccaggtccttgttccttcatggaaacacaaagtaaacaacatattaaccacaatagctttatggaaactttagaaacagttaaggatttgcagcaaccaagataatgtccatcaagagaaagccacactcaacatggtaggaaatttggggtcatttctgctcacttgtgcccccacccctccctggcatgttcaggagggaagccactcaattcctcgtgttatagaagagaccaggttcttgtcacacgaccaggaaaatttaggcacatggacacattgtagggtgagtagggcagagtgcactgggtgaaaaaaaaggcaagagcaactcagcaaagccagagagagtcctgctagcaggtttcctgcctcactgattgaatcccaggtcacatagtaacaggcaaggccacgctcctcccccatgcaaagggcacgaattccgaggctccaccccatcctcccagtgtgcaggtgggcattattcagaaagaattagttgagaaagtgtgggtgtcatccacaaccagcagtccagtgttttcagctttcaggctgttttaggcttgaaatcagggtttctccagggacccttggctgtctcctgtctctatcatgagttcctcctttacaatggaagaaaaagagtagaacttctcccttgttttgtggcttcctagaggaatagtttctttctcccctaactcagagagtaattgggaatgatgatatagtttgaaaatcaggtttcaggccactgaaagccgcaataggcacaacaacacattaaagctttggggaattcaagacctatggggtcctggaggcaacagagtagaggccgaggaatacaatagaagacttaaggtcctgaaaagaatcagaagtaaggctcttaaggaaaataggatatataaaagcagctgtgtataccgggacttgggagaaggaagaagaacacacagaggctcagtaaatacatatgtttagaaatgacctgaaaaggcataagatttcacaccatgctgatgagtgaatgtcttcccttggatgagccaatccacaaaattggcataggtagctgttttttcaaatgttcaagtatatgtgtctacaagagactcactttggatttaagaactgcattagattgaaagtgaaataataagaaagatattccataaaaatagtaaccgaaagggaacagaggtggctatatgaatatctgacaaaatggactttaagtcaaaactgttacaaaagataaataagggctctatataataaaagtgtccctgcaccaagaaaatgtcatcataataagaacaagtgcacttgttctcactcacatgcaaaagctaaaagagatgacctcatagaagttgagagtagaatagtggttactagaggctagtaacggtaggtaggaaagaaggagaataaggaaggattggttaaaggatacaaaattacagctagatagaagaaataagttctagtgttttacagcactgtagagtgactatggtcaataataatttattatatattttcaaagtttgaagaatctcttcaacttatatattgtgttcccaacacaaatataagtgtttgaaatgatggatatgctgattaccttgatttgatcactatgcattgtatgtatcaaaagtcattatgcacctaatatgtacactatgtatcaacttataaaaaatatatgcatcaagcaccagagcacttaaatatatgaagtaaacactgacccaattaaaggaagaaatagataattctagaataatagtataagacttcaatactacaccttcaagaatagacagaacaaccagactgaagagtaataaggagttagaggacttgaactacactatagaccaattggacccaacagacatatacagaacaacccaccaacaatagcagatcacatacttttctcaagtgcacatgggttgttttccaagttagaccatatattaggtcacaaagttagtcttaataaacttttaaatgttaaaattatacaaattatatttttcaatcataatggattgaaactagaaatcaaaagcaaatggaacacaggaaaatccacaaattccacatggaagttaagcaacacactcttaaacagtgggtcaaggaaaaaaattttcaaaaaattagaaaaatcttaaggcaataaaagcaaaatataccaaaacttatgggataaagtgaaaacagtgctaaaagggaaaattatagccacaggtgcttacattaaaaaggaagaaagtctcaaaaatctgaatttctatctcaaagaggcagaaaacaattaaaaactaaacccaaagctagcagaaggaaaatgtaaaggttaattttatgtgttaactttaatgggctaaaggatgtccagatagctggtaaaatattatttcttccaatgtctatgagagtgtgtccagatgagattagcatttgaattgatagactaaataaaaaagattgtcctcaccaaatttgggggacatcatggaatccattgagagaccaaatggaacacaaaggcagaagagcacattcaccttctttacttgagctaagttatttaattttttctttatacatttgtgctcctggttctttggccttcagactcagactgggatttaaaccattgactcccttgttctcaagccataacaaacttgggctggaactatacaactggctgtcccgggtctccagcttgcagatggcagatcatgagacttatagctcataatttctcataataaatgttttcttttgttttttcttctttctttctttttctttcttccttcctttctttctttctttctgtctttctttctttctttctttctctctctctttctctttgtctctcttttactttctttctattggctttattctgtctggagaaccctgactgatacagaaaaagaaaataaaaattaagacagagataaacaattaaaggtaatagaaaaaacaataaagaaaaatcaacaaaattcaaagttggttcttaaaaaaaatcaacaaaatgtataaatgtctggcaagattgactaagaaaaaagggagatgactcaaatcactaaaattataaatgaaaggaaatattcctatcaattttacagaagtaaaaaatcataaatatgctttgaacaaatatataccaatgaattggaaacctagatgaaattgataaattccagaaactcgtaaactaacaacactgaatatcgaagaaatctgagcagattttaaactagtaaggagattgaatcagtaatcaaaatctcaacaacagaaaaagactaagtcctagaagtcttcattagtgaattctacaaatcatttatttaataaagacttaactttaatattcctcaaactcttccaaaaagtttaaaattccaactaattcaattagactatcactaccctgataatcaagccagccaaagatactataagaaaactatagactaatatccgtggtaagtactaattcaaaaatccttagtaaaataccaggaaacagaatacaatagcacattaacaggattacacaccatggccaagtgtaattttttgctggaatgcaaggatggttcaacatcttaaaatcaagcaatgtaaatacaacattaacagaatgaagaaaacatcacatgatgatctgaattcatgaataaaagtatttgacaaaattcaacacctttttataatcaaaaacattttgagcaaactataaatagaaggaaattacatcaaaataataaatatcatatatgaacatcccatagctgacattatagttaatggtcaaagacaagacttttcatctgagattaataacaagacaagggcactcactctcaccatttcttttcaacactgtactagatattctagccaaagcaattaagaaataaaagaagaaaattctaattgaaaagaaagaagtaaaattaactgcagacaatataatagaaaattctaaagatttcacaaactgttagaaccaataaacaaatgtaggaaagttacagaacacaagatcaacatacaaaagtcagttgtttctagacactaacaataaacaatttagaggagcatcagaaagaatacttagaaataaacttaaccaaggaagtgaaagacttgcacactgaaaattcaaaatgttgcagaaataaattaggaaaacacaaataagtgaaaagatatcccaagcacacaaataagaagatttaatattaaggtctcaatagatctacagaacaatccatgccaaaatcccaacagtgtattttgccaaaatacaaaaattcattctaaaattcataaggaatttcaatataccccaaatagccaaagcaatcctaaaacaaaaacaaagtttcaggcttcacactttctggtttcaaaatgtaaagctgcagtagtcaaaacaatgtagtactggcataaagacagatataatactggtacaatataaagctacagtaatcaaaacagtgtagtactggcataaagacagacatagagaccagttgaatagcatagagagcccagaaacaaaccctcacaaatatcatcaaatgattttgacaagagtgccaagagcatttaatgaagaaagtatagtcttttcaacaaatagctctggaaaaactggctatttatatgtataaaaataaatttaaaccttacagcatttacaaaaattaagtcaaaatgaaagaaacacctacatataatacataaaactataaaacccttagaagaaaacaaccaaaagctttataacattggatttggcaatgatttcttggacatgacaccaaaagcgcaagaatcaaaaataaataaattggatatgtcaaaatgctaaaagtatgtatcaaaggcataatcaacagagtagaaaggcaacatatggaaagaaataaaatatttgcaaatcaagtatctgataggaaattaataaatataatatacagtatatatctacacacacacacacacacatatatatatacacacattaactaaacactaaaaaacttttgtacaccaaaggacactatcaacagatagtaaaaagtcaacccatggactaggtgcagtggctcatgcttgtaatcccagccttaggaggctgaagcaggagaatcacttgaagccaggagtacgagacctgcctgagcaacacagtgagtcctcatctgtacaaaaatttttaaaactagctaggtatggtggtaggtacctgtagtcccagctacttgggagactgaggtgggaggattgcttcaacccaggagtttgaggttacagtgagctatgattatgtcactgcattccagcctgggagacagaccaaaaccctgtcactaaaaacacaatgaaacaaagcaaaacaaacaaacaaacatgaaatggtagaaaatatttgcaaatcatatagtctgaaaaggaattaatatcctcttaatatataaaggacttctacaacttaacaacaacaaaaaaacactcaattttaaaaaaaattggtaatggactagaatagacatttctccaaagagaatatacaaatggccaataagcatgtgaaaagatgttaaacaatactaatcattagggaaatgtaaatcaaaaccacaataagataccactttacatcctttaggatggttaccataaaaagaaagaaaaagcaaaataaaaccaaaaaagcaaaatagaaaataaaaagtgttggcaaagatgtggagaaattggcacccttttgcactgttggtgagaatgcaaaatggtgcagctgctatggaaaatacacaaaaaaattaaaagtagattctcaaaagaaatgtttgtaaacccatattcatagcagctttacaactgctgaaaggtgaaagcattcaaaatgactgctgatagatgaatggagaaacaaaatgtggtacatatatgtaatgcattattcagtcttgaaaaggaataaagtcacaatggcaaagacatggaatcaacctaaatgcccatcagtgatagattggataaataaaatgtggtatgtatataccatggaataccatgaagccataagaaagaatgagatcatttcctttacagggacaccgatggagctggaggccattatccttagcaaactaatgcaggaacagaaaaccatggagaatagagggtaggaggagggagaggattaggaaaaataacttatgggtactaggcttaatacctggatgatgaaataatctgtacaacaaacccccaggacacaagcttaccatatacaacaaacctgcagttgtaccccagcacttaaactaaaagttaaaaaaacagaaagaaatctgacccatgctatagcatggataaaccttgagaaaattatgttaggtgaaataaatcagtcacaaaatgacaaatactatatgattctactggtataatgtacccgagactagttaaattcatagagacagaaagtagaacaatgattctgaggagatagagcaggagtcctcaactccctctcctcttccccgccccctgtactggtcaatggcctgttagaaaccaggccacacagcaggtggtgagcaagcattactgcctaagttccacctcttgtcagatcagcaggggcattagattcttacaggaacaggaaccctactgtaaactgcacatgcgagggatttaggctgcatgctccttataagaacccaatgcctgatagtgtgtcactatctcccatcatccccagatgggaccatttagttacaggaaaacaagctcaggactcccactgactctacattatggtaagtatgtaataataataaagtgcacattaaatgtaatgtgcttgaattatcccgaaaccatcccccaccatcctatccatggaaaaattgtcttacatgaaaccagttcctggtaccaaaaagattggggaccactcttttaatggatacagagtttcagttttacaacataaaaagagtcctggagatagacggcagtgatggttgcacaacagtgagtataattaacagcactaaatggtaaattagaaaattgttaagatagtacattttatgtctatcttaccacaattaaaaattaaaataccagtgctactgatgctcttagcagtgccagatgtttcaggtattatgctctctttaacaaaaaccacttcccatttctagtttaaactcatacctatgaaattagaaccctcctggggcactggaaagcttcaatctgtgtttttgaacttgttcatggtttttcactgaggtaactagtaaaattatctacactgttacttacggaaggattcacttcacagtgtgagtaaaacctcagaaatttggggagggttttaacgatgatggtcatttaaaagtaattaactataactcttcagtgaatgagaatattttggaagaatatttacatctaaattgagtttactgtcttatcaccataagatatatacataaaaaaattacattcagagccaggaatcaaaatcaggcaagaaccagggtacaaaataaattttaccaagtcaagcctaaatttcaactagaaagctagttaattatttgaaggactgaagatggtctgattcctagattaaatgcagttgagaagtgtatttgcactgagtgtatgaggcatgaaacgacagactgaatgttttggaacagaagctgtcttagtttaaattgctgtgaaaacagagcctgaaacaagaatttggatgaagattatttatttgaatggtgatcccaagaagtaggagtgagggctcaggaatgtcaagatagagtcagggaaagagaaaactccaacataagatgctttctcattgtcactcgtactggtgggaaactcagttctgctgaatctccctgtaaagcatccttacctcaatcattttatctcacatggcatcagggaaggccttggatcaggagaagctgcatgtgcttgtagaaggactctcagcacaaagggaatatgaggtcataaagagctacagagttgtggctaaatcaaaagtaggccaagaggacttgaagatgagaaagacagcttttgctacaggccactccttgcactactctcataaacttgttactcttagatatactccatcaccaactcaagatgatatttagccaaaatatctatgaaagatttaacctaatgataaactttaatttccattgctgcaccttttctctagtccacaactggcatttgttacctccttcttccactgcccagtgtatgactgaaatcttcatccaagaaagatatggactctgataacctttttttaattttaatttttatttttttgagatggagtttcgctcttgttgcccaggctggagtgcaatggtgcgatcttggctcaccacaacctccccctcctaggttcaagcaattctcctgactcagcctcctgagtagctgggattacaggcatgcaccaccacacccggctaattttgtatttttagaagagacggggtttctccatgttaaggctggtcttgaactcctgacctcaggtgatctgcctgcctcggcctcccagagtgctgggattacaggcgtgagccaccgcgcctggcctaaccttatttttattaagccatggttgctgcaattggaaatgtgatggtatttaggtccctgggtatcagtgtcagctcaatacctcctattcatttgtgtaccctactatacaatttagcaggtgaattatctagtaagtggacccaagtccctttggggaagaatcagggaatattatatacagtatacttgcactgaggttcctcctcaatcggaccctgctcctggaactaagaacttaatctgtttacaaattaggtaaaagactgtgattttctattatggtgctgaccttagtctcccactcatgtgttcttaatcttattgaatatatacatcaaacagcacctcaattgacagttaataccttgattctgcccatctctcttgtctctagcaaccctttgtttaataggcatttccaactatccctgtagttgaggctcctggattatcatgccagttgttcattaaagtaattgcatttaccctgcttctggtggttaaatgcttccacctggcatgtgcctttctggaattctatccctattgactttaggaagccccttttcatagaatcatctcctaccaacaaatatggcctacagaagacagtcatgcttaagctgctcagagctgtttgtgtatatgttcccttcccaggttcccatttattactttagtgactacaatgtcaacattccattctaccagaaaaaatattcagtattcctcttagaactgtccaccagaatgactgcatgctggagcatttatctacaacaatcccagggacgttaactgtcccacacatctgggctgagcttgtatgttaatcaaagagggttccagacaaattggggaagactaattggagagacagaaatagatgcatagcacacatttgagatgggatttgtcatcatgaagtcactcatataaaaccatctaccacaactgttgattagatcagacagatgctgaagagatatgctatggggtcctaagatatctgctctgcaggctctgtcataggagtaggcatggtgttctgcacattttctaatttttcatataaaggagtctgcataaaatttgggagagagaaaacctacaaaagcacagaatcatagatgggttagagcatgaggtcacaatcatgtgacagagttcagagatgaacagctctggaagacatcctaactctcccaacacatacacacatttctgtcatgaagagtggggtataggacagctgaaagtttggaatttggtggcatagggaaaataacctcatctgactcctatgtacctgattaaacttttactatatgttgcttatggttaataagaattctttggaaaagaagactacctgtcagttacacgagccatatataaaatctttttttaaaaaaatacttagaccaaccagacgcagtggctcatgcctgtaatccaagcactttgggaggctgaggagggcagatcacctgaggtcagtagttcaagaccagcccacatgatgaaaccctgtctctactgaaaatacaaaaattagacgagagtggtggcgggcacctgtaatcccagctactcaagagactgaggcgggataattgcttgaacctgggaagtggaggttgcagtgagccaagatcatgccactgcactccagactgggtgacagagtgagactccatctcaaaaaaaaattacttagaccattacagattaagctcaagctcccttcccttttactcgtaatctggtccatgtgtgctcctttctttctcagaggcatccactactgtgacttataacgagtcatgtgtttttcttaacatttatacacatttatgagcccacaggtaatacatattattgttatccattttcataagcatctctttcaaatgcctgttgtaggagtcctagctagaagatggagcaaactacgtctcctcttttgcagtagtgatattctcaggaatgccagaagatgggattatactgacaaagacaattatcctgaaaaactaattatctgggggtatttgtgaaaagaaacacgaaaatgtgtgttcaagtaatagattatggggaaatgggaagtccaacactgggttaacactagctcatcttatatttggggtcagctagtgttgtgaatcaatccagtattaatgttgcaataagatgcaaagaagagtcagctttattgcacaaattaacagaaaggggataaacaaccacagaaaaaaacatacacctgaatcctttcatacctccatgtttctgtgttgagtagagagagggtgaaagtataagcgtcctcagtgctgtgtgatacaaagaaggagggatggtgtatgtgaaggaagaacaagccaaagccctcctggcatgaatgtacatgggagtgagtgggaaagacactgtccattactatataacatttattctcaaaacatggaactgagatttaacagaatgttattatccttttagtctgaatcaattattcatatcagaccagaatacattgtctctcaatttattaacagtacccagaaattttattctttctgaaatatttatttagaatctcttatgttccagtcacaattttcagaggcagtttctgaatatatagaattctatatataatattcagaattgtattctatagttacctcaaaaggcaatgcagggattttaataccttacatgagataaaaatatgtgaaagcagtttgcatgatctaaaacaggatttagcaaactttttctgtaaaaggccaggtagcaagtattttcagctttcttggccaaatgaataggtggccagattttagctcttcaattctgctgttgtacaagaatagccatgaacaacacacaaataagcatagctgtgtttcaacacaactttacttacacaactgttagcagagtttagaacacaggccatggtttgccaacccctacggcttcttcctcccataagttctcctgaaaatgaacacttagcaaataatgactttatgttttcactttgagagcttttcttcttctgatgtccctttaagaatatgaagtaactcataaaaggaaaacgatgtttgatgtgatctctaaacttaggatcactaattcattcagcagttattcactgaatgccacatttgtgccaagcactgctttaagtgctggcaaaatagagatgaacgatgcacaactggttctcaggaagcttatagttgcatgatgatagacaggtaaagagaaaactacagtctgctattgagagaggttgttcaagactcaacagttatggcacactcttagaaaagccctgtgggaacctggtgctcaagttctttgagtgtaggaggtaagaaggttgttgttcacctggaccatgaagattcatatttcctgttttgcacgactcaaggacaactctatcctgtgctccatttctcttgtgggcagtaattctggtataccttgaaggatgcttgctcttcaaagaatcctcctaatccttgacgtgattctgttcccttacttggaaagtgattgccctttgaaattccactctaaagtgatgctgagtgccaggttacctgtattcttgttttcctgcaccattacctagccttagataagtctctgcatctctttgagctttattattccacattttaaaacgactgcttttgagtgctaaaggataaagagcagatacacagaatagaagaaccggagaagaatcaaaaattaagaaatatattctatatgtgaggcactttcgcttacaatgtcatgtacatctccagcctgaacctgagaggatttattaataacaccattttacagacaatgaagccgggtcttagaggcttagcaacttagctaattaacaacaagccaagatgcaaatttaagtctgtgatatcttagatctctgccttctttccatatgctccttatctccccttgaggttcataacatccaaagactatacactgtaatcacagactaagtaaaaaaaacaaagcatgagaaaccaaataataagagaagttaaataacaatgaaaaagatgctacaaaatatatgtgtttaagcaggaaataaacattacacaaaatatggaccacatgatttcagtgggttgtgatggtgggaaaacataataaagagtagatttcaactgagtcatagaaaaatggtttgagtgtgtgtgggtttgggagtgtgtgtttgtgagagagagaggagagagaaataattctgtcattctagttttaccaggtcttaaacatgacatttaacaagatagaatttttgtgtagatttcctggcatctaccagtgagattcagacaaattatactgactggaaacctgtttcgtcatttgacagatgtggcttcaatccttaccaccttattcactaactatggatccaatcctttttgagccttaattttttacctctgtaagactgaagttattatatgattcaatctataattcaaagtcactctctatggtccattaatcttctttgaaggccaaacaggtaagctaaagaaaaatgtgatagtaattaagaccactgcatctttcagggttttaatggtgatattaatgtcttactttttccagggttgtattgttgcacatgatttgctattatgaaacagaggggaagtttctagggttctgacctggtatttttccttctcgattatgtcccacacctatgaaatgctatttcatagcctatgtgtgagcttatttcagtgagcccaggtgggaattcagtcagtgttagggtatgtttattctacctgtgtattaagaagctggaggggacggggcactgtggctcatgcctgtaatcccaccactttgggaggctgaggcaggtggatcacttgaggtcaggagttcaagaccaacctggccaacgtggtgaaaccctgtctctactaaaaatacaaaaattagccaggcttggtggtgcatgcatgtaatcccagctactcggatggctgaggcaagagaatcccttgaacttgggaggcaaagtttgcagtaagccaaagttgtaccattgcactccagcctgggtaacagagtgcaactcgaaaaaaaaaaaaaaaaagaaaaagaaagaaggaaagcaagcaagcaagcaagcaagcaagcaaactggggggacaaaaaaacacagggtgggtctgtagaattactgtacccattgacagatagctttagattacatctctattgtttaccagatcctcatgaacctccactcaaactaggggagcccggtgctattttaatagctctataatagctccataattagtattaaccaagaggccatgtgtagtaactgctgaaatatttggtaatttctttttggtctgtgctcagatatcctgctaaagacacaggtcccttttgagagactttggaggaagatttacatatataaatatggcaggatccttcctcaggggtccttccccagcttcatcttcattgaggggatgcaagtctgaaatgggtcagctctgggtgacattccgttgtggaattcaagctttttctctacacattatatctaaatactttcagatcttaaagatcaagtcatactttggtaagatgcctgtgtgttttattcttagtgacatcatgatatgttagccaacacaaaataactttaaaggtgatgattactgaggccctgctctaaccttacagtaattgtccttaccttatatccgataattaagcagggatacatctccgccagtccaggattccattaaccccactgaaatcagaaaatctatatcaatatcagcagcttctaccatcattccagcatacagaggaaatcctcaaggatttgtttcctgaattaaagcacttttggatgtcttagcaaaataaatatcattttagccctataaggagacattctggagaaaggaaaagaaggtaggaaggttgctgcaagaaaaatcaactccaatatttctgtctccttaaattttgggatttatttctttcaccagggaagttctgggatgtaaatttcattaactttaaatcaacattggctttagggttttttcaaccaatcaagaaaattgctagaacaacttctaactgttcaggctaatgtattgaaccatcatctctaagtacatggatgcatcaacatagcttcaaaccaacattattcccgtcctctttgacctatggattttagaattaatttctacatatatgccatgtgtttttctcatatcacttagcaagaacctgaaattctctaatcatgtgaattattgtctgctgggttagactttgcccttttactcccaggatgatgatgagctctttctctagttttcagtctaaagacaataaggagtagttatgaagagatttggcatctacgtttgagacgatggcctcagatgtgataattacttgcctttaaacaggaaaggctactcttttcagacagaaaaggaggattgaatttctctggaaagagagactcagtgggatttggggattgaaggttatcacgtcccctaagtgcaactaaattcctctaccccaaatgttagttctcgttccttgtcattcaatgcttgaaattaaacataagaggcttgacaaagatgtaaactcaacttacattgcagcatcaaacttagtatttattttaaactgtattaatcccgtgtctattaaaagaattattttggggggtccatcatagaatatatccagttctgtatcttggactgagagtttagtgccctcagcctgtaatttccttctctaaactcttcagtgcagtaagaaatagccagccaattgcatgattcttagtgtaaccattactaccataatggtcaagttcattagcacttggtctccaaatgccttatgtactttactccaagccaccactgataatttaagtactttccatggattatcagaatcccatttaccaatatcaatgagctcacttcagcttacaagtctaatcaggtaagataaccaattctattttccaaaatctgagagacagttaactggaaccattcctgttttagtttggatcccatcaggaaaacgtatccattctgggtattacaaagagagtatcttttatattaacaatggtttacaaatatgttggaaggaccggaggagcaaaataagaaggggtattagaagatgagaaagaaagaatatctgtgtgtaacactcagctcaagtggtaaattccctgggctgttacccataagactgccttatttatttttggaagtactatagttcctggacctggaagagttcctgaagagttgctgatgagctcagggtttctggagtttgcagtcactttgtccctcctgctgtaacagggtgagacactttgtgggagccaggaagagagaccttctcccttcctcctgccttctaatctcctaccagtgcttcccactggccaactttaaacacatatataaaagttatattaatctgggaaatgtagggttatttttttctattactccagtccagcagttcagagcagagtgtaaaagttatgggtacgggtttgtcatgtttgatattgagtgtcaacttaacttgattgaagaatgcaaactatcgttcctgggtgcgtctgtgagggtgctgtcaaagattaacctttgagtcagtgcatttggaaaggcagacccaccttcattctgggtgggcacaatctaatcagctgccagtttggccagaattaaagcaggcagaagaatgtggaaagactggactggctaagtcttctggcctccatctttcttctgttctgtatgcttcttgccctcaaacatcagactccaagttcttcatcttttggactcctgggtatacaccagtgatttgccaggggctcttgggccttcagccacagactgaaggctgcactgttggcttccctacttttgagtgtttgggacttgggactggcttcttgactccttagcttgcagaaggcctattatgggacttcacattttgatcatgtgagtcaattcacctagcaaagtccccttcatatattcatctatcctaatagttctgcccctctagagaaccctgactaatacagggtttgagcaacaatctttgaatactgacaaattggaaccttaagtatatgatttaccatattagactttattgtaagattcatattgtaatataaaatctatggacatgattttttttttttttttttttttagatggagtctcactcttgttgctcaggctgggtgcaatggcatgatctcgtctcactgcaacctccacctcccaggttcaagcaattctcatgcctcagcttcccaagtagctgggattataggcatgagccaccatgcccagctaattttgtattttttgtagagatggggtttcatcatgttggccagactggtttcaaacccctgacctcaggtgatccacccgccttgtcctcccaaagtgctgggattataggcgtgagccactgcacccggtctggatgtgatttttatttgacatactaattaggactatcacctctcagtgagacagggttcaaattatgactaccatatagatttagttttatgactttcaacttgatatttctccttaaaggggctcttcgtttttctatttgtaaaatgggggatatatgccttattaagtggtgtatattaaatgcgtcaacagccatgacacataaaagtcctcttctaatatttgtgctgatggtggtgatgatggcaatgtccatgaagatgtcagcattggtagtgatgatgctgaaagctgatactgatgattttttctctatagtgagagaattcattattttgcttatattttcaaagtgatcaaagattctccaaatgttaataattactactaagggtaataagggactactgagagttttgagaaggcaagcgacataaagcagctttgggattattaacctaatcatggcactatggaaggatgttgagcagaggttatttatttatttttgagatggagtctcattcttgttgcccaggctggcttgcaatggcacggtcttggctcactgccacctctgcctcccgggttcaagtgattctcctgcctcagcctcctaaggacctgggactactggcatgcaccaaccacgcccagctaattttttttttttttttttttaagtagagacaggtttcaccatgttggccaggatggtctcgattgcttgacctcatgatccacccccctcggcctctcaaagtgctgggattacaggcatgagccaccacaccctgacaagtggaggttaaagagaatgatacaagaccattacagtcatttattaacaattctttgctaggtattaaacaagttataaagttttaaattaagaaaattttgatacaaggtattccctactctgaagaaattatgtaattggtatgtgattgagattattcatatgtgatgatatttttgaaatataagcaacagatcttggttcctgagtgtgagaaatgagagagagtggacattaagtaggtcctttaacagaaatagcaaaatcaggagtaaatatccagttggaagatacagtatcaatttttatttcctccttcctttcttttctgaaaagagaagttttttgctatttacaatataagacaatttattttgtattttaacttttctaaattaaaaaatctacctacttattccagttttataaaataagcattgaagtcaatttttctacattttgacacttcccctctacaaatttttaaccttcacagatattctctatgttagtataattcagtcttatgcaggagaacaattcagtctaatgcaggagaatacctccaccatataacgactggtacaattgtcccaatcaaggctgggattgatgcctagcagcgacaatgaagatggcaattatccaagctctatcattgtgagcagcatcacttactctctttgaagatagagtgcaaaccataaagatgatgcattccagatgcgaactttctcaagaactataaagattccacctctaataacccgaagtgtcagaaatagaaggaatgcccttggcagagaatatgctgtgttcgtttcgatccagacacctactgctactttggtatccttcaatggatttttatttaatttggctcttaaaacatcctttgaaggagtgtttgctcagctcagggatcctcctagcagcaatgcctgatcactagcaggctttttattggctcttcatgacaatgcaggtccctgaacttgtctgtttccatttgtaagtcaatccctacctccgtagcagccaacaggtaatttttttctttttcccacacagaccctatggggaaaaaaggaagctgcaacattgctagcactttaaaaatacagtagtcaggcagaaaaaaaaaaaacacagtgttacttagtgtctttttccttgacaaaagccaagtgggaaattctgctctgattgaaatcatttaggtaaacaacaataacagaaacaaaattatatactacacaggcatacacataggcaatcacaaaaacacaatgtagacaaatatataaacttaatcatctattgacaatggaggaaatctttgtggctctatcagctgtgaatactatataacacccttccttaaaaatatgttggatgtgtgtgtgtataaaattgggtataggctaacttcttaaagttagaaatataaaaacctttctagatattgtggattcttctattcatgattttctacatggctctctcctgatttcttttaaacaaaagataactgttcatcatatccataatggcttccaaatcattgaagagaaaaatatttaagtcagttgatcaatttcctaaaaaaaaaattaaaaaaatttttgtctcatattgtagtaggcatgaatcctgaggcataaagaaccatactttttcccactcttaccttggtacaagtatcaaaccattaaaaaacttcacagtcttactatcctaggaagcttcaagaaatggaaacacaaaattctgatacttctgggaagctggcttatgtgaccatcattggatcaggctctgataatgcaatgagaaggcaaagaacttacatcgtttctgctgacgtgtaaaaggaagtggtacactagtaaaggctcaacaatcaactgtctggaaaaaacaaacatgcagtttttagtgttttttaatttcccttgtgcaaatattcctatcaagcctgatttcaagctatcacatggcatcagtgaatgcaaaaatggagatgagaagcacataactggctcttctaagtcattaggagtcagttcaagcacaccactgaaacatcttcagaaagggactgagctatgttgagtgtcataatttgaaggacaaaacatcttttaatgtttttcccgcccaactcttctacagaaagttgaggctaattttctctctcagcacagtggtgctgcttggtaggcaacatgataacaataaaatctaaaagttttgggcataatcatgtttatctactttcatggcaaccctaaaatggcacagctactgaaaaaaaaaggttcctggcactcgtaagaatttcctttgagattatgggacttattcataaaagagttgctttgtattctctattaggacaagacaaattagagaggttttcattattccccaaacccctgttactcaaagtgtgatatatgggccagcaatatctgcattacctcagagcatgttagaaaagcaaaatcttaatcctaaacctagaacaaatgcgtcagaatctctattttaaaaaaaaattcccatatgttttgcatgcacattaaagtttgagagacactgccctaaatcactgttttaaagtttttcttaggtagtatgagatcttctgtttcattaaaacttacacattctttctgaggtgaatctttgtaatccaagtctttactattctggctgagtcagagaatatggatgtatcaatgtagtccctcctcagttctggcaactaaaagcactgccaatatttaatgggagtccatactcaatttagtgtatatgacaaaggctaactctcacttttaggaaccagaattgaaggtgaaggttgctcagaatttcataatgtgaataccagtagaaaaatgactggaaggaaatatatcaaaatgataataatgtttatctcaaggtagtgaaattttaggcactttcttcttttcaaaaaatatcttccaaattttttacaatctggtttcattttaaaaacttcaaaaagaggccaggtgaggtggttcatgcctgtaatcccagcactttgggaggcctaggcgggcggatcacaaggtctggagtttgaaacaagcctggccaacatagtgaaaccccgtctctgctaaaaatacaaaaattagccgagtgtggtagcatgcacctgtatttccagctactggggaggctgaggcaggagaattgttcaaatctgggaggcggaggttgcagtgagcctagccgagactgtgctattgcactccagcctgggcgacagagcgagactccgtctcaaaaaacaaaacaaacaaacaaacaaaaacttcaaaaagagagaaaaaaacataaaatagaaatcctctgtgagtttttctatagatgcaatcaatgggtagttatttatgatttatgatgtctttaactcctacatatcagttattttattagcgtaattaaatattcctaattatttgttttgcacctgttctttagccacagaactgcccttctcataaaagcagggaacatttctagcatgccttctggaaataagtgggtacttaataaatatttattaaattaatggaagacaaggagggataagtagtatgatttggggaagcttaaccagagtcagatatacattttaaagttagtgaaataagattttcctattctcatttctcctttctttcaaatcttttattttcccagcctccacagcttattgcccccttttgggtctcaacgtcttctctctctctccttctctatctcctctccaaatggaccttaggtacacagcattagataaatcagaattcttaatttaggcctgactcacatcatggttccacacctgtaatctttccctttatttacaggtttattttgaataatatacttaacactgtgaatctatcgctcaatctattaagaacattgacagtaatctaaatagacctatattctccctccctgttttcacccacagtaaataccatgcttaattttatgtttattccacaaatatttttaaataattctatcatatatataatctaagctaaaagatatttaatgttattattcttgaacttcatgaaaaaggcaccatgctgtatatagttcccataacttacttctttcacatcatgtaaccaggcttcatccatgttattgcatgtagatggagtgtattcattttcactcagtatatctcagctgcagtggtatatttcagccactgtcttcaaaattagacaaatggtaatgacattgttcctggcaaagcctaatggcctgttctcttttccaaaaaaaatatgttcagaaagatatatgatctaccaactatgaaattctgtagatgtgatactttcttgtaacatgaaaaataaggaataatttgttattttttaaatgaaccatcttatatttgtaaggcctggaatagcacttgatactagataactagaaatagtgggctaatttaggagaaatatttctggttttaatgttattcagtatcatatatgggatggttgttgagggagatgaaaatcttagactctgactgcaagtcatatcttcttcaaaccactcagtgtgtagaaattttaaacctttctagctccaaatatatctgttttgtttcatttaaattaattaaagtattcgttcattataatttcaggatatttgaactccccacaagaccatatgaaagagaaatgatatttatccttgagatgaagtaacaagtatggccagaatcagtgagccatagtccaataggctcaagtgagataggaacattttgtctacaataacatttcaatcactgaatatcataacagacctggtatcagtctccattctgaagaaagaaaagtcaaaagatggaccaaaacaagatcatagatttcaactgaaaactaaattcgttgatatgtcccttgcttagtccacaattgacgttgtctcctaaaaggtgcggcacatatatctttgtatcagtttccttctctggattacttgtgagtcccttctagccattcatacctggtaattttatgcactcctttcactcttcagcggtagggaatgagaaggcagactcaaattggtgagcacgcgtcctttcggagctttcatccatctatctatctatcatctatctatctatctatctatctatctatccatccatccatccatatttttttttttgagatggagtctcgctctgttgcccaggctggagtgcagtggcacgatctcagctcactgcaagctccgcctcccgggttcaagctattctcctgcctcagcctcctgagtagctgggactacaggcgcccgccaccatgcctggctaatttttgtatttttagtagagacagggcttcaccatgtgggccaggctggttttgatctcctgacctcatgatctgcccacctcggcctcccaaagtgctgggattacaggcatgagattataggcatctttaaagagtccaatattcctcctagactgctgtgaaattcaaggaggaaaccttttcataactattttaacaaaatgcttttgctgttgttgtgaatctttttctacatgtatctacagacatactgaatacttgttttcttatgaaaatctgctcctaatattagaaaatcaggtagggtaaagctgagaaataatgtttaatctgggaggcaatgagtatggcctgggttgaattcttgttttaccacaaatgaccactgtaatttgaggcaggagactttaccttcaaatgttttttttattttttcatctcaaaactgaaataacaatagatacctcagatgattattgtgaaagttaaattacataatgcttatgagaattcctagcatagcaggcactccataaagatttgtggattctgaggagggccagtggaggggatacttggagaacttttaggtttgattttcccagcacaatgaagtactgactctcattttaatgacaagtgtggtgaaggcactttgctcaaggaagcaatttgcattaatgttaattaattaatgataattaatgagtagttttttttaggttaagtgtccaaggccagatgtttgcatcagttccatagctaggtatgggagtaattctcatgccctccaaagggctccagcttcattctttcatccggagacagccctcaagctaaatggtagcctgaaaagactgtcacctttatggtagccccactctacactccctccgtacaagatatcaggcctgtggttgaaacttcaggaacagagttcattccaaatatctcagcacatctcttagagccatcaagccatcttgttattgccacctgcaacatattcttaacaccaaaccaacaaacaaatgtcaaaacaacatcaacaacaaaacatcgaaactcttctccccatctattcaattagaggtgtcatggcagactgcaggggaaatctcatttttgctctgaataaatattgctctgggttgtttgttgtttgcagaacactcatacttttctaattcctactttcttacccccaagatatgttggtcaagtggcctatatatgtatatattttaaaatatttctagattttttgtgcgtgtgtttgtatgcatatatgtgggtgtgtatgtataaaatcttgaaaacctctgccacatttaaaaatgccacaggaaaaaaatattcttaggatctatgtctatgtctagatctatgtaagattgagaaccactgccaatgttactaaaaaaaatcattaaaatcatttttgtgcctcagtttctttatctgaaaaacagggttaacaaaggtatattttaaaaagtagagataatgtataatgcaaaaaggatctggcacaaaggaagtatccactgtatattgtttattcttattcttgacagtgtgagaaatgtttattatacgggctaagtaaaagtagcatcatcccagatatataaaagacataagttacgtagattcaggcaaaaataccagcaagttgccctggatatagagtctgttatttctagaccaagacattcatagaagggcaaaccgtcttacttgcaaggaactttggaactcatgtgatttagtttcctttcctatgcagaaatccccctttaaactatggttctttggaacctaagccaataaattaggttcagagattatctggagagcagatcttgcccatactttaccgtaaggggtaaggattaaagtctccattcccagtgggcatagtttcaaccagagaatgccaaagatgctatagaggaatggaggatttaatccttaccccttacaatagcccatggttaagtttaacattaagatttgctcctggtaaatgttattggggaaacaaggtttttatattcccaggacaccttgtggcaatctctctttccccagacataaagctaaaggccatgtggtttttaaattccccactttttccataataaaacatagcatctggatataatctgactcatcattggcttagagatgcaaatgtctacggatgctcggtgcagatactttttaaggtaactggaagtaattccctatttgactgaaactatgtaataaaaataagattttctggtgccaaagacctatgtaggaggctctttctgcttgcacgcaagggaaggaacagagaatgcctttaattctggctttgatttaaatctgcatcaccatttaccaattgtaagccaatgagcaagtcattaaaccactgtaagcctcagtttcctcatttgtaaaatggggataattgtagctgcctcacagtgatgtacaattaaatggggataatatttataattagagtatctgaccaaatgtattaaataaatttagctactataaagatctaattaaaggagagttattattgctattattatatttattctctgtggttttcaggctgtctattgaccatatatatgctctgcagggacacggagaactgtattttctcagccatgctgtggagccaaatagcagaaacccaggcagcctgtaaggagaagcaagacaaattcaagagattgcaaggggatctcgttgaactgagcctggaattacatgaaaagaaatcttttaacagttatttcctattcaaaaaagacttggtgcattattcaattccatcgtactgggagctttgctccttcacattcatgctttcaaatcttactcattactgccctagcctggatggggtgaaggaagctggaaaagaaattctgggcagtagatcacaaaggagatatttgcagggatgagaatagctctagcttcctacctacatttgtgagttacttttaacttttcaaaatactttcatgcctaccttctctattggggtgggtagcaagcaccttggacccctagatagaaaactcctagataatagaacctctaaacccctgcctactcattcagtttcttgaacacattctgaataataagaacactacagctattataacagcataatttacttagcatctgccacgtgtgcaatacgtgctgaatatctcatatacattgtctatatagtttttaaatcaactctttgaaatagccggttttgttttttcatctcagtgacttggtataagggtcctatagatactaagtagcagatcttggatttgaacacaggcatgtgacacaaaatttgtgctttaacaactctactaaaattctgaagacttcgtcctatgtttggaaatagttaagggatacagagaccggtagaagcctctgtcctgtgctacaagaacagagcagacccttagaagcagaataacatttcactgtcagtgtttatttaagtggtcgaagtcaatttcaagagacatagagggcagagaaagagtgattttaaaggacctagaggagaagcaataaatacagctgaaaacgtgggggacaggaaaccaccatcagagtgtaggtcagctaagtagttaggaagtgttgcatgaaaggaagaagcttcagtaaaatgtcatctgtgacctgtttaggtaactacatatcctgctaagttaaatagatgtcagtcccagccagctggctttcatttgggaaaaaatataaataaagaagtaacccttaatgagtcagttcagaatttgtggaatccttcagcaaaaagagatttcagaggagtagaatggggaaagaataggagtatctcttcagaaacaaggaagagtcactcagaaatgttaattgacttgcctcagatcaaaatttctctgggactaactcaggttacctgggacattaccttttgtgctaactatttgagaattaatgaaaagaaaaaaaaacctaagttctctaaagttaaaatttttcatttacctataaccaaaggactcattcgttcagaaagctgtgggacgcctttgtgaacaatggatgcaacagctaggcctggatcacacgaattacaatcaacccttccttaccctatttgtgatgtttctgtgctaagggaaggcattttcacattatcttctctgttctcatctgagtcttatgccttttatattttgtgcctcttcttaaattatacctctttctcaagattgtatcccaccagccctgtgggcccttagctgtcctcagcaagctgtctctattccagttcagcctgtccttcagcctgtccatcaggcttctcaccatggggttgatgaaagtctcatctccccaagaccatgctttccttagaaccaagtattgtgtctcttttatacagaccaatagtacaccaaccaaggatgtactcaataaacctttgctgattgactacagcattggctttttctcaaccagaaattataaaatgttaaaaaagttgtgctgaaatacagcatttactgggctaaagggcaagtttggctttccagtaagtttcaactttaatcagatcacttgttggggttgggtaagaatgtggctgttgtcatgatttggggaccctaatgattccagctgtgtctactcagccaatggcacagaatccgtgatagccgaggtcatgaagagtcaccttcctgatccgaccccctccatcttggttctgctgctattacacttttctataccacctcttcttatccctagcagatgacatagaaatggaatgtattatttggaagcatactgaaagatacagtagattcttattgtttatggtagtgatattctgtaaaatcaatgcaaacattgaattagtgaatactaaatcattgttcctagggtagatacaggattaggtttctgagagctactatgcacaacattttctgcaaccattcaatacataaccctgtttaatggatgtttctgttcagacattatattgtatattgttgattcattaacatcacatgcacagccaactgcactatttcttgtgcctgaatgaagcttttctaacatatgcaatttctctgtaaagcacatcaaagtcttcttgtgctttgtgtcactaggcatcacttcagctctctgcctggggatcattttaaatagcaaaattaccaacataaattacaaaaatacaaaaaatatgtcaccaaacagactgcgaaaagaattatttactgtactagaacttaaacaagaagacagagcattgtctcgttggactgctgctgggaatgtgcactttggtgactcaaattttttgtgactctctgcatgtgcatgtctgtcaacgaccatgaaggtgttcaagtattgatttgtgagtaacaaacaaattttggcaaatagatgaattggtaaatacagaatcaatgaataatgaggactgaatgtacctttaaatggtatctactttcatttggcatttttatgtcttagatctggggattctccatttatccacttcagtgaaatggcccatgttctcttacaggggaaagaaaatccatacgtaatctggaattcaaacgatctcaagcaatgagagccattttaacatttgtaattatgctttaccgccaaaagagttgtttgggctttatagaaattggagctcataagaatgtagacttcgctatcatagagatctaaatttaaaaccagattatgctactgattaggtgagtagtcacccaccttcttgcacagaagctgtcttatttctaacgacaaaatataacaatatacatattttttgcagggcttgaaagaacatacatggaaaatgcctgccatgagggcacactgagtttactctttttctttccttcccattcaaggtattctggaatgaagcatatttagtcattgtgttttccacaatgctgaggtggaggaacatgcagcctgagactatgtataggaactggctattaacacaggttaattaaaaaacatatattgtgttcttctctaatcaaaatatgattattaccaagaggtgagtcttgtttcaagcagtggggagggaatgaacagaatcatccaaattacaactataaaaataggtatacatttggacaaagtctgcaagagaatacacagaaatcaaaatagttgtttccaagcgatggaattatggaaatttttttcttcaaaatgttctcaaatgttatacgttctttttacaatacaaatgcagtgcatatgaaaagaattataatgaatgaagcaatcagggattgtcttgaagcaaagcagtaacatgaaatcaagataatgtagatgagagatgatttacattattttgttcccaccaagcgaagggcattttccagaagcctaagatggtggatcaacaaagagtgttgacaacaacacagggtaaagagaggtgagaagggggtacaaacatggcaggcccactatcaacccatttccagactgtttctcttgcccctcttctgactttcagcattgattcctgttaatctgcactttattaacaactttttccactccatgcttccgtcatctcctcttccctacaccaaattgacatgcaacttcccaaggattgcctaagactagtcagtacattgagcagaaatgataggaagcaagcccctgtccagctttcagaggggtttagtattgcgacgtgtcaaaatctgtggggagctgccggtggtagaataagcaggtggggagagaacggaagtttgtcaggctaagcgtccagattgatgcattctattccatgctattataaatattcttcttttgaaattgtatttgactttgtattggggggagaaatcataattgagtttaaaactgtggatctttgtcctgtagtatggtattaggacttaaattctatttccatgtacatatttcatccaataaaatttaaaatactggctcaagcataactggtatataattttattgtcatgatagccaatccgttataaattaaatcaagctttcacacactaatatcaactcacacatttattctaactaccaaatagtacttgattctagacttgtcatatcttttttgggccctgaaaaggtattaccatgtctattttaatatttcatctattttttagaactgttatttaaatttcacaagacctctagttgctgccctacatatttttttaatttatatacaccgtatattagggcctgtgttaaagtctggatactgttggacaaaatacaacaatttggtgcccagaaaaatgaactgtgaaaatcattaatgcttttcacaaaacagtgtggcgtttgccttataatcacatgcaacaattaaacatccatgccctcttctaacattgctaaggacatgtgatttgctctgtccaatgaaacctgtacagaagtgttacttctgagaggtgaacattaaaagccagtgcacaattacccactttttcccttcccatcacttcagtgattcaaaaactcttggcaagatgaagccttggtcagtttggggatgtgagaaatcaagaggagcagagctttctgctgatctgtggtgagcacataccattgggtaaggaatagacatctgctttggtaagcccatgaaattttttggagctattcgttaccacagcataatggagttttcttagctgaattataatgaataaagatctgagaagtttctcaagtgttattcatagcttttagaaaaaaatgtgttatttagcatttgatacaaaggaaatatatatgaattgttcagtcatcccttggtatctgtagaggatttgttccaggaccctcccaaaataccaaaatctacagattttcaagacacttatataagatggtgtagtatttgcatataacctatatacatcctcctgtaaactttaagtcatctctagattatttataatacctaatacaactatcataggcttaactacatttttgatccacggtttgttgaattcatggaagcagaacctgtggatccagggctgattccatatgtacgctaataagtataaaaatgcagcaaacagccataaacttatcacccaatttaagaactggaacattcatacattgtttgaaactgtctttaggcttctcctacatcctaacacatggcctcctccttagatataagtatttgaaacaaaacaggttagagaaagtggtcccaaccattttggcaccaaggactggtttcgtggaagacaattttttccatggaatgggtggtgagggggtgggtatggttttgggatgaaactgttctaccttagatcatcaggcattagttacagattctcataaggagcgtgcaacctagatcccttgcatgtgcagttcacaatagggttcacgctcctatgagaatctcatgccaccactgatctgacaggaggtggagctcaggcggtaatgctcactcaaggctcaccccctgtgttgtgcagcctagttcctaacaggccatggactggcgggtcctggtccatagcccggggacaggggactcctgacataggagactgcatttataatatcatctttgtaaagtactcattgtcttttcaatcacattctttgaatatatgaataattactaccactactgtgatactatggtaacaggtactgagcacttactatttgcctaataatgtttattaactttttatgtacttattcctttgtatgaggtaggatctatcgctaggagtacaggcatgagctaccacactgggccccagagttctctttatatagctggtttagtagacagatagttactttcagaatgcatttttaattgcagttgggtaaaatgcttctactcattttaaagatgaaacagttaaaggtccagtattaaatttcttatttaagatcagatatattaacaatgacagatctggaacatttggttccagtattagattctctctgtggctgcaacaaattaccacaaacttggtggcccaaaacaagagaaacttattgtcttatattggttcaaaatgggtctttctaaaacaaaagtgttggcaaggctgaattctttccggagggtctagggaagaatccatctccttatccttttcagccagtaaggccacctgccatctttgggtgtggccccttcctccattttcaaaactagcaccttagcatcttcagatctctctctgactctgactaccctgcctcactcttttacttataaagacccttgtcattagagcgggttcacacagctaacccaaaataatttccccatctcaagatatttaacttaatcttatctgcaaagtcccctttgcaatgtaaggtaaaacattcactaggtccagccattaggatttggacaactttttggagaccattattctgcctgccacaggttcaaaacctattgtgttagtcactatgctatactgcctcttgggggatgatagtcctacagccctattttgaagtgtcatgtttaaaatcaacaacagtaacaactgcaattaaaaatgtattctgagagtaaccatctgcgtactaaaccagctacataaagaaaactctgggactgagtgtggtggctcatacctgtaatcctaacactttgggaggctgaagtgggagaatgcttgagctcaggagtttgagacaagcctgggcaacatagtgagaacccatctctataagattaaaaaatattaaaataaaaagtagaaagaactctgatctcctaatttgaatccaatctatcaatttttaatgtgttttataatggagttatagacttatacaggggtggagtcctatccgtgccattttttattattaacaatattttatagataaagaacatgaggacgtttaagtaccttgcatgatataacacagtaaataaatggtgagttatctcatgacacataaattttgctgaacaagtataataggaattcattgttgggagtttgaggaggaataaatcacaatgggttggagtacttagggacattttaattcagttttggatattgaattgtaccctggaggaatatcaagatctataattagagaatttttgtaattctaaatattaacttcagtaatgtacattgctgtcttactctgggctgggggaatgtgctaggtatattcacatattaaaaccaacaaacaaaaaaacttgatgagatgactaaaacccccagtcattacacataaatatgcttgttttcttcctatgtgaaagaagactctgaaaagtgaagagaaaaggcagactagctcaggacctcaggattcaagcaagaacatggtgttgagttctttgtgtttctttttgtcccttatatgccaaccggaagctgaagaagctggtaacccagaaatgccaaaacaacaaccaaaagtctgaacaaaagcttgttccagaaagggaatagactaggaaaaataaaacttttagacaataatcactctattccaactaaacatgacagataaactgtggcctccacccacacccataccacgaagggcaaagtggggagcctagaccctcctgcttcagaggctattgtgaggtgcccccagacctccaccagagaattggcagagacggttgagtgggaacccaggacttttcatccccactggattatagcaaggtcctcctgccccctgtagtgtcagcggagaccacgagtcctcctgctccatgtggtgtcaagcggagaccacttccattcccacaactatccgtaatgaagcaatgcctgtctctcctttggggttctcttagagggtcaaaggaggcttaatgaagtcatgactttcaccactcccatggtaaccaagcgtaccacctacctcccattacggtgtcagtggaagccttgaggggcatagtaaagaggcattcctacctctctcagccagggagatgccagcggaggcctagtgggagccaagactcccaccccaactgagagtaatgcggagcctttcacttgggtgtcaggggaagccacataagccttacataaagaaaggccaaaattatagaaatggataacagattagtagttaccaagggttaagagatagatgtgtgtggctataaaaaggcaacaagagggattgttgccataatgggagtccagtattttgtatcttaagtgtatcaatgactgtatctcatctgatactgtattagtttttcaagatgtcaccattgagggaaactctaaagggtataccagacttctctgtattatttcttataactgcatatgaatctataattatctaaaaaattttaaattatgaaaaaaatcttgatgaagcatagctattatacttagaaagccatgatattgaggtaacatacagaatttttgtgttgttaagacagggtctcactctattgcctaggctggagtgcagtggtgcaatcacagctcactgcagccttgatttcccagactcaagtgatcctcttgccttagccttctgagtagctgagactacaagcatgtgccatcacacccagttgatttttaaatttttatttttagtagagatcaggtctcgctatgttgctcaggcgggtcttgaactcctgagctcaagcaatcctcccacctcaactggacaaagggttgggattacaggaatgagccaccacaaccggcctacatgcagtattttgattaggagaccatgatataggtttgttctggagaggagtagactcagatactccaaattttaagtactcaggaaagtgattattgttgctccgtggtttttcttatgccaactaacatttttaaaagtctaaagaattggcttgaaatttaaactattagtttagtgtataaaataagattgccaaaaagcctggaatattcaaaatcactaatttgtgttatcatccctaagaaaagatttatatagaaagcaaattgtcataaaagccttgtatagtaaatatgcattcaggccatgaaagaatggttgtcaaatgactggctcccatagcttaaggaccctaaggcactgggggaatcctctttagagtttttgcaaaaaccattcaccactttctcctccctgttttcctttcactttcaataccacattctagtgacatgttaatactatgcactgttgatgtcttactgctctcatgccttcccaagtctattgtataggaagggaagagaagggactaagctttgttgagcacctagagatccagtctctgaggaatcaagtcatgtaatacccacaaaaatcatccagtaggtatattactattttacacatgagcatttagaaagatttagggtgtttctcgcaaactatcagttaattattatctgggtctggcttttgctaccttcttattagattctcagagagctaattcacctccaactctgggggtgttgccctgctgttacctaacacgaactgaccacattaataacatcacacaatgtaatttacaaaactgaaatttaataggttatatttaattgttaacaattaaattattagaagtggtagaattagatttagattttctgcctctaaatctagcagtcttctctgatgacttctaaaatgtgatcaagtggatataatacaacagaaaaacattttttccttttcatcatttctgacaatgtagctagaaacgaactgggctatccttttgacacactaatgtttggccactttcttgattttccctgcaaggattctatgtttttctgtgtccattgtgttctagaaaagatggggttgtggtaactacttacaattttagagaaagagagaaatgaggagtgatttggatgatgtgctttttgtcctggtctaaaaccaataggagaagaatcatcctgtaatcctgtcaggaaattttctctttggtagactgcttttataatatatcatggctcagaaagcctggaattctactactggcctataaaatataaagaattgggacaactgttctgttcaattgagaccgtcactgctatacctatgggaacttcctaattgatacatgttcaaaatagtttggaattgagaaaaagaaaacaccagctatttttgaaataatgagacactttcttagctattatacaccaactgaaacctgtgccactgcctagagtattataattcctgcatgaacaaaattggcccaaataattatccaatgcttaaggcaacataaataaaagttcttacacttctaggtttccagttagtaaaagatgtgcagtgatgggagagaaagagaaaaacacatttggcagtgatcaggttaaaaaaaataaataaattcatgctcagccttgccatttagcaaaatagtgaagttgttaaagtttctgaaactctttaaccccactcaacagctctcctttcaacatacaaatgactagtagatgctttttcttggtctcttgttttatatattttgcattcagagggttgtaaactaaaggacagtattaaccatcgattagggtattgcccagttaaggtgactgccacatcagaagaatttgcatataaattaatgcttttgaaagcattaaagacttaaatgagaactctactggtacatatagagtcatttctttagatggaaattaggctgtgcagagtgagggatgatcttgtcaactatatggaggtggtagcttgtcaccacatagggagtgggtagctcaatgacaggcattcagaacttttaaccttaggtaaaactatcatgactggatcagaactttcaacctggtttaaaatggtaacaccttttgttttatttcattgtatttaccaccttagaaagaaagaacacatttgttctcattcttgttattttttggcaattgcctatttatgtttaatgtggatgaaaaggggattgactttccactcactgattatttgagtgccactttaatgggccaccagagttttctgtaaaaggaaaacatgaacattatagttgggagtttggtaagaagagaaagaatgaaagaagaaagaagggcaggaacgtaggaggatagagtaacatgacactggggtcaccaggtggggcccagaaagcaggctgctggtaccggtccaatagaaaggtgtctatccttctacatgaccagttagtggacctgtataaggggtatgtgaaggacactttgaatattcaggagccctacaagagggaattttctgccagttgattgggcagcttcaatacaaaagagaaattcccatgttcagtagacagggttgacaccagtgtatactcgtcccaatgcagataagaactctgcctcatctgaaccagctcctcacctgttatctaccccataggtgggatgcttggctggatcccatggctattcctgggctccatctgaccacagttcatgttacatatgaagatgcttgttaatgcacaagaggattgctcttcaggtaccaggtagaaggtggtattaatataccaggctagtcacctttcatttatttagcaaatatgttaggaaactttccatgtgccaagcaccctgatatattattggtgatagatgaagcactgtgtgttcctacctcaagcactgtttaactgggaggaattaattacagcttttatgttcagtgccaaaatggaaattaggccaaagggccacgaaagtttctccctgggacacagcagagggaaggggatccattcttcttgggaagaggcaaaaagggaaatcatagattgcaacatattttttaatttttttttattatactttaagttctagggtacatgtgcacaaagtgcaggtttgttacatatgtatacatgtgccgtgtaggtgtgctgcacccattaactcatcatttacattaggtatatctcctaatgctatccctcccctctcccccaaccccatgacaggccccggtatgtgatgttccccttcctgtgtccaagtgttctcattgttcagttcccacctatgagtgagaacatgcggtgtttggttttttgtccttgcgatagtttgctgagaatgatggtttccaacttcatccatgtccctacaaaggacatgaactcatccttttttatggatgcatagtattccatggtgtatatgtgccacattttcttaatccagtctataattgatggacatttgggttggttccaagtctttgctattgtgaatagtgcctcaattaacatatgtgtgcatgtgtctttatagtagcatgatttataatctttggggtatatacctagtaatgggatcactgggtcaaatggtatttctagttctagatccctgaggaatcgccacactgtcttccacaatggttgaattaatttacactcccaccaatggtgtaaaagtattcctatttctccacatcctctccagcacctgttgtttcctgactttttaatgattgccattctaactggtgtgagatggtatctcattgtgattttgacttgcatttctctgatggccagtgatgatgagcattttttcatgtgtctgttggctgcataaatatcttcttttgagaagtgtctgttcatgtccttcacccactttgtgatggggttgttttttttcttgtaaatttgtttgagttctttgtagattctggatattagccttttgtcagatgagtagattgcaaaaattttctcttattctgcaggttgcctgttcactctgacagtagtttattttgctgtgcagaagctctttagtttaatgagatcccatttgtcaattttggcttttgttgccattgcttttggtgttttagacatgaagtccttgcccatgcctatgtcctgaatggtattgcctacgttgtcttctagggtttttatggttttaggtctaacatttaagtctttaatccatcttgaattaatttttgtataagacgtaaggaagggatccagtttcagctttctacatatgcctagccagttttcccagcaccatttattaaatagggactcctttccccatttcttgtttttgtcaggtttgtcaaagatcagatagttgtggatgtgtggtattatttctgagggctctgttctgttccattggtctatatctctgttttgataccagtatcatgctgttttggttactgtagccttgtagtatagtttgaagtcaggtagcgtgatgcctccacctttgttcttttggcttaggattgacatggcaatgaagactcttttttgaactttaaagtagtttttttccaattctgtgaagaaagtcattggtagcttgatggggatggcattgaatctataaattaccttaagcagtatggccattttcacgatatcgattcttcctatccatgagcatggaatgttcttccatttgtttttgtcttcttttatttcgttgagcagtggtttgtagttctccttgaagacatccttcacatcccttgtaagttggattcctaggtattttattctctttgaagcaatggtgaatgggagttcactcatgatttggctctctgtttgtctgttattgttgcataagaatgcttgtgatttttgcacactgattttgtatcctgagactttgctgaagttgcttatcagcttaaggagattttgggctgagacgatggggttttctagatatacagtcatgtcatctgcaaacagagacaatttgactccctcttttcctaattgaatagcctttatttatttctcctgcctgattgccctggccagaacttccaacactatgttgaataggagtggtgagagagggcatccctgtcttgtgccagttttcaaagagaatgcttccagtttttgcccattcagtacgatattggctgtgggtttgtcatagatagctcttattcttttgagatacatcccatcaatacctaatttattgagagtttttagcatgaagggctgttgaattttgtcaaaggccttttctgcatctattgagataatcacgtggtttttgtctttggttctgtttttatgctggattacgtttattgatttgtgtatgttgaaccagccttgcatcccagggatgaagcccacttgatcatggtggataagctttttgatgtgctactggatttagtttgccagtattttattgaggatttttgcatcgatgttcatcagggatattggtctaaaattctcttttttttattggatcacaacatatttgaactagctctggaaggataaaatagagcattaggcagaaaaggagcaaaagtaatctaagacagagcgggcagtattctcaaatcttagtggcatgaacatgcttaaggaattggagagtctggctgaacacaagacatgggagaagagagcagaaactgggtgtggaaagagaagccggggctagattaagaaacgtctttataatgtatcttatgggcataaaggagctatcaaagcagtttaggaagaaaaatgtcatgatgagaattgtgttttagtgatatgaagctggtattagtatgctggatgacttagcagacagattatactcagaaagtatatcagatgtttctcctgggaaagccaggaaaaggaaaaataggtgtgcagacagaaaataaaagacgagccaaggtctagcaaaagattaggggtgaagggtgtcatggaatccagaagcaaagaggcaaaggaatgaggtgacaagtaaataaaaataggccatttggtatgaaaactagagaggagttgactttttagaggtataattccaatggaacattgaggtgaaatgtgtcttcgtgtcttccaactcgatatccactttcaccacccttctttacttgcctcaagcctcaaaaagctgacctgcatatttcatcaatgttttcccttattgtctggcttttattgggtttttccaaaggggaatgccaagaagaatagaaggaggaaggagacaacagtcaggatatctgtttcccagcttctccctgtaaggtcactttgggttggtatggtcctggaatcaccatgcttctaaggtgtcctgtctatgtctttttccttctgggttccagtaagtacttcattttcttatcttcttgggcctagtggtggctctcatggcttgtataatacttaccctgggttattgcaccatctcttgtaaatattatctttgtaaataatattttcttaaatcattctaacttgagatgatgcgtttcttattggcactcaggcagatagggtggaggaagtgattttaggagttaattgaatgtaagagagtagagacaacacatacaggccactcatggaagatatttagttatgtaaagacgcaggttgtaagttgaatggggaccataaaggaaagaaagtatttcagatggagagagatgactatatttctatgttgagtcaaggatactcccttttctttaagttggcaggttaattagaatcaaatcatctatgtaggaggcctctcatacaccctaaattttggcaaattgtcacctttaattctattctttcttaattgccacatatgggaggtagaaaatgggagtctcaatgcttgttttgaacttagaacccagagaatgaatctagcattaccagtcctaattgctaagcagaatgataaaagtcactttataatcaccgtgaaaccatgaaatggcaatgaagaaagctgccacatgattaagcgaggcagaaaccagagtagagttaatcctagccagaagattagtcacagaaagggaatgaacaagagaaggaggcatcagtgggcatgataagggataataattacatctgtagattgaacaccacagaattttgacatcatttagtgacattcacatcttagagagctgctgcagtgggcaagtcattgtattttttccccaaaatttagccttttgcttcaggtacttgccttctttgagaatgtactcgattaagagagaagcaatcaaggctctataacataatgtctcaaggcatttagaatactttttcacccaatgaacagtgcaagcaataagtgctatgagttcacacagagagaaaggaccactgaataacagacatgtacaaatgacttatctatatatgcaaatccattgaacaatccattgagtgtgagaaggaggcaatgtcctcattttgtatataaaattcattaaagtcttatggtatccattgctttgaagactcccacaacttgtatacagactcagaaaactgtgaacagctttatgtttttttttttttttttaaccagccaaccccattaattacctaagagtgctacatgctgagcacaatatcaggtacaatatagccagccttgaaagtccatggtgttttttattttgctgatatttctaaaatgtttcaaataactgtgatacacaaagaaataaccataggcttgagcttggaaggtgttaacagagtgatttcaaaataaaaggtttttctccatataagtgatttttacctccaatcctcccaaagaaaaaataagcatagagcatcataatgtgataattataacacattacttagtattagtcctcaatttttgatgacatccctgaagctcagatatttattggaaaagttagggcagaaattctgaatagaaagaaaggcaaactaaatgtaaatggtatgaattgctgtacaggcctgagggtatctagcatactcaggtctcttattttttcaaataaactgctcaatctctcacctgcttaacatcaagaatttcagtgtctaattccttttctatttaattgtaacagaatcctagggagtttttcattctataggagtttctgcaccattgaaaccaggttgccactgtttctcactgctatagtgtgacagctgatgactggtaacttacaggctgatggtcaggtcagcccactcttctgatgtcgttactgcttgttgaggttctgcagaaaccacagtagtttttgaaagagaaggatcccctagcctccagggcaagtgtcatcattcctcaggttcccaggatcatagctcttaataatcatccatttaaatttatacagctagccccagcctcaaagtattggatctggactcatgcctctgtctgcaccctccaacatctggaaaaatcatccatttttccttctactgaccacctctcccaggctatggtacattttttttttaatccccacaaatcaatggatcttgttatattcctctctatgaacaattggctagtgtaggatttgctcaaacaaaacctactatttaagggtggcatctctcaataatttaaaaaaaattatacgtagattataatataaaatgtagcatttctctagcattagaagaggggaaaaaagaaaataacaaaatctaaaaaagacaaacaaaaatgaattctttagcagtgcatcctctggcagggcacctgatcatataatatcttataatttctataattgtactaattgctttaaaatattgttttgtttaaaaggttccacttcccagggtacaaaaaataaaatcagagtggtggatacttaaggtgacccatctactgacaggcatatgttgggacttcatcttgatgtatgaggtcacagccatgttcctcatcatgtttctgatgtgctctctcctaatagtgggtggggcataaaagaagtccatcccacagtccttgaagagtttgcattaatgggagagaaggaaaattctatacttatacatatagaagagttggatactaatataagatagcacatagcatagtaataaattaaatgcaagcatctaaggtattgagagaacttctcagaggagttccattcaacaatacttattaatagtaataaaagtgtaactgactgacagacttttgccttcaaaacctctttaaagtacaaagcacttggctacactgtgcagattggctcactcaatgccaactccaactcctctttagtgtatctccctatcttttagaagctggaaaggcaaaaaaatttcagcagccttctgtgtatgacctaaattccaaaagcaaagccaccacctgagacagggaaagagtaatgtgacaatgtgaaggggcagcatggagactgactctttggataatgcagaatggcacaggtgtcatcataaagtggaagtgactgtgggttttgttacaagagtcctgttttactaaaagccttttctcttgcctctatcatctagcttactagaaattctgaaatgaacccttgtctgcctagtatagctgcaggagactatggcatctgcaactaagaaattcagaaaggtataatagtatcagaatgacttcaggtgagacagatgaaggacatggatgttggagttgtctgtctgacctactaggttgaaggtagggtagactagtcagcagtagagattggaatgctggtaatctgtagcatctactgatggaagaattattaaattattgccttttgttactgggaaagatgcacctattaaaggtaatggctatgcttaagtaggccatgttgataggtgtgaagaatataatgacaataggccaggctgttgcttccaactgaactgaagagcacaaagcaagaaagtaatggggtcatgttttaaaatcctgattcaagtcctgaaaaaagaactggagcgtttctatgagtgccctcaaaagaatcttgtattcctttgggtttatgtaactaaacatcaaatccagagactgattctgagttgatgaaataaaatagagagaatttagagtcttgccaggccctgactaaacacataagggtattggctgaaaaaaagttaagcctaaaaattcttaggtatttgaggtgacttagttgattttgagtattctgaacctccaaactttactgactgtctcagacaacactagcagctactccccaccacccatacagggctgatgagattcttcctgttttatttgaagaccttgtaatcagtgcttttgcaagagaacagctatactccccatatcccaccctaccatctatatgatctcaaacatacctcagtttgactcacagaaccaaaaagagattcaagtccaggaggagaagctgtttgctaatttgtattagcaaatatttaggacttgtttactgaaaactaaatataacagtgtcttatgttaagtgaagttaagatatcagaaattccttagttctgtataataaatgcaaagagcttaaaaaggtggcatggtcttatcaaatgccagtggctcacctgtacttaaacatgtacacaaagatgagaatgaaaatgtccacttcctatgatattgaggagcatcaaatatagtattagttctgattctctgatagaactttgactgatccaatgggtcaacaagtcatcatatgtgctatttgaactgctatcatgaacttgtaaaccacagagctgcgtgtgctcagtaggacaccaacatcaataggaaataagataaacaggattgggcctaagcatgttcaaaaggtctcaacatgttacataatcagattactaatactcccaatgtgcccagttctgtgggttcactgtcactttttctagccaaactgtgacttcataaagagttcctctagtatcaattgactgaggaaaaacaagtaagctttatttatagatgactcaatctaatatgttgacatcagccaaaagtgtattgtctcactcagggatactcctgaataacaatagctatgataatacatctattgggcaaaatgtaaaaactaaatatgatgatcactttgtttgaaaaaagagatgactgaggctttagatatacatcaattccatgggtaggagtcgatcatggtttggaaagatggttagaaacttggaattaaagaaatatcagaagattattaacaaggcagttttggtgatcgattcacgaatgaatttcttaaagttgtccagaacgtaagggcattttgtattagtccattttctgctgtaaagatactgctggagactgggtaatttataaacaaagaagatttaattcactcacagttctgcatggctggggagacctcaggaaacttacaatcatggtagaagggaaaacaggcatgtcttacttggcagcaggctagagagagcgtgggaagggggaaaagccccttataaaatcatcagagtttgtgagcactcactatcataacaacagaatggaagaaaccacccccgtgatccaatcacctcccaccaggctcctcacttgacacgtggggattatggggattaaaattcaagatgagatttgggtggggacacagagacaaaccatatcacatttgtacccccaagtgtctgctcccatgattattgtggccacattaatcacatgaaaaaagtaatcatcactgttggtattattcagcctctcttgcctgacattccatatttgctcacgggactcatgaataaaggtggctatgatgacagtgaggaaagttaggcatagggtcaaaaacatggatttcttactagattgctcaggtaactgtcactgctgagaactccatctgccagcagtagaaattaatgttacatcacagcaggctcaaaccccagggcactaactggcaactcatggcaggtcaattacatgagattcgtttttgtccacagagaagaaagtgatttattgtcactggaatagatatttatttttgtactctgcgagaatatggatttgcctttcttgcattctctaagttttggccccggggatttaccagatgccttgtttactgtcatagtatcccccacaacattgcttctgaccaacaaaccattttacaacctaccagggatatctggatttattcttactgggacctggaggaaacagagatagagatacatgattaaaaaacaaaacaaaaacaaaaacaaaaacaaaaacaaaaaaaaacccaacaacaacaagaaaaaggttgggagagaagtgcagtatggtggaaagtgcttgaggctcagagctcaagaatgtgagtttgtgtctgatttctacatctttctaagtctttgaccactaataaattacataccctctatgggtttgagttaccctcactgtaaaatgtgtaaataataggtaattcataggatggtttcaatagaaaatgttaatcacaaaaattaattgtttaaaaaatttagagtcttatatttacccactatacctgaggatgcatttaaattatttgagagaaaaagtctcagaacctggaaggaagggacatctggttacaggtcactgttaggtattcccctaaagcatc

SEQ ID NO: 19 - DNA, 10405 bp, Homo sapiens
ataaacatgaaataaatgtaggcattaccttaaaccaccaacatattcttgtttttcaaatatagtgatgtcagagtaccccaatcgagccaaaaaggaagcacaacttatacttgcaggcccagcaccaaaaagagcaatctttgcagaataggcttcagacattttttctgggggaggcagcgaaggatttctgatctgtgggatactcattgctttgaatacctacggggaaatcaattgtcatggttaaaattttgaaactagcttacatcctcaaacatatttttaatgtttcaaacgaattcttgttttaaatagcaatgagcagtacattttcagtattaatatggtatacttacaacttttattgtgtcaagtagatgaggagttatggctaactttcagtctttcctttctagagtcatgcctcctctaggaaacactcatggggcacattccctactcccacctagagggtacattaagtgcctctcctctaagctcctacagcataatctgtatgtctctaacataaccatctgtggtatgtgttatgatgtcagtcagtagaatgaatgttagttccctgaatcagaaaacatgtcacatgtaaacacattacccttgcattataggagttagcattgcgatggcacacggtagacatttaataaataatttcttgaattctgcttttgattatgacagattaactttgggagaataatgatttaaaaaaatagttgaaacattcaagaactactgacgcaggcatcttggaagggctaacatctcagaggaaagtaagaacaaagttaagtgaccagaagtcacttttcccctgagggatttgcgacttcttaccaaagggaggaaggctaagcatcttgaagagaaccacagctcagaaaagagatgttggcagtcttttgaaaccagagagacacagagttttggaaatgtaggaggccattaacctagagcaaaataaagtacagaagagtgagattaattcttaaagtgcatatgacaaaaacctaaagatctaaacagaaaaccctatggtccaggaaaaacaaaaactggagtgactaaataagaaagagccctagtacacacctcagtgtacggctgaagcttctggagggctacactctacaagtagggcaaatgaggggtaaatagccaacctagccttgagtcaactcagccctggatttaaatgacagtgatcagtcctcactgttatctatgtaccaaacgatagaatgcactttctgtgaataataagtcaaccacagtttctacaaattttttataaaatgcctgggtttttatttttaaaagtccaagcctgcaagaaaaataaacctaaaaaaattgaaagagatacatacataatctcgtaagtgtggttatcaaaaataaattttagaataactatgattgatatgttcaaaaatatgtaagaagaatgtaaacttcattaaaagctggaatttgttaaaaataaaaaattaaatttactaagtacatttagtaaaacatatttagcaaaaaaaataactagctaatgtggaaggagggagtgggattttaaaaacacattattaaaatgtattaattaaaattattataaataggtggtagagggtaggaaacaaagaaacaaatggtaagatggtaaatataaatgtcaacatgagaaattatattaaatgtaaatggactaaaattccaattaaaagacaaaagttatggaagataaatgccttaaatataagagcacagatagataagtgtaaagttaaagactagaaaaagttatacaaagcaaacactaaccaaaagaaagctggtacatatatatattatatatatatatgaaatatatatataccaatattagaaatattacactttaaggcaagatgcattactaaacttaaagaacatttcatagcaaggaaatggtcaatctttcaacaagattttaaaatacaattttaaatatataaagcaaaattgatagaactaaaagtaaaataaataaatcactataatctcattattctactctcatgaaaacttgactaccaatagaagtggccaatgaataaatccatattataggtaagttatttatgctatccaatggattggctcacacagttgcttgcatttaataggtcaaagcagtaactttctctcctggaaacccagacagagatcaatagatataaatgtaagttttcttaagaatgaggaataaaggtgacaggactttacattttcttaacctcatcccacatataccacaaactattgtaaataaagtcaaaacacataaggaacatccaaacaatcttattttaaaaaattgaagagggtattatcaacaagtattatagggtcaatttctaagcatgagatgaaaggtcctcataaatggtctcataatattttgtcattttcattctaatactttgtcacttttactggtttacttatctgtttcctctcttagaccataaaatatttaagggaagacaacatctttgaattcaccttttaatattcagtgtttttatacataagggggaatatatgttaactaatgagtttaaattggtaataaaataatttcttattcccagctacaatttgtataatttacaaattattaatatgtgttcctgctcttccctgtgctatccaaacagtacagattttcttaaatattgtttttgaatcaacatatactgttatcttttattcctttctaagcaatgtgaacaaggaactaaattctggtagttttatatgatcattaattaaaatgtagttaaaatatattttatatttccccaaagaaaggtttcacatacttttcataaatatatattttattagatcattaattaaaatatagttaaaatatattttttatatttccccaaagaaagatttcacatacttttcataaagagatacttaaaacatatgtttaacgtgatcaaggatctctgatcagggaacagagatatagctaattttatttagggattaaataaatgctaatttctttcatatttagttgaataattttagctttgtgaactaataattaaatatttaactttcccatgttaaaatctgctaacatttacaaataacattgtgttttaacaaatcttaaatgaagacatttatgatgtatttaaaagtatcatttattgctgacatcttttacaatggaagcagatttaaatgtactaaggctacagcattcattataatatgaagttacagtgtcataaccaaatggaatataatttgtgctcagcattcactcataagcaagaaataggttagttctgaaacgcctagcatatctgaacaaattctagctaatggcatgcaaataataaagtagcaattaccaaataatacacaatatgtatgtattttcacctaaaatattttaatatttttgaataaaaatttaagccttcttttaaaaaaattatgagatgcaaacattgaattattttaaaaaatgtttacagaatccctattaagtacccaacacagagttaaagactcttaaaaagtgtttgaagaaatgaaagcaagcacactcctcagtacacatagcatatgtgcacatactagaatgtaaattgttagcccgatttgctcaaccccgtgcactgcagcttaagagttgttcaatacatactcattacattgcttggctcaatacactaatctatcaattggtatccctttgcctgctctgttctggaattttttctttacaactttttattgcactaggttttccccgagtttaacaggagtttggattaaccttgatgcaatttttaaggaagtaaataattgaaccacatttttgtgaatttcagcacaacagatggtatatttttagaagtatggcattgaaacgagactcttggggttgagtcttgacttccatcattctcatgatgtatagaattgaacaagtcctttaacatttctatgcctcagtctccttaataaggtgggattaataaaatatatttcatagagatgctttgaggatttaatgagctaattatatgtggaaagtgctttaggaaactgcctgcccatatagcaaatgttatctacttctcatttcacctagtgttcaaattccatgagacagaatgtatctaaactcatagtgtccaagacggaatccactagccacatttgattaagttcaaattaaaattaaaattaaataaaattaaaaatgcaaagacctcagtagcactaattatatttcaagtgctcaataactacatgtggctagtggataatacatcgaacacatccatcactgcaaaaattaaaatttcaaacatataatgcaatagatataaataatctcatgagcatagttaatgggaaataaataatttagaggcagtgagtttgtagtatttgttatagttatttttaatatgatttttatgactacatgttcatatactttaatttttcaaaattactgtgtttcacaacctgtttacaaaattcctaaaaatttaatcagcactagagctggtcctggctggcttcagcacactattgcacctcggcaatacatgagggctcattcaatgtttttttagccactaatattcttctaccatcaaccctaaattctgaaatacataagttacactttccaacttaatagagatctgaaggcataagtggccctctatccctttaaaacatcagcaactaactcttttttaactgaaatacaagtaatggattatttcatatatacacaatatacttccatgaatgtagcctgattatgacaaaatgagggcaaatggataaaaagccaaataaatagctccaaaaatattttgtgggtgaatggggggtagtgatttgtatttaagtatattatgaaactatgaaaattgaaatcaattataaatctagagttggcattatatgaaaaatgtaaattaaaataactaatattgtaacactttaaactgccaatgaatagattgtgtaagttaaaaaaaagagggttaacttaattttgttaaatttaaaaataaaagtttacaaaagttagttaaaacaaattacaaaatttaaaatgtccataaatacgaagaatatttttcaaaaataatatttttcattccttttattaaactacatcagtcttcagagaagtgcaacataaaattacaaacaaattatacataaaagatattattaggtccagttacttacagtatcaaattcctaagagattttttcttagaatatagttccctattgtttcataatgtaacaaaaatattataaaataatttggctctttcggtgagaaagacccctctttttttcgttaaagcaaatgtcagttgtccatcaactgactaatattctatgatttaatttttaagttgaagggtcaactgccgaaacaatgtaataaatgaaataaacttgttaatatcagaagagagtgactgaagtatttaaagatgaatgaaaagtatacttaatatgtatttccccacaataataaggtggccaatatttattgaaatatatcctatgtgccaggctttatgttaaatctctatcatttagtcttcaaccctcctttatggaggtacaattatcagatccatttcctaggtaagaaacctgtggtcaggttcacatacaaaagattttatcttaaggctacttgactccaaagcctgaactctttttttttttaaattatactttaagttttaaggtacatgtgcacaacgtgcaggtttgttacatatgtatacatgtgccatgttggtgtgctgcacccattaactcgtcatctagcattaggtatatctcctaatgctatccctccccgctccccccaaccaacaacagtccccggtgtgtggtgttccccttcctgtgtccatgtgttctcattgttcaattcccacctatgagtgagaacatgcagtgtttggtttttttgtccttgcgatagtttgctgaaaatgatggttttcagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttccagttctagatccctgaggaatcgccacaccgacttccacaatggttgaactagtttacagtcccaccaacagtgtaaaagtgttcctatttgtccacatcttctccagcacctgttgtttcctgactttttaatgatcgccattctaactggtgtgagatggtatctcattgtggttttgatttgcatttctctgatggccagtgatgatgagcattttttcatgtgttttttggccgcataaatgtcttcttttgagaagtgtctgttcatatccttcgcccactttttgatgggttttttttcttgtaaatttgttttttaacgattacattttcacagtaatcgctaaaaaattcactatatttctctaatttttcaataagaaatgtataactgaaaaaattatatgaatttgtcattcctaacccacttagaatatgttatattttaatatattaaattcatacattctgataaaatagattttgatatattctagccactctactaacaaaaatagctggttattataattaataaattaactttacaaaccaagaattgttcatgaagcatttaaaaaacactgaactacatcatctggtttcccaccatgctatcctgccacccgagaactaaggtagttggtgcattaagagaactgcctccctattatcaacatcctctccatagtggtacatttgagtacatttattacaactggtgcaccttcaatgggtttgcacaaatttattatgaaaatagcatcataggactacagcatcatacacaatagtttctttcactgtcctaaaaatcttcttaatctccatatgcatccctctctcaccttctccccagcaatcactggtctttttagtgcctccatagttttgccttttctagaatgccatacagttgaaatcatacaatatacagccttttcagattggcttctttcatttagtaacatatatttaagttttctctgtgtctctccatggcttgatagctcctctctttttaatcctgaataatattgcaatatctgtatgtaccatagtttatttatgcatccacttactgaaggatatctcaaaaattttggtgattatgaataaagctgctataaatatccatgtgcaggtttgcatgttaacgtaagttttcaactctttggggtaaattgccagatcatatgataagagtatgtttaattttgcaagatactgtcaaactgtcttccaaattggctgtaccattttgcatttccaccagggaagaataaagttcctatttctcctaatcctgtcagcatttggtgatatcagtgttctgcattttggctgtttggtctcctctgaatgtttgtgtctacgcccccatttcattcaattcgtatgttgaaaactaaccacaaatgttagaaaggtggggtttttaaaaagtcattaggtcatgacttaggaggtgattaggtcatgaggagccctcctcaattagattagttcccttaaaaacaaccccaggagaaataccttgcccctgtcacatgtaagacaggcacagtaaaaagcctttacctatgaccagaaagcagcttatgagcatatattttttttattatactttaagttttagggtacatgtgcacattgtgcaggtcagttacatacgtatacatgtgccgtgctggtgcgctgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgggaattcccagcatccagaaccaagagaaataatttttgttgtttataagccatccagtttatggtattttgttgtagcaaactgagcagactaagcattctaatagtatagtggtatcccgttgttgtttcatgttgcatttccctgatgatacatatgaggcatctattcagatgcttattttccatctgtatatctttcttggtgagatatctgctaaggtctttgtatcattttttaaatgggttgttttcatattgttgggttgtaagagacttttggacattttgcataacagttctttatgaagtatgtcttttgcaaatattttctcccagcctgtggcttgtcttttcattttctttcaagacagtttcctgcagagtagaagttttaattttgtttctgtgtttgttttgagatgagagtctcactatgctccccaggctggtctcaaactcctgcattcaagcaaacctccctcagccttctgagtagccaggactacaggtacatgccaccacacccagctcagaattttttatatttgatgaagtctatcttatcaataatttattttataaatcttgcctttgattttgtacctaaaaagtcattgtctaaccgaaggtcatctacatggtctcccatgttatcttcaaagagttctgtagttttgtattttacattgaggtttatgatccatctttaattaatttttaatgggtgtaaggtttgtttctagattcacttttttacatatggaagtagggtggtataaatatcattcgttgaaaggactatcccttctccattatattgcctttgctcttttgtcaaagataagttggctatatttacgtgtgtctatttctgggctctctattctgttccagtgatctattgtctattattttaacaatatcacactgtcttgattactgcagctttacagtaagtcttaaaatcaggtagtccgagtcctccaactttgttgttctatattatgttggttaatcttttgcctctctatataaactttagaatcagtttgtcaatatctataaaatagtttcctgagattttgatttgggattgtactgaatctatagatctaattgggaagacctgacatcttgaaaatactaagtcttctatttggaaacccggaatatgtctctatttatttagctttttttatttatttcatcacagtttcatagtttttctcatatacatattatacctatttcattagatttatatctaagtatttcgtttttaaggatgcaaatgtaaatggtatacttttaatttcaaattctaatcatttattgctattgtaaaggaaagtggctgacttttgtttattaatcttatatccttttttgccaaaattgtgtattagttccaggagtttttctgttgattctttggaattttctacatagacaattctgccacctgctaacaaagacagttttatttcttccttctctgtatacatttcctttccttttcttgtcttataaattgcatttgtattctttttaaggtgttcccttccctacaaatattgtatcacttggactattttaagattattttaataggcactcaacaagattttgatgaatttcaaaattcctggccttcagtgatatgcttaaacaaagtagtaaaagtcaccaaggaaaacagttctaccttagtgataatgaagaattatctgcaagtgaatatccttttttaaattttactttttaatatttttactttgtaagtacatggtatatatttttttaattttactttttaaattttttaatattgtgggtacatagtacattcttgaggaacatttttaatattaattttcttgtgtattcatcctgtgatttctcatctttcattcatctagaaagtgcatgtatttcaccactccaaattgactttaccagcattttctccataattttcacattactttgaagaaagggagagattatattgatatttaaaatggaaagattgcaatgcagagaggagccacaggattttcccccaagtctcctcaccttctggagacagaaatagtataattttctaatcattatatagtgt

SEQ ID NO: 20 - DNA, 10633 bp, Homo sapiens
tttttgtttgtttaagagatggggtctcaccatgttgctcaggctggccttgaactcctgggctcaagtgatcctccagcctcagcctctcaaaggctgggactacaggcatgtagcactttgcctgactcaaggggaatttttagtaagagtatataatccaagtctgtagcagttggaggatgtcgtaccacgctgaagtgtcacacataactgatgactcagtcccccaagcctattttatcatcgtaaagaaagctatttctttgattattccaactctttcagcaccaggactgctgcaggggctggattcatgctacctgtagttgcagtgtaaattatgtgtcagagccaagatcctaggaaagtcaaagactaggttacaagagcgattctttttttttttttttttttttttttttgagacagagtcttgctctgtcgcccaggctggagtgcagtggcacagtcttggctcactgcaacctccgcctccctggttcacgccattctcctgccttagcctcccgagtagctgggactacaggcgcccgccaccacgcccggctaattttttgtgtttttagtagagacggggtttcaccgtgttagccaggatggtctcgatctcctgaccttgtgatccgcccgcctcggcctcccaaagtgctgggattacaggcttgagccaccgcgcccggccaaggacgattctttctaatctttggtaagccagtttttacagaatgaaatgctcttggattgactgacttgattgggtaagtattcattgggctcttgttccatgcaagggcagtctacaagggcctagatatgggggcccccaaagaagaaaaatcggtttttcatcatattttctggttgagtttcttcctttattatatttgttacatatgttattaaattatttccataaaagaggttatgctgagcaggtaaccaaattcttgttcccccaaaagacatgtataattcagacgatttatgcaattagaagaagggagacttcatcagttaataaagtctagaacgtgaggaagcccagtcatttccaggaccttcagatgcccaagctggatccaggttttccaccccgacagctccagggagcacgctggagagacagacttcaccagcgggaaggcgcggcaccctacgcgcaaggaacctcaagtcccagaatcctatgaggactccaaatcccagaaacctgcacgcaaatctatcccgggtgccaagtcggccgaccgcagacgtgaccaagttgcgaggctagggtgaggtgtcgtagaatttgtccctaccattgtccctgcagggaagagactttagtgatctagagctggtcattgtctctttcacagctcgcgtgaaagcacccctctcggcgtgtttgatgccatgatcagcgtctcccattccctctgtcccctttctctgcccccgtaaggatggttcagcccggtattgaggctccttgagctggctggatggttgcgcccgccctaccccggaatgtgggcctttggagcgagcgaagtgggagggaccgacgcaggaggtgtcttgggcccgggcggctgtagaggcggcggcgcctacgggcagtgggaggagccgcgcggttccggctgctccggcgaggcgacccttgggtcggcgctgcgggcgaggtgggcaggtaggtgggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcgggtgagtgtcctgggacagggcggtgggcgggaggggacaggccggctccactcggcctggaggaggggagggtgaggggctggaggtgttgtgggcggattgggctgggcgggcgggcggctccggtgactcagggtgagtgacgaagtgataggggtgggggcgaagcaaggggatgcagtactgggggcgcccccaggtatggcggtgcggggagccgaggggccagagtagggtccgagaaggaagctagggttagagtaggtgcacctggtgtggacgagagactcgcctcctgagagctttgtaggggccttgcatccttaagtctgggtgtatttggggttgcgagttgaggattccaagtgatgccttagttaactcagtttgctgtggggatagaaaacgggacttcttcagttagctgtccgttttgattaccagcaggcctaacgcctctggttctctgagatatacctccatccccgttgtgttcacgtagtgtatctgcactgccagtatattagacataggggttgtatttaagaatcaagtcgatgcgttttcagggacgtgcagtgggtacttacgtgtcgtcaagattaagttgcatgtgtgtaaatcaaaattttgtgagcctttctttctcagtgttgtttcaacgactacccgatagggtgagatactgcaaggtgaggagactagcctagttacagttttaaattctctgatcttcactcccttactatggttacaagaaaaaacccagttctaagttcattgtgttaaatcattttctatcagtgacgcaaagtgccccccttcctttaaattcagttgtggtttgaatttttttttgagataattatgtttaggagcattagaaacgtgaaatgttagtgtgaccataaaggttggagactgagaagtcacagaaaacccagctactttggcttgccttactgcttgtccaggtagaagtaaattgctttaaaaaactcaagcagtgctaggttgaaattttaatgcatacttttacattcctgagaggatcagtgaagatagcaaactctcaaactacctctcttgttttgatttcaaagaaaatctgagcccctaaatgttgtattgatttgatgtaaggacttttttttttattattatactttaagttttagggtacatgtgcacaatgtgcaggttagttacatgtgtatacatgtgccatactggtgtgctgcacccattaactcgtcatttacattaggtatatctcctaatggtatccctcccccctccccccaccccacaacagtccccagggtgtgatgttccccttcctgtgtccatgtgttctcattgttcaattcccatctgtgagtgagaacatgcggtgtttggttttttgtccttgatgtaaggacttttaaatttgctgccatgaagcctctggcctctgtttattattagcttgactgtatgcaggagtagtttattggagttatattggacagtatgataactttgtgtttaagcaggtaaaactgattaaggaggtttttattttaaatcagtaccaagaaacgtgtggatattttttaaagtttgtagttgtcacaagagctgttttgacttgaggatggtcagccatgaactttgcaaggtgagaaaaaagcttcctttgcttttttttttttaaacccttacctgtaatttgatgaatgagatgtttcactttattcttttattttatttttgtttgtttgtttttgagacagggtcttactctgttacccatgctggagtgcagtggcacaatctcggctcactgcattctccgcctcccgggttcaagcaattcgcctgcctcagccttctgagtagctgggattacaggcatgtgccaccacacccggctaatttttgtatttttagtagagacggggtttcaccatattggccaggcatgtcttgaactcctggcctcaaatgatgcgctcgtcttggcttcccaaattgctgggattacaggcatgagccactgcgcctggccctaaggctttcaataaattcttattaattgagatcatcttctccaatgagtctatgaaaggtaagaaattagtgcttctattttcccatttgtattagtttgacacatgtaaataggcccagttagtaaatgaaaatcattgtaaactcctttgagaagaaatcaaagtcttgctgtacttcatgaatttagatagcaaattatcttggcttattgctccagttattaaaaagaagagaataaggacatacagcttctttagtgtttgactgcaatttttccaagacattcaaggtaacattgtcttttaaaatctgtgaaattttgctgcggcgcaaataacctcttgcccattgtatactggtctttgctcaatgaaagctttctaatggtaccttcatttcaagcctcatttaaagacaatatcagcactctaaattgtaccaaattcctgtcctctgaaattagatgttaagattatgtgtttgtatagtctaaactgatgattgtggtattacatagtcagctgctcattaatatagatgaagctaaaatgagtcacggacaaggatagttaataaacaggttggctaactagaacacctacctgattttaaaatagaaaatccttcctttataccaagaaatgtgagaacattctgcatttgaaaaagttttcttttctctccaatcttctgaagggccattattacatagcatttcctctatccctctacacttttcttttcttttttttttttttaaatagagacaaggtctcaccgtgttgcccaggctaatcccaaactcctgggctcaagtgatcctcctgcctcagcctctcaaagtgctgggattacaggtgtgagccactgtacctggctccactacccttttctaacaatatttctttccagtgaatgttgactcatttaatagccagcattttttttagtgaaaaaattgccctctcttttcaaagatgtgtatagtgttattattctgttaagcttgatctcagtgaaaacgtgtaatctctctagatctaataacatttaatttttttctaatttttattttattttattttatttatttatttttttggagatggagtctcgctctgtcacctgggctggagtgcagtggcgtgatctcggctcattgcaacctccgcctcccaggttcaagggattctcctgcggctgcctcccgagtaggtgggactacaggcgcccaccaccacgcccagctaatttttgtattttagtagagacgggttttcaccatgttggccaggttggtctcccaacttctgacctcaagtgatccacccacctcggtctcccaaagtgttgggattacaggaatgagccatcttgcccagccaatttacatctagtttttaagcaagagattaatagcactgaaaattcaattttattggacaccacatcttacttagatgcctttctcatggcctgcacccgtcttttcctagcaaggaagcttttcagtgaggggccttcagttattacctagtgctagtagtttggaggaagagaaacaggtttcattaattagtgataaactgtcaatgtatgtgcttatccttatataaaattacttgctattatgggatagactttaacaaggcaacatctggactgctcatttctttacattatatatgtatggaaatttttgcagaaagcttgtgaaagttctttttaaaccgctgctgtcaagtagtaataacaatacagaggattccttctgtgcacatctagaaataaaagattaactctttgcatatttggaatagctgcttcagtgaagaagtatgtaggatttttcttactgtgaacaagtcttggcaagacttgtttttgaaagaaatgcaagattattttagcaatatactttagtaatggttctgaggaaatacaagtggtatcttgagggttggggggatgttagctaattggtcttagagcttcagccatggcacctaatcctagggcagctgatccatagcttggccaaagagagaaaaaaatagagcatgctagcctggtgccaaaaaacccaaaccaaacacaaaaaaccctcagaaatttgaatgagaaaatatggagataaaattggtcagcactgggaactgaagctggagttggagggagagtctggcgaggccagaactgacaatgtgcaaatgaaagatgtgaagaagcagaaactgaggaagcaaaggagaaaggagcaactctgcacagaaaaattctccccacaggtccttagttcatgatggctttctaatgcaactgcagccctccttttacaactttagtgtctgttttttttatgattgaaatgagcctaatttaaacatagattttaaaaattccagtcttgcttaagatttcaaatataaccagagatcattcaaactgagtttagtaaatattgttgaacgtccgtaatccaggcacatgatgctgtcgtaggcacagagaatgtagaggtaggtaaggctctgcctttaaggaattaagagacttgtggagggaaggacatataagagttacaatagaaacaatttaatttgaagtacctatgtaaggtatttgcaggaatagacgttggggaggagtttggggtgatggaagccttcctagaggaaatgtctgaggcttttaaaggataactaggagtttgcctggtgaataatgatgttaggtgggtgttataggcattaaacaaccacatggtaagtttgcagaattaagatcactttggctgttagtctcatattcattccttattaggatataaagtatgaagtgggcactgatgagaaatgaggctaagaaagttcacaggggctagattgtaaagacccttgaatgtcatactgcagagtttagactttttctcattgatgaaaattctaagtaagagaaatacatgatcagatttgcattttagaaagataacacttgaaattagtatgggagatggattggtgatggatgaaactaatttggaggcttttgaagtagtccagatgagatattttaaggagagagaaaagagtgtatggattcggtggaaattttaaggggtagtatcagtagaattaaagatagtcttgtaggggtgacgggagttggacaactcataggtttctcgtttaagagagactggggaatgtggaagagatttgtgggagaagttaattaattggctggaacaattcactgaattttgagttctaggtgtttatgaggcattcaggaggaaatgtcagaaagaatggagcaattatttattgtctgtctactctgtgttgcaagcactgtgcttgacagctaacctatgtaggaatgtggctgagaacgataatagaaacaaaaatgacaccagtggccaaatacagatcacaaaggcaaggcactaaaactaaattttaaaaatatagaaatacagaaagaggctgggtatggtggttcatgcctgtaatcccagcactttgggaggtcagggcaggtgaatcacttgagcccaggaattggagaccagcctgggctgaatgtggtgaaaccctatctctacaaaaaaattagcctgtagtcctagctactaggagggcgaggtgggagaatcacctgaggccaggaagtcaaggctgcagtgagctgtgattgcaccactgcactccagcctgggcaacagagtgagaccctgtctcacacacacacagacatacacacacacaaatatatatatatatacacacacacacacacacacacacatatacatacacacacatataaagttcccctgtagtctctcactcccaccttattttattttattagtttatttttatatatttaaagggtacaagtgcagatttctttctttcttacatgtttgtatcatgtagccatgaagtctggtcacttagtgtacccatcaccggaacagtaaacagtaaaacccagaaaattacctgtacccgataggtatttttcaaccctcacccccctcccaccttttgtagtctccaatgtctactattccctctttatgtccatgtgtaccctttgtttagctctcacttataagtgagaatatgtggtatctggctttttgtttctgatttttttgactagggataatggccttcagttccatccatgctggtgtagaagacgtgatttcattattttttatggctgtctcactcccactttctagagatagccattgttaacagttagggatattctatatcatatcggtatatttataagtatagatatgtatgtgcatacacacacacagacatacccttttatttttccaataaatgagttcatatttccacacatgcatctgcaacttgattttaaaaatcgtggtcatcttttcattccagggtagacagacctctttatagttggtaatacagtgttctacagttgttgttgttgttttaagagacagagtctgattctgttgcctacgctggagtgcagtggcatgatctaggccctctgcagcctcaaccactctgggttcaagcagtcctcccacctcagcctcctgagtagctaggattagctcacgccactaggctcagctaattttttttaatatgttttgtagggacggggctggtctcaagctcctgtgctcaagtgattctcctgcctcggcctctcaaagtgtagaaattacaggcatgagccattgcgcccagccaccataatatgtttaatcttttttcggattgatgaacatttaaagttgtcttcatcaactcactatttcaaataatgttgaaggaacctccttatatttaatacatattcttgtaaatatggtcaaagatatgcctatcttgaaatatgatattgtttcccaaaagagcttaatttacattcttaacaacaggactagtgaagcttctgccttatattcccattgcatgttatctgtcttttaaatttttgactgtcagattggcaaaaaatggtaatttatttttacaagtatcttttatatattaatgatcatttgtatttcttctggattgttcctattttacccattttctattgtattatttttcttattaatttgttgacaggacattgacattttgttaaagttgccagcatttccccaatctgttgctagtctggagtttttcgtttttatgtcatcaaacctgtcctttttaaaaatttccttgatagtttctggatttactgtcttaggtaaaagtgtttttcatctaaaaatattctatttttcttctattatgcaacttttttttttttttttttgagacagagtcttgctttgttgcccagggtagaacccagtggcgtgatctcgtcttactgcaacctttgcctcctgggttctaacaatcctcctgcctcagcctcctaagtagctgggattataggcgcacgccacaacacccggctaatttttgtttgttttttgagacaaggtcttgctcagtcgcccaggctggagtgcagtggcacgatcctggctcactgcagcctctgcctcctgggttgaagtgattctcctgcctcagcctcccaagtagctgggattacaggcatgcgccaccatgtccggctaattttttatttttagtagagacagggttttgccatgttggccaggctggtcccaaactcgtgacctcaagtgattcacccgctgtggcctcccgaagtgctgggattttaggcgtgagccactgcgcctggcttattatgaaacttttaaagtgattatcttttcagtgaatctggtattttggggtttagtcatttatagggtactgacacaactttttttttctccaaaatttattctaataccattattgggcagattgtcctttcaccactgatttgaaatggtaactctgttatgtactaaatttcccacaatgtgcgtaggtactttctattgtttcattgattttaggggagagatctatttttgcacataccactattggtttaattattgtaatattatagttaactttgatatatgttatggaatggcttgattcattatttaattttttttttttgttttttttttttttgagatggagccttgcactgtcacccaggctggagcgcagtggcgtgatcttggctcactgcaacctccgcctcccaggttcaagcgattctccagtctcagtctctcaagtagctgggattacaggcaaggcgctaccatgcctggctaatttttgtatttttagtgaaaatggggtttcaccatgttggccaggctggtctggaactccttacctcaggtgatccatctgcctcggcctcccggagtgttgagattacaggcttgagccaccgtgcccggcctattcctatatattttataatcatgtgcttttgtgaatggggtcttcttgtagacctattacatactgttttctttttgtatgtttaaattaaactttccaccttactaataatttaactgtcttagaatttttaagctagataatgtcatctgcaagtagcaattttgcctcttcttttctatatcttatttatttatttattatttattttatgttttt

SEQ ID NO: 21 - DNA, 13264 bp, Homo sapiens
taatttatccatgaaacaaattccttttcgtgacatttttccttggtgggccaatctgctattccccatcagaaaagagcccaggtgagagaagaagaaaatagaagaaaacagaaaatcaggaggactttctctttctcactcctcacttcattcctgcctcactcccaaggcaagttcagagccccacagtaccaagagttcaggaaaatccaagggctgaattcaacatccatctagccagtagagatattttaaaaatcacacatattatactgacttgaaaaaatattttcagcacctactttttaagtactcttatgctaaacacaatggagaaaattaaggtacaaaggcatagcctctttcagaaaatccataaaacctgtatccaaagaactataataatgggcaggttctgaagaatgacatagaatgggccacacatctctaggataggatttaaaatgtcatttaaatataacacaaatgtttgtattgggaactctaaattgtccttgtctacagccttcttccttccctttcttacaacctataagatcagacttaagtaaactcctaagctaattttgaatcatttgtcctccctaagcccataatcacatggctaagccaagaattattcaaacctaattctcccgcaagacctcatccattgctcactgctcctgaagatggtcttgagtatccccctggatctgggcctcagactgtctttgccactctcctgtgttaccacatggagttggtccccgccatgtttggtcaggtctcttagaatgataacttctaacatcatggatcctgaaaattagctaatgtgatttccaactactgtgtctcatctagctgatattatcaatcaattcatcctgcctgaatttataacaccacatttggatatagtgtttagttgcttaacatatgttcaataagcataaattaaatacatatagacaaatggtctagagcagtcttcatcatgcttctccggaaggatctagagtacttatacaatttgagaagattgagtttcataccaagtagggacagggtctggaaacaggcagtacacaaacacttgaatgtatgttaagactgagacttctgctacagaaagtcagaggaaagaatgtgactttcaggtgagatcagcaaagaaggattccctctgccacaaaataacaccttctttcccagaaactcagatttcctttgatataattcactattaattttcactctaggagatgaagcatctgaatgaatgttcctggaatatgcttggaacatgggaataaatcatgctagttgatatggaagacaaacacaacactccagcaatactctcttaggaattccctcatcaccatttaaattgttgattttctgctcttctgtagaaatctctagttctggatgaacataagcactgtctatattcgttagacagcacaatacatattagtctttaatttatttcacctacaccaaacctaaattttttcttcttctaactttatgtcctaattttctttacttaattttgtctacatttttgtcatcattttctcttagatttttgttcagctttccttgaaacccaataaaagcaaaaattatattgagaaaagacaaaatttcacatcccatattctacagcttgctacctctgggcaccaatggacattcaactgaaatataattttttaaagaattttatcagtataatagactcttggacttgaattatgaagcctaacaactggtgctaaatcagatgaaattgtgaagaaatgtctgcagtgtagctctaactaaaagctatattctaacaagtcggcgatggagcctccaactttctcatgcctctggatggaatttattccctaaactcagtaaagccactgactttcagaaaatgaataatctaaaaaaactgcaaaggcaaggcttttgttctttaaaaaaagaaatgaagctaacttctgcttatggcaatggagatcagtttattttgcaccaatttcctactgaaaataactataaaggctgaacaaaatgtccaaaacccatctgtttgaagtcatcagagagccatcaaggtaaagaggggcttcagggcaaataatctgacagaggcaagccaagagatgttcaccccccaaagcagttactaaaggcttggaggttgacaggagtatttaaaagtcgcactgagaaggacaacacaaatttgagtttagtgccttccaggaatgaaaaatccttggataaagacttaggatatcactctgcaatctacagggcttcaccctgcaagtgagtgtaaacagaaaatagaacaagccttataaaggtttaagaaaagttttaggtcagctcaagtcctaaaggattaaggtgattggcatctcacttagctgcctggtagaagcaagttgaagtcccacctggagaaaaacattcactgaagcctcaaaatgccttgcaagttttcatctaaaatgtatgacactcaatgaaaaattaatagcatattaaatagatttgaccagcggggcgtggtagctcacgcctgtaatgccagcactttggaaagctcaggtgggcggatcacctgaggtcaggagttcgagaccagcctggccaatgtggtgaaaccccgtctctactaaaaatacaaaaattagctgggcatggtggcgggcacctgtaatcccagctactcaggaagctgaggcagaagaatcactcgaacccgggaggcagagggtgcagtgagccgagatcgcgccattgcactccagcctgggtgaaaagagcaagactccatctaaaataaataaataaataaataaataaagatttgaccagctaacaagagggaaagaaaaccagacagtgcaaaattatccatgagaaatgcagttgttgtatttatctgataggacttaagataacagtgattaaaatgtttaaaagattaaataaggcaatacaattcagtgaagaacaaaaaattataaaaacaaagaaaatataaattctagaactgaaattaagaactttacagatagatgtaacaataagacatacaggactattgaaaaaatagtgaattggaagataggtcagaaataaatattgagaacaaaagagggagaaaaaattacagaaaataaagaaaagagcatgcaaaatttatgggacaggtacaatgaaaagatctaatacacatgtaactgaaatttcagtaagacaatgaaaagaaaaatggggcacaagcaatatttgaaaagatagttgctgaggatttttccaaactgatcaaatactttattcaagaaatgctatgagccttaagaagaaagaatacaaagaaaaccacatagctagatgcatcatagttaaatttctgaaaaccaaagtcaaagagaaatcttaaaaaaagaaagagatagagaaaaaagtgtattaacttcaaaggggggacaataagaatgacagctaatagctgacttcttaattgaaacaatggaagccagaagacagtagaaagatatctttagaaaggggtgggggcagaggtcaacctgtaattatgtatcagtattaagtgcaatacaaaaattcacaaaataaaagcattttcacacaaataagaactgaatgcaccagcagcagatgaacagagaaaatactaaaggatattcaagaagaagtaaatttgtactaaaaaatgtgtaaaaaaaaaccccatctgtttgaagtcatcagagagcatggagaaaaacattcatttaagcctcaaaatagcatattaaaaatatttgaccagctaacaagagggaaagaaaaaccagacagtgcacacaaatatccatgagaaatgcagttattgtatttatctgataggaactttaagataacagtgattaaaatatttaaaagattaaataaggtgatacaatttattgaagaacaaaaatttggcgatgcagaaaggaatgaagagtaactaaaaggagtaaatatgtggataaacacaagtgaatattgactataaaacaataatactaaagtcttatggattcttaagtatttagaaaattgtaacacatgagaacataaattagagtatgggtaaatgaggctaaagtgtattctaacttttgcattgagttggtgttggtaaaaatagtaatttatgttagacttgaatttcagggatgtattatatttcataagctagggtaagcactaatacaatggtaaaagaatgtgtatctgaccagctagtactggggagaaagggaaaaataaataatactgaatccatccaaaagaatgtaaaaaaaaaaaaaaaagaacaaataaggaatatgctgggttaattagaaaataaatgtaaagttctagattttaaacttaatatatcaataacattaaatgtaaatggactaaacactccaattaaataacaaacattttcaggctggatttaaaaaataattatatgacacaagagactcaccttaaatataagaatataaaaaagttgaaactaaaaatagaaaatatatataccataaaaatactaatcaaagtatctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatcaaagtatcttaatctcaaagtagatggtatagcaagaagcaccactagagataaagatcactttccataatgatagaacagtcaatccatgaggaagacacattttaaaacttgtgcacagttaataaatagtgtcagaatatacaaaggtaaattattagaagtaaaaggagatatataaaaattcaaaattgtagtgagagatttccatacatatacttattaactgatggaccaggcagaaaaaaacaatcagtaaagagataaaagaccaaaaaaaaaaaaaaagattgcaaacttgatctagttgaaatattcaaaacattactactgtataataatattcttcccaaatgcataatttaccaaaattaaacattatctatctatctatctatctatctgtctacctacctacctacctacctagtttcaaaggtttggaaatgtgaagtatattttccaacctaaatggagttaacctagaaatgggtaagaaaaataagtagaaaatatcatggacttggaacatagactatttttcaataattcatgagcaagagaagaaattacaagagaaatttaaaaatagtttgaaataataatgataatgtaacatctcaatacttgtaaggttcaggtaaagtcatgcttagaaagaaatttatatttaatatatacatgagacaaaggctgaaaaatcaacgattaagcactaaactcaaaaaatcaacaaagagcaaattaaatgcaaataaagtgaaaactagaaaacaataaaaaataagagtggaaatcaatataactgaagcaaacacataatagaagaataactaagaaaaaaggtggttctttgaaaaggctaatatagttgatgataacttgtcaataccctgatcataaaaaaggcagaaaaaaatccataatgaacaatgagattattacagctcacataggcattaaaaaggtaatagaatattttgaatagctgtatgccaatgcatttgaaaattgacataaaatgaacaaatttctgaaaaaacacaagctaactaaactgacacaagaaaacgtatcatttctaaaaatatgaatatttctatatttgtgaaagaaaatacatttataattttaaaacttttcataggaaaatctataacctcagtgttgttactggtaaattttaccaaacacatttggaaaaacaaaataccaatcttacgttaagttctttcaggaaacagaaaaaacgtggaacattttccagctgtttttttgaggttaccataatcttcatatcaaacctgacaaggactttacaagaaaaatcaaacaccaatcattgtcataaacccgtatgcaaaaatattacaaatttgtgctaaccaaatccattaatatagaaaaaagataatatacaaccaaacagcctagttcggtttattccaagaatggaaaattggcataacatgtaaaatcagttaatgtaattcaccatatgaagagaataaaaggaaacaatcatctcaagaaatgtaaaaaaaagaagtcatctgattatttatctgatttatttataataaaagcccttagcaaacaaagaataaaaaaaaaagactttattggccggtctcacgcctgtaatcccagcacttcgggaggccgaggcgggcggatcatgaagtcaagagatcaagaccatcccagccaacatggtgaaacctcatctgtactaaaaaaaatacaaaaattagctgggtgtggtggcatgcctatagtctcagctgcttgggaggctgaggttgcactgagctgagattgcgccactgcactccagcctggtgacagagtgagactgtctcaaaaaaaaaaggactttatttatttagtaaacagtatctagaaataacttccagcaaacattatacagaatggtaaaatattaaaaatttttcctctaaaatcaagaacaaagtaaaaaatgccagtgttacttacatttgacatgtacaagaggtcctagtcaatgcaataaggcaagaaaaagccaaaacatgtgaggattttaatggaatgaatgacagaagtctagtcctcttccctttcaaaataagctgtggcttccagaaaaaaaaaaaaaagagaaaggatgatgggaatgaaaacaacagcagatatctactatgtttctctagatgaaaataaatatagttactctgtttttagctgacaactagtcagtgtcaggatattgatgaacctcagtccgtcaatcagaaaaactactgctatcatcacacagaaggggttagaattcaagctgtactgcctgctagctgtaggacctttgacaggtcatatagcatgtctagcatttagatccttcatctgcaaaatgtgggtggcagaagtacttgcttcctctgcctgtatgaagattaaataaaattatacaatgtaataaccctaacatataaatacaaaataaacgttagatgaattttactgaaattattagtaacaactccaaagccttggttccttcagttaaggcgaccactgaagttaatctcatgtgaaaataaattataccccaaatttaacacaaacaactataacaggtgatctggaactgaaaataataacaaaaaattaatgaagcttacattaatgagatatttaaatattaccttacttttttcaaaaagtgttccttttctctctctttcccatgatttttttaaaaaaagcttttaattgctgcaaaccggcagaaaaatacttatttatatcttaaaggtactgctcaatgaattttcacaaactaaacacgtccatgtaaccaacacccagatcaaattcttcccatgatttgatcattcagaaaatctttgacaaagaggttgacaaactcaagctggagtcagacaacccagatgctaattctggctctaatagggatgcactggttgacttaaattagctccttccctacatcctttgcatcctaatttttctcatgtggaaactaagagcaacacattcccctgcccctccaacctcttgtttcacagtggagttccaggaccataactgcaggcaaccaaaaccgtcttcctaaagctccctctcctttagcttccatgagtctagaccttcctgaatttcatccactgcccccggattattgcttagtttagtttctgttcatctttgaatgaagacatttcccaagattctgttctgcccccaactctcctcagtttctcattaaatttctcactgcactttctcattcaattcctggttagtttcatctgatcacctccatgtccagacttccaagtgcaaaatccaaccctaatttttctccccaactccagtccaagattttcaactacctgctgatatcttcaagtcctgttgatacatcagtcccaatctatcaaaagagaaatcatctttcctccccataccttctccctatgttatattctttactttgattaccacttctggtcacctctgtaagacacctgggaatcatcagctttctctggttcacttgccaaatcttgttaattctaccaccccaatatcctttgaaatgtccctttgtcactatgcctaccccacttctctaattcagttcatctgcctgagggatttcaagagtttcctgactgatctgctactcatggatctaatttctgcaatgcatctttcattctctaatggacttcttttcctaaaggtgtgtcagatcatgaaaatttcctgcctttagtcatcctacataaaagcagaataaagaacaaactccttggcctgtcaacctaaaaggacggttcctttccagaaccatccaccatgaaatagcatcatacaaattacactggagcctcaccagagtgtgcactgttcctgcatttccataaacccatgattttctaactttttgcctcttctgtactcaccaaagtgatatgtatccttaaatttcttccctggccttcacaatcagaataaattagcccttcatttcagaaccaacaccacttttttttaatacatatataagaacttaaaaataaaactacttttgtctactttgtgtcaagcatttgaataggtactttatatgctataattcatttaatcctcattagttgaatcttcacagcaactttacattttagagatgagaaacttggtctaattaaggctgaatggttcacccgaggtcttactaaagtgaagtaaacgtaggagccaggatcagaatccaagactttgggattccaaagtcaattttctttatacttcgcaaaataatttctacagctaattgtttatatgtgtctccctaaaagactgcaagctctcagctgagaatgtgaataatctatttcagcccactacctcaaccctgcaaacacacagacacacacagacacacacacacacacacacacacacacacacacacagagacaccctaattgggttacttccacaacagtttgactctgtaactgttgaggaggtgaatgaataaattatcaaggttcttacattaatacctactcagatcttatgatagatattaatgacaaaagaggtatttctgtacctgtctctgtggaacttgcaaacacagaaaagaacaataacaaaataacatcagttgtagcatttactagtccagaaatagctcacctatgaaacaaacacaattttaattcattttccccatcccctaataggaaaatagttctttctgtgggggccaagggaaaacttccctgtcacactctgaaggttcactgaaaatcactgacaaaaggcagattaacaagagaaaaggcatacaaattcatttggtcatagttttgcatgacacgggagccttcagaatgaagagccaaagagacaggagaaattgtccatttttatgcttagattcaacaaaggatgaacagctgtgttgaaacacgattgggcaaaaagggaatgatctaatggtaacagactgagtggggaagctcagcaacgcctgtctgtttagatttctgggcctctctgaagctttccttccttctgggtatgaggcaggcccctctctggaatgcaggtgttatgacctacagtcaaacaagtcagataagttctttacggctagtttttatacagaagtggggaggagtgtagggggcagttagagtagtatttttaggttttatggctggctttaggggaaaggggttctggcttctatgacccgccttcaggaaggggaattctagtttctatgcctaaccttgggggagagtaagaggccagagacaggagggaacgaggtcagagaaacatgcttctgagtccctcatattgggatatcattttctgagctttaacatttctgtaagaataatgacaactaatttgaggtgcagcactaaaaatagaaggaatctagcagctcttgaggggtccatcctgagttgctttgttctgatcacttagcatgtgatcttgctacctagaaaattattttacctgtggtttttctcattgaaacccaggccataaattccatcctgcactaccttccttccactcgatcacatttgcattttttggctgccacgagacttaccttgagttctgcttctttttttatttttatttttgagatggagtctcgctctgtcaccaggctggagtgcagcagcgtgatctcggctcactgcaacttccacctcccaggttcaagcgattctcctgtctcagcctcccaagtagctgggactacaggtgcccaccaccatgcctggctaatttttgtatttttagtagagacgggtttcactgtgttggtcaggatggtctcgatctcctgaccttgtgatctgcccacctcgggctcccaaagtgctgggattacaggtgtgagccaccgtgcccggcctgagttctgcttctttccaagatagatcctctggttttctgttgattctgtgagcaccaggtactccaaagaatatcatttcaacaaacagttttctgtttaaaccaatcaaagtaagatcctatggcttgaaattaagaatcttgcctgacataatccctgtctcttgataaacacaaacaggcaatcaccaaaccagtgccataactccacaactcaatttttaaaaattaaaatataataaatcccctctcttttcatttattcgttcgttcatggcaggtacatttctagataatgaagatacagttataaattttgatggattttacaattttcatatctttgttattggcaaccaaagggtataacatgcacagtccagacaaggaagttaatcagaaacagtaaaaacttatcttcccgaaatgataacctgaaggtcaaatacaacaggagctactcttgccctttcaaatggccaacaatctgaagatatcaactaaatgccaaatattaccaaaagtaaatactataggagttgcccagtttgttaggtgagagtttaaaggaaactttagaaagaatgagcctgaaatgatgggaggaacacaggtgtgtatagagaaggagggatggaaccatttatggtgaaattttctcagaaatggcacaaagaaaggagctcaagaatcacagtcaacacccaaggaggagggtaattcattggattgaaaggatcccagaggaataaaaagttgtagaagaaaagaccaaactattgcatttgctcaccaagttctagagaattattttatcctctaggtcacagagatgggctgcagggggtggatagataagatgtggtgtgcaagttcttaaaatatgtactgcatatcatacattttaggtgggtattggacaattttcttagtgaataaagaggaaattcatttagcaaaaatcaaaattaaggtaactctagcattctttttcctttctctctgaaaaggtaataattgtgatatctgccaatttataatagaaatgtttaaaaacaaaagaattaaacttagagagttctccttaaaagtcagacaaatttatcaacaaaagagaagaaaccattgtctcaagtgtctttttgttgtttctttattcttcttattttctgcaaaaaaaaaaaagaatgagcctatgaaaagcaatgttaatgatggcacactctggggttttcactaatgttttaaataggctttacatagagcagcaattatgtgagatgatatagttaaacagtatcgataataaaatattccatttgagcacctcaaaatactttggactaattcatattagaacatcttgctatcagaactgttgagtttaaaataatatacacatatgtatatgtatactcatatattatataaacacagttacacaaaagtaaatttatttattaatagattcatccctttttatctatggtcataaaattcaaggatcagtaatagaatccatagatcccctaaattcatttgtgatttttttttttttttttttgagatggagtctcactctgtcaacaggctagagtgcagtggcaccatcctggctcactgcaacctctgcctcctgggttcaagcgattctcctgcctcagcctccagagtagctggaattacaccactatgcacaccacgcccagctaattttttttttttttttcagtagagacggggtttcaccatgttggccaggatggtctcgatctcttgacctcatgatccacccgcctcggcctcccaaagtgctgggattacaggcatgagccactgtaaccgactgcatttgtcatcattttttaacatctttcttattcataaaccaattagctagtgggaaaaaattaattagcatttgtaggatatactttttttttttttgagacagagtcttgttctgttgtctaggctggagtgcactgacacgaccttggctcacttcagcctccaccccccaggttcaagtgattctcctacctcagcctcctgaactacaggcatgcaaccaccacacccagctaatttttgtatttttgtatttttagtagagacagagtttcaccatcttgcccagtccagtctcgaactctagacctcaggtgatccacccacctcagcctcccaaagtgttgggattacaggcgtgagccactgcacctggccaggatatactatcttgattttttcctaatcttaactttaaagatgctcctatgaataatactaataaggtcccaggtaatgagagagaacaaagggtaaagagtcttggtaattcccagg

SEQ ID NO: 22 - DNA, 13264 bp, Homo sapiens; identical to SEQ ID NO: 21

SEQ ID NO: 23 - DNA, 24329 bp, Homo sapiens
tagataataatttgtgtaagaatctcctttgtaataactggtctggcatcacagacaagcctgaaagaaatttgccagttttgtatccaatttcccaacataattgcaacatccttccagcccccccaccccccagaatatccactgctccttctttcagccatctctatttttctgctgctttcatcattaatgagttcaataacacctttgacatctgctcaccctgtttttgtatgagtcatgtttgtttgttctttgagacagggtctcattctgtcacccaggctggaggacagtggcacaatcatggctcactgcatcatggacctcctaggctcaagcagtcctcctgcctcagcctcatgagtagctgagaccacaggtcgtgccaccacacccagctgtttttgaatttttggtggagatggagtttcaccatattgcccaggcgggtcttgaactcctgaactcaagtgatctgccttcctcagactcgtaaagttctgggattactggcatgagccaccacgcccagcctggggacatttttttttttttttgagacagcgtcttgctctgtcgcccaggctggagtgcagtggtgggatctcggttcactgcaagctccgcctcccgggttcatgccgttctcctgcctcagcctcccgagtagctgggaatacaggcgcccgccaccacacccggctaattttttttttgtatttttagtggagacggggtttcaccgtgttagccaggatggtctcgatctcctctcctcgtgatctgcccgcctcggcctcccaaagtgctgggattacaggcgtgagacactgcgcctggccttttttttttttttttttttgagacagagtctcgccctgttgcccaggctggagtgcagtggtgggatctcggctcactgcaacctccacctcccgggtccaagcgattctcctgcctcagcttcctgagtagctgggattacaggtgcccaccgccacgcctggctaacttttgtaatttaagtagagacggggtttcaccatcttggccaggatggtctcaatttcctgacctcctgatctgcctgcctcggcctcccaaagtgttgggattacaggcatgagccactgtgcctgaccagggacacattttaaaagttaaaaacatgactcttagccaggtgcgatggctcatgcctgtaatcccagctacttgggaggctgaggcaccagaatcacttgaacccaggaagtggaggttgcagtgagccgaaatagtaccactgcactccagcctgagtgacagagcaagactctgtctcaaaaaaacagaaaatgtatacgtgtgtgtgtgtgtgtatatatatacacacacacacacacacacacacacatatccctgttttatttcatttttattatggggtttttgttgttttctgtttttgtttttgtttttgtttttgttttgagacagtcttgctctgtggcccaggctggatcggctcactgcaacctccacatcccacttccaagtgattctcctacctcaacctcctgagtaactgggactataggtgcccactgccacacctggctaatttttgtatttctagtagacagggtttcaacatgttggccaggctggtctggaactcctgacctcaggtaatccgcccacctcagcctcgggctattttttattgaagaataacatacgtacagaaaaagcatataatcacaggtacgcagcttgacacatttacgcaaagtgaatattctatgtaaccagcagctaaatcaagaaacagaaaattataagcagagcagagtccccgtcctgttcccatgtagtcactggtccttctaaagcaatcaccattctaacttctagctacatacataaatattctcttaatttgtcttaattttctcataaaaatggaatccataatatgtactcttttgtgtctggcttctttcattccacattatgtttgtggcatgtagttatatttcattcattctcatttctctatagtattccacagtgtgactaaactaggtattacatgattatgtggaatgattggaatgctctgacaccgctgcaactttaaataaccactttgcgctgtgtacagtggctcatgcttgtaaccccagcattttgggaggccgaggcagaaagattgcttgagcctagaggtttgagaccagtagggcaacatagtgagtccctgtctctacaaagaataaaaaaattaacaaaccatggtggctcacgtcagcagtcccagctacttgggaggttgagggaggaggatcacttgagtccaggaggtggaggttgcagtgagctggaaaacaaaacaaaacaaaacaaaacaaaaaacagaaaagaaaagaaatagcccctaagtggccagatgcggaatcccagcgctttgggaggccaaggagggcggatcatttgaggtcaggagttcgagaccagcttgacctacatgtcagaccctgtctctactaaaatacaaaaattagctggacgtggtggtgggcacctataatcccagctcctcgggaggctgaggcaggagaatcgcttgaatccaggaggcggaggttgcagtcagccaagattgtgccactgcactctagcctgggtgacacagccagattccttatcaaaaacaaacaaacaaacaaaaaatgcccctaactgggaactgcttaaatgtccataataaaagaagacaggggccaggcacggtggctggtggctcatgcctgtaatcccagtactttgggattcctaggtgggcagatcacttgaggtcaggagttcgagaccagcctgaccaacatggtgaatatccatttctactaaaaatacaaaaaatttagctgggcgtcatggggcatgcctgtaatcccagctactcgggaggctgaggcgtgagaatcgcttgaacctgggaggtggagattgcagtgagctgaaattgtgccactgcactccagcctgggagacagagtgagactctgccttaaaaaaaaaaaaaaaaaagaacagtgtattgtactgcacgcacatattttgtgcatctgctgggttataagacctaaatggtagagtcatttgcaccacatcctggacaggctagagaatctcctcttgctctgggctccaccggccttacagttcacttcgctgatgagtgagagcaggtctcccggccatgatacaagctgcccccaaaattccaaagggctttttcttaccaccttttccatcaaaggatgggggtataggggatgaaagtttcagtagcttgccctgtgtttagggaaaaaacaaaattctaacaaaactcttctcccggacctccaaaatatctctgggctggcaggtctctgtattttttttttttttattgaacttccttaaatgcacataagtcagctaatacttccatggtacctgtttctttctgctcttggtacatcgatattattattattataattatttaattattatgaaacaaggtcttgctctgtcgcccaggctggagtacagtggcacaatcacagatcactgcagcctccacctccttggctcaagtgatcctccagccttagcctcctaagtagctgagaccacaggtgcacaccaccatgcctgataattttttttttttttttttttggagacggagttgccctctgttgcccaggctggagtgcagtggtgtgatctcagctcactgcaagctccgcgttccgggttcacaccattctcctgcctcagcctcctgagtagctgggattacaggcacccgccaccactcccggccaattttctttcttttttttttttttttgtattttagtagagacggggtttcaccatgttagccaggatggtctcgatctcctgacctcatgatccacctgcctcagcctcccaaagtgctgggattacaggtgtgagccaccgcgcctggcccaatacccggctaattttgtgtgtgtgtgtgacgcagtctcgctctgtcgcccaggctggagtgcagtggcgctatctctgcttgctgcaagctctgccttctggcttcatgccattctcctgcctcagcctcccgagtagctgggactacaggcacccgccaccacgcccggctaatttttttttttgtaattttagtagagacggggtttcaccgtgttagccacgatggtctcaatctcctgaccttgtgatccgcctgcctcggcttcccaaagtgctgggattacaggcctgagccaccgcgcccggccaattttgtatttttagtagagatggggtttcaccatattgtccaggctggtctcaaactcctgacctcgtgatccgcctgcctcggactcccaaagtgctgggattacaggcatgagccaccacgcccagccagaattttttcttttttctagagaagggggtctccgtatgttgcccagtctggtcttgaccacctgaccttcattgattttcctacgtcggcctcccaaagtggtgggattacaggtgtgagccactgccaccggccagtaattatgctgatgaaagacctgttttttctccagttcctgggatggctctagggagggttatttacactgtgagtgaggaggcattcacagagaagttcctccagagtgtggaagaagcactaccatttggcaccaacgcctggagaacaaaggaggagaccattggccaaagagaggcatttccattttgttggaacctgctgaccaccaacccatagcattttttccctttcttccttgctaatccaatcgcagattcattgaggaggtgagaggtcctgagatccaggctggaagaggagtgattggtctacctggttctcaagggataatgttgccccctagaggacattttggaaattattaaggaaaattaacgactggttttttggttgtcatctggttctcaagggaacagtattgcttccttgggagaatttggaaacttaccttttttcatcgtcacaatggtgaagggtttgttactgggattagaggacaaggaccagacatgccaagatgttctacaatatagcattcctaattaataatcacctaatgaataaagctcagatagcacttaaaaagtggggaaaggactgtttatactaaattatgctaagctgtaacactgaactattccagttcttttgaaattgtttacatagcaaaatcatagttgactcctggccatttaagacttatgccaccactcttgggatagtgaaaatgttttgcaactagattgaggtggtgattgtataatatggtgaaagtactaaaagccactaaattgtgcacttcaaaatgctgcctaattttatattatgtgaatttcacctcaataaaaatgtctttttttttttttttttgagagggagtcttgacctgttgccaggctggagtgcagtggcgcaatctcagctcactgcaacctccacctctcaggttcaacccattctcctgcctcagcctcgcaagtagctgggactacaggtatgcgccaccacacccagctaatttttttgtatttttagtagagacagggtttcaccatgttgaccagcatggtctcaatctcctgaccttgtgatccacctgcctcggcctcccaaagtgctgggattataggtgtgagcccccgggcccagccaataaaaatgtttttttaaaaggatgcatatttccaaacatgagactataccatcacatttaatttttcccagaaactataaaaagtagaagtgaagagaggaaagggagacacttttagaccttcaatgagtctgcaagtacaggagaaaataatttatgcagcaattagctttattttcagggctctttttcttttcttttttttttgttgagacggagtctcgctcttttgcccaggccggagtgcagtggcgctatcttggctcagtgcaagctctgcctcctgggttcataccattttcctgcctcagcctcccgagtagctgggactacaggcacccgccaccatgcccagctaattttttgtatttttagtagacacggggtttcaccgtgttagccaggatggtctcgatctcctgacctcatgatccgcccgcctctgcctcccaaagtgctgggattacacgcgtgagccaccgcgcctggccaacaaagtgatcattttacaagagttatggcatagtcacaggtaagaacctgggtcactgggtcactccctaaccaattacgaattactatatgccatggaccttcaggattactttcttttttgttttgtttttgtttttttttttgagacagagtctcgctctgtcacccagaccggggtgcagtggcgcgatctcagctcactgcaacctctgcctcccggattcaagcaattctcctgcctcagcctcccgagtagctgggattacaggcatgtgccaccacgcctggctaatttttttgtatttttagtagagaccgggtttcaccatattggccaggctggtctcgaactcctgaccttgtgatccacccaccttgacctcccaaagtcctgggattacaggcgtgagccaccgcgcccagcccaggattactttctttctttcttttgagacagagttttgctcttgttgcccaggctggagtgcaatggcacaatctcggatcactgcaacctccacctctcaggttcaagcgattctcctgcctcagcctcccaagtagctgggattacaggcatgcggcaccatgcctaaaattttgtatttttagtagagatggggtttctccactttggtcaggatggtctcgaactcccgacctcaggtgatccgcccgcctcggcctcccaaagtgctggtattacaggcatgagccaccgtgcctggcctctatttttctttctataatccatgtacattttcctttaataatataaggcaactaaacagcactttattttcagaggcttatctaaaagatacttgacacagccctttgcagctgggtcattctctgaattctaaatgtcgtttcctgcacaaagtggttatttgatcttgtaactggcattttccccggagattaggaagtggcacaccaaagtgcaaaaaactttggaatcagaactttaatttttaatctttattttatttatttatttatttttgtgacagagtctcgctctgttgcccaggctagagtgcaatggcaagatctccactcactacaaactccacctcccgggttcaagtgattctccgccttcagcctcctgggtagctgggatcacaggcgcacaccaccacactcggctaatttttgtattttgagtagagatggggtttcaccatgttggccaggctggtctctaactcctgacctcaggtgatcctcccgtccatgcctcccaaagtgctgggattacaggtatgagtcactgtgcccggcctaatttttatatttttttgtagagacggggtctggctgtgtttgacagcctcaaactcctggcctcaagtgatcctctcaaagtgttgggattacagacatgagccacagtgcctggcctattgaaagcttttccatcataataggtccttccccccaatgcttgcagcaagtcaatagtaggagaccccaggttgcagcagagaaagaggtttaatcataggggccactgaaaaccaagagaggagatggaaggaaccacgaatccacttccccagggagttcggggctttttaagggttttggagtgggttgaagtgtggaggtcattggttggttgaagtgtgcagggtgaagtaatgaaacagggagttgaagaaactctattctcctgtcgatttggttcctctgcggggtcttcacactggttggtatcagctgttttgctggaattcaggatctgaaaaatatcttaagcttttttttttttttttttttttttgagacaaggtctgttgtccaggctggagtgcagtggtgccatcatagctcattgcagcctctaacgcctgggctcaaaggatccttccaccttagcctcccaagtagctgggattacaggcacgcaccaccacacccagctaattaaaaaatttttttttttgtagagacaggggtcttgtcatgttgcccaggctggtcatgaactcctgacttcaagtgattttcctatctcagtctcctaaagcgcatggattacaggcatgagccaccatgccgggcgctaagcaattcttattatttatttatttatttatttatttatttttttctgagacggagtcttgctctgttgcccaggctggagtgcagtggcgcgaactcggctcactgcaagctccatctcccaggttcatgctattctcttgcctcagcctcctcagtagctgggactacatgcgcctgccaccacgcccggctaattttttgtagttttagtagagacaaggtttcaccatgttagccaggctgatctcgaactcctgacctcgtgatccgcccacctctgcctcccaaaatgctgggattacaggcgtgagccaccacctccggcctaagcaattcttaaataaaaatctatgattccgccaggcatggtggctcacacctgtaatccgtgcactttgggaggccgaggcgggtggatcacaagttcaggagttcgagaccagcctggccaacatggtgcaatccctgtctctactaaaaatacaaaagttaggtgggcatggtggcttttttttttttttttttagacgggagtctctgtcatccatgctggagtgcagtggcaggatcttggctcactgcaacctctgcctcccaggttcaagcgattctccggcctcagcctcccaattggctgagactacaggcgtgtgccaccacgcccggctaattttttagtattagtagagatgggggtttcaccatcttggccgggctggtctcgaactcctgacttcgtgatctgccctccctggcgtcccaaagtgctgggattacaggcatgagccactgtgccctgccaaaaagcctatgattctaacatcagaaatccttccacctcagcctcccacgtagctgggactatagactcagtaccaccacaccaagctaatttttgtatttttaatagagatagcgtttccctatattgaccacctggggccatccctggttttttttttttttcccttccttccttcctttccctctctctttccctccctccttccttcctttctttctttctttcttttttttttttttttacagagtcttgctctgttacccaggttggagtgcagaggcatgatcttggcttactacaacctccgcctcccggattcaagcaattatcctacctcagccttccaagtagctgggactacaagtgtgagccaccatgccctgctaatttttttatttttactaaagacgggatttcaccacattagccaggctggtctccaactcctgatttaaagtaatctgcctgccttggccttccgaagtgctgagattacaggtgcgagtcaccgtgcctggcctattcctgttttcttaacgctcctctctcccactgggccgtgactgcctctaaggcagagatgtgttcatttttattattattgtatgtccagggctgggcacaaagtgcaacacatagtagggacatgaaaggctgggcacagtggctcatggttgtaatcccagcactttgggaggcagaggcgggaggatggcttgaggccaggagttggagaccagcctaggcaacagagggaccccatctctatgaaaaaaaaaaaaaaaaattgacagttcaatgtcacctctgataagccttccctgaccacccctgttactctgtagccccatgtcctgctttatttttctccaaagcatttatcatcgctgggtttatatttatttctcttcgggcttttctcactggatcgtaaactccatgaggacagggctttgtcgatttcactcaataccgttattttacaacatccctattgctgggatctcagtatgcactccttaaatatttgcagaatttaagtgccacataagtgaccacgtgggcaacgccctcggggccttaagccgcgccatttttggggctaggattggttggaccctccgtcacgtgacatgcagtcgccggatcgcctttgagtctcgtgaggtacttttggtcccaggctccgcggacgaggtactgcgcaggcgtgggagggtctgcgcatgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtcagggccggcgcggcttgaggccgctagggtctggagggggcgtctattctgaggcgtttgcggcccggaaggagcgggaaggtgtgatttgaagggaggaggcgggaattctgtgctctgggatcgtctctctcttggggggactggaggagttgattggggatgtttctggaaggtctgggaagtggttgggagggccgttccgaaggatgggagctctgaagggggcgttggggagtcctgagagagcgggagaattcaaactcaggaaatccgaggcccgaaagcggtgattgtggggtttgatcgcggttaggggataagaggggctggggatacgtggaaagggtgaggtgagggacgcagttcattcattcgagggtatgggacctggttccgtgctgcacacaggggagactggactggccaaccggacagacgggagcttacactcttgtgggagctcacgggcgggccagtctgagagaatgcgggttttgaggagttttggagcaagttatctcaaatgggaatcttgagaggctcggagaggctggagggggacggccgtaggctcccgaaaaggttgcttgtgtttggtatggggctgtgtcttgataggacaggagacgtagtttgggcattgtggagtagcttagggaattctttttttttttttttttttttttgagatagtctctctctgtcgcccaggctggagggcagtggcgcgatctcggctcactgcaacctctgcctcccggattcaagcgattctcctaactcagcctcccgagtagctgggattataggggcccgccagcacgcccggctaatttttgtatttttagtagacacggggtttcgccatattgacgagactggtctcgatctccttacctcaagtgatccacccgcctcggcctcctgaagtgctgggattacaggagtgagccaccgcgccaggacgtcttttgttttgtgcagttgggtgacctcggttcactgcagcctctggcctcccgggttcaagacttcctctcacctcagtcttctgagtagctgggattacaggctcgcgccaccatgcctggctaatttttgtatttttagtagacatgggttttcaccatgttggccaggctggtctcaaactccggacctcaagtgatctgcccgccacagcctcccaaagtggttggattacagacgtgagccactgtgcccagcttgttttttttttttttctttctctgtggcccagtggagtgcagtggtgggatcacagctcactgtagcctcaacctccaaggctcaagggatattccctcttcagcctcccaagtagctgggactacaggcgtgccccaccacatcatccgactaatttttgtttttttttttttttgtaggatggggttttgccatgttgcccagactggtcttgaactcccaagctcaagcgatcctcggcctcaagagatctccccccatctcagactcctaaaatgctgggattacaggcatgagctaccatgcctggcctcattgatcaatatttttacttagcctggacgcagtgactcacacctgtaatcccagcactttgggaagctgagttggggggaggggacctcttgagcccaggagtttgagactagcctgggtaatgttgccaaacccagtctctacaaaaaaatacaaaaattagccaggcatggtgacataagtttatagtcccagcttgtcaggagactgaggtgggagcatcacctgagcccctgggaggtggaggttgcagtgagccatgatcacaccactacaccccagcctgggtgacagagtgaggccccgtctcaaaaaaaaaaaaaaaatccacaagcgtgtgtatatgtgtcagttattaaaggatggtgaagtgagagggttgttttgataggttggccagggaagggctctgaagaggtaacattgagcctcagacttatatgggaaagagccctgtggtcatctgggagaactttcctagctaagagaacagcaagtgcaaattcccagaggcccaggcatgattgtcaaattagagaaataaggtggcaggaaccaaatgatttgaggagtagcttttattctaagtgtgtgggaaaacctgttggagtgttttgagtgtgggagtaacatgatctgttttttgtttgttttttgagacggagtcttgctctgtggcccaggctggagtgcaatggcacgatctcggctcactgccattgcagtgaatccgcctcccaggttcaagcgattctcctgcctcaccttcctgagtagctgggactatcggcatgtgccacaacacccggctaatcttgagtatttttagtagagacggggtttcaccatgttagacaggatagtctcgatctcctgacctcgtgatccgcctgccttgggctcccaaagtgctgtgattacaggcgtgagccactgcggcctggcctggtttgtgttttaaaatgatcgctccagaataggttaaagtggtcagaaatggaagtaaagattctggctggactgttgcagtaatccagttgagataaaaatattggtggcttgaaactcaagagaaggggtcaaataaatatattctggatatattttgaaggtagaagagggaacagaatttggggcagaagtccaggatgacaccactgtttttggcttgagcacctacctggaacgatggaattgccattttgaaagatatggagagctgtaggtttggtggggtcggggaagagtcagttctcttttaggtttcagatttgttttttttgtttgttttttttttttttgagacggagtctcactctgtcgcccaggctggagtgcagtggcatggtctcggctcactgcaacctctgcctcccaggttcaagcaattctcctgcctcagcctcccgagtagctgggattacaggcgcccgccaccatgcccagctaatttttgtatttttagtagagacggagtttcaccgtgttggtcaggctggtgttgaacccctgacctcgtgatccacctgcctcggcctcccaaagtgctgggattacaggtgtgagccaccatgcccggcctcagatttgtttttttatacaactaagtagaaatatgtgaggggttgagttcagaggtaaaatttgggtgatggtgggtattgtgtgagtacagagtatagaattaatggaggggttggggaggcagacacgtcaggagaatttagtttgagggggtgggagctttcagaaggttttagagggtgcagtggtgggatgggaattacctcaggctcatttcagatctgtggggtcttctttgatggggtggggggatgtcatcatgaggcattaacattggtgggagggttgaaggcacctggaatagattgggaattaagtgatgagaatgtgcctctggacataggtggactgcattgattttagggactgctattttctggatggagtggaaagaggatttatgtgagttggaggaaactttgaggaagcttggtgtgttctgagatcctaaagggttggggaggggattctaaggtactggaagggttaatcgaaggggtttgcggcagcagatagctttgtttgaagtggggcaaagttggtgaggtttaaactggaatgtagttagggaactttcagagggatggggatgatttttctgagaagcagtgaagaatggatgggggcctctgagtgggagatgacctaagggacaagtcagggtcagggcatggaatttgtgggaggtaggaattattctgagggagtggagctgtaccaaatttggtggagaacatgaaaaggattggctgggggttgcaggagggagggaagaggttgtttgtaatttgtactctatttttagacagtcttagagagtttattaaagtgttttttgtccattttcagccgaggtttttagaaattaaaaatttttttgtgtgagtacatagtaggtgtatacattttgggggtatgtgagatactttgatacaggcatacaatgggtaataatcacatcagggtaaatggggtatccaccaccttaagcacttatcctttgtgttacaaacaatccaattatattcttttagttgctttgaaatgtacaacaaattattgttgactgtagtcaccctgttatgctatcaaatactgtatcttattcattgtatttaattatatttttgtatccattagtcatccctccttcccctccaccccccactacccttcctagcctctggtaaccctcagtctactatctgcatgagttcaattgttttaatttttttagttcccacaaataagtgacagcgtgcaaagttttctttctgtgcctgatttatttcacttaacataataacatccagtgccctccctgttgttgtaaatgacaggatctcattcccttttttttgtagacagggtctctctgtcgcgcagactagagtgcagtggtgtgatcacaactcacttcagccttgacttcttgggctcaggtgatcctcccacctcagcctcccggtagttgtgactatagcacgtgtcacaagcccagctaatattttagtacaggtggggtttcaccaggctagtctccaactcctgggctcaaataatcctcctgcctccctgcaaagtgctgggattagaggcgtgaacagcaatgcccagcctttgtaccacaatttctatttttttttttgaaacggagtctcgccgtgtcgcctaggctggagtaggctggagtgcagtggcgcagtcttggttcactgcaagctccgcctcccaggttcacgccattctcctgcctcagcctccctagtagctgggactacaggtgcccgccaccacgcccggctaatttctgtatttttagtagagacggggtttcaccttgttggccaggatggtctcaatctcctgacctcgtgtaccacaatttctttatccatttgtctgttgatagacatatgggttgctttcaaatcttggctattgtgaagagtgctgcaataaacatgggatttattgcagttttttttcttttgagaccgagcctcgctctgttgcccaggctagaggacagtggcacgatctcagcccagtacaatctccacctcccaggttcaagcgattctcctgcctaagcctcccaagtagctgagattacaggcacctgccaccacgcccggctaatctttgtattttttagtagagatggggttgctgtgttggccaggctggtctcaaactcctggcttcaggtgattggccctccttggccccccaaagtgttgcaattacaggcgtgagccaccacacccagcctgatttattttcatttgggtatatacctagcagtgggattgcatttttacccgagtcttttttttttttttttttgagacggagtttcgctcttgttacccagactggagtatggtggcgtgatctcagctcaccgcaacccttgcctcccaggttcaagcaattcttctggttcagcctcccaagtagctgggattacaggcgtgtgccaccatgcccggctaattttgtattttagtagagacgggattcctccatgttggtcaggctgtgaactcctgacctcaggtgatccgcccgccttggcctcccaaagtgctgggattacaggcatgagccacagcccccggccttcacctgagtcttatagcagctctctggagtcggaagggcagtgatttccttctctgttcagatgaggaaggaggctccacagagcaaattgacttgcctctaagagggctctaggtgggataggagggttctaggtgggataggagaactctggagactggagttcctttatgaaacagaagccctggaaatgggcaggctgataaaatgtacaaattgtggggcattttataagacagttatcctacttctcttccaaaagtcagtttcatgggaaaaataagtgaagggactgttgtggattaaaagagagtaaaggccgtcacagtgactcagcctgtaatcccaggactttgagaggccgaggtgggtggatcacctgaggtcaggagttcgagactagcctggccaacatggtgaccgtctctactaaaaatacaaaaaaaattagccaggtgtggtggtgggtgcttgtaatcccaactacttgggaggctgaggcaggagaattgtttgaatccaggaggcagaggttttagtgagccaaggtcacactatcgcactccagcctgggtgacaagagcgaaactctgtctcaaaaataaataaataaaataaaataaagtaaagaagcagcttcctagagcagatttggttgcttaaattgaggccaagtttctggagtttttattgatagttgacaattacaactaaaatttttttttctcgctctgttacccaggctggagtgcagtgacgcagtgacgtgatcttcagctcactgcaacctccacctcccgggttcaagggattctcccgcctcagcccccaagtagctgggaccacaggcgtatgccatatcactcagctaattttgtgtgtgcatggcgtatgccgtaacactcagctgattgtgtgtgtgtgtgtgtgtgtgtgttgttttttttttttttttgtgatggactctcactctgtcgcccaggctggagtgcagtggcacaatcttggctcactgcaacctccgcctcctgagttcaagcgattctcctgccttagcctctggagtagctcggattacaggcgcgtgccaccacacctggctgatttttatatttttagtagagacggggttttaccatgttggccaggctggtctcaaactcctcacttcaagtgatctgcccacctcggcctcccaaagtgctgggattacaggcgtgagccactacacccggcctatgtgtgtgtattttatttttttatttttttgagacggaatttctctcttgttgcccaggctggagtgcaatggcgtgatctagactcactgcaacctctgcctcccgggttcaggcaattctcctgcctcagcctcctaagtagctgggattacaggcgcctgctaccgcgcccagctaatgtttgtatttttagtagagaccaggtttcgccatgttggccagggtggtcttgaactcctgacctcaggtgatctacccgcctcagcctccttaagtgctgggattacaggcatgagccactgcgcctggccagaagttaccttctttgtgcctgttttctcagctgcaaaagaggggtaacaaagtgccagcccattagattgtcatgggaattaaatgacataatacatacaaagagcttagtagaacagtgcttggcacatagtaagtgttagataaatgttggccattattattttattatgtaccagatttctataattctgctgatggacacaggtttgttttggtgtgtctattaattcacagccatttgagtaacagtatgtcctaaatgccaaggaagttactggttctagtgatacagtggtttctggagtttacattctaatggaggagggggcagtaaacatataaacaagtagtgtagcttagcacagtggtgtgtggctgtgatcccagctactggggaggctgaggttggaggatcacttgagccaggcaattgagactagcttgggcaacttagtgaggccccatttcaatcaaaacagtgggcaacacagaccccatcttaatcaaaacaaaaacaagtagcataattcgagatagaagaggatgtggacctattttaaattaggtggccagtatggacttctctaaggaggtgacaattgagctgagacctaaagaatgtgtcccttaagaagttgagggaagaagcaatgggaagcactaatgccaaggtcctaaggtgggagcaaggatgggagcaaggatgatgttctctaggatcagcctcccgagtagctgggactacaggcacgtgccaccacgcctggctaatttttgtattttgagtagagatggagtttcaccatattggccaggctggtctcgaactcctgacctcaagtgatccgaccgcctcggctaattttgtgtatttttagtagagacggggtttcaccgtgttagccacgatggtctccatctcctgaactcatggtcctcccaccttggcctcccaaagtgctgggattacaggcgtgagtcgccgcgcctggcacacccagctaatttttttttgttttgtacagatggagtcttactttgttgcccaggctggtttcgaactcatgggctcaagtgatcctcatgccttgccctcctaaagtgctgggattacaggtgtgacccactgcgtccagcctgctgtagttttgtcggagagaaacgatggtggctcagactagagtggtgtttgtggaacttgagggaagtagatggacaatgctgctgtgaatgtgtatctttttttttttttttttttgagacagagtctcactcttgtcacccaggctggagtgcagtggcgcgatctcggctcactgcaagctacaccttccgggttcacaccattctcctgtctcagcctcccgagtagctgggactacaggcacccgccaccactcccggccaatttttttttttttttttttgtatttttagtagaaacggggttttaccatgttagccaggatgatctcaatctcctgacctcgtgatctgcccgccttggcctcccaaagtgttgggattataggcgtgaggcaccgtgccctgctgaatgtgtatcatttttgtgcccacttgggtatttctttttttttttttttttttgagacggagtctcgctctttcgtccaggctgaagtgcaatggtgcggtctcggctcactgcaacctccgcctcccgggttcaagcgattctcctgcctcagcttcccgagtagctgagattacaggcgcctgccaccactcccggctaattttttttttttttctttttgaaacagacccttgttctgttgcccaggatggaatgcagtggcgccatctcggctcactgcaaactccacctcccgggttcacgccattctcttgccttagcctcccgagtagctgggactacaggcgcccgccaccatgcccagctaattttttatatttttagtagagatagggtttcaccttgttagccaggatggtctcggtcttctgacctcgtgatctgcctgtctcggcctcccaaagtgctgggattacaggtgtgagccaccgtgcccagcccacgcccggctaatttttgtaattttagtagagatggggtttcaccatgttggccaggctggtctcgaactcctgacttcaggtgatctacccaccttggcctcccaaagtgatgggatttgtaaacccagcactttgagggaggcagaggcaggaagattgcttgagcccaggagctggagatgagcctgggcaacatagtgagaccctgtgtctacaaaaaaaaaaaaaaacccataaatcagccaggtgcagtggtgtgcacctatagtcccaggactcaataggccgaggtggcgggatcacttgaacctgggaggttgaggctgcagcgagccctgatcttgccactgcccttcaatctgggttcacagaatgagaccctgtttcaataaaacaaaacgtaaacatggtatttggtgttgatggcagttgagtatttaatttaatttaatttaattttttttgagacggagtctgtcacctgggatggagtgcagcggcacagtcttggctcattgaaacctctgcctctcaggttcaagcgattctcctgcctcagcctcccaaatagctaggattacaggtgcccgccaccaacatgcccagctaattttttttttttaaacagagtctcgctgtgtcacccagactggcatgatctccgcttactgcaacctccgcctcccaggtttgagtgattctcctgcctcactgtcccgagtaactgggactacaggcgcctgccaccacgcctggctaatttttgtattttctgtagagacacggttttgccatgttagccaggctggtctcgaacccctggactcaagtgatctgcccgccttggcctcccaaagtgctgggattacaggcgtgagcccccacgcctggccataattttttttgtatttttagtagagagggtgtttcaccatgttggacaggctggtctcgaactcctgacctcaggtgatccacccatctcagcctcccaaagtgctgggattacaggcatgagtcaccgggcccggctgaataatgaattttaaacaactgcagagcagtctgtagagctatgtaggaatgtaggtcgtggagagcagatttattgtcagggactttttatatgtagctgttgctggaagagttcggggagggggagtgcttgctggtattgactcagccatgataaaaaagcctttttttgaggaaatggcattggagttgggttttgaaggggaaaggcgtaggtaggcattgagaggaagaaatggtgcattttgcgagggtggaatgttgtgattaaattttatttaatttttaattaaattaatagcaaactcttaccagcagaacttaaattgtgtgaaaattattcttagttattactaaatccttttcagtatgaataatacatttgctgcagaattattaatgagtttggttacatgatgcagcccaagatcttgatgagttgtttcataatacatgatgtaaagtctgtatttcctttttgaaatctgaaaaaattgtgactctgaaatacttctggttcaagagatttcagataagatatagttgacctattctgcttcctactgacctcagagaagtcttgggatggcctgacctctgattgccttttttcagcctcatcttctgtcactttacagatttaaaaagctaaaaacaaggctgggcacggtggctcatgcctgtaatcccagcactttgggaggctgaggcaggtggatcacttgaggtcaggggttcgagaccagcctgaacaacatggtgaaactccgtctgtaccaaaaatacaaaaactagccaggcgtgacagtaggcgcctgtaatcccagctactcgggaggctgaggcaggagaattgcttggacctgggaggcggaggttgtagtgagctgagatcacgccactgcactccagcctgggcaacagagcgagactctgtctttaaaaaaaaaaaaaaaaaggtaaaagcaattcctgtgtacatgctcttttcatgccaccatgtgttttgcttgtgtgttatacttaactagtgcctcttctcagcacctcttctgctgtcatgctagtttgagccaccatcatcctccctcaccttaactgtgacatcttcctacccccatggctttccatcatgcctcgaagaaaatccagaatccttccattgcatgtaagagccttcatgatgtggccccttgttccaacttttcagcctctctgtcattcctgtccctagaacatgccaagcactcctgcttcagggcttttgcatttgctgttttctctatctggaatgttctgctgccaaatatctgtgtgtttgtcctttatttcattttgatttttgctcatatggcatctcctcagaaaggcttgtatgatttctgtctcaaatagcgttctccatcattcttgattcttgtcacacttgattttcatcactttttcacatattatgtatctatttgtttatctgtctcctactttttcatgagggcagggactatgtctgattcaccgccttatttccacaccatagaaggatgcctggcatagttggtactcaataaatatttgttgaatgaattgttttgtgcagtatggattagagcctgtctctttcctagattcgaggtgtgatgcctcaatgcagttagaaccaaaatgatttttttttttttgagacggagtctcactcttgttgcccaagttgaagtgcagtggcatgatctcggctcactgcaacctccgcctcatggtttcaagtgattctcctgcctcagcctcccaagtagctgagattacaggcgcctgccactacgcccagctagtttttgtattttagtagagacggggtttcaccgtgttggtcaggctggtctcgaactcctgacctcaagtgatccgcctatctcagcctcctaaagtgctgggattacaggcatgagccaccgtgcctggcaaaccaaaatgatttgtgtattttttgttcttctgtgattctgcaagctcactgttctgtatcatcaggttaacaatgtttgtcttacaggctgcgggcctctcgggtgcttcttgtcggcttgaaaggacttggggctgaaattgccaagaatctcatcttggcaggagtgaaaggactgaccatgctggatcacgaacaggtgcgctgttgtgagctcattcctcccctgctctggctcccctttccagcatgaagatctgcagattttgtgagttcctccttgtgccttaagggctgtgaaaggagggctaacattaataaaccattgcctctggagactgaaggtgctattgttgggtttgaattctagctccaccacatctagctggatgagcagtagagactcacaccccctcattgagcttgcctgcctgtaaaatggggttagtaatatctcccttggtggttgcttgtgaggaggtgtagagaagtgtttttccaatttgtgcctaaaaatgacctgagtgactaactgaaaatgcagagtggcctggaggcttcgtggtgccctagctttcacccctagtgattctcatttaggtctgaggcgagctcaggagtatgtgcatttaaaaggtgttttagggctggacgcagtggctcatgcctgtaatcccaacactttggaaggctgaggcaggcggatcatctgaggtcaggagtttgagactagcctggccaacatggcaaaactctgtctgtactcagtatacaaaaattagccaggcatgttggtgtgcacctgtaatcccagctactcgggaggctgaggcacaagaatcgcttgaatctgggaggtggagtttgcagtgagctgagatggcaccactgcactccagcctgggcaacagagtgagactttgccttaaaaagaaataaattaatgaaaggtgtttcaggagattatgatttagatggtccacagacatcactttaaaaaacactggatcaggccaggcacagtggctcatgcctgtaatcccagcactttgggaggctgaggcgggcagatcatgaggtcaggagatcgagaccatcctggctagcacggtgaaaccccatcactactaaagacacaaaaaattagcagggcttggtggcgggcgcctgtggtcccagctactcgggaggctgaggcaagagaatggcgtgaacctgggaggcggagcttgcaacgagccgagatcatgccactgcactccagccttggcaacagagtgagactccgtttcaacaacaacaacaacaaaaacaaacaaaaacaaacaacactggatcagagagaatgtgggcagactgctttgtatagtgcttgaac

SEQ ID NO: 24 - DNA, 656280 bp, Homo sapiens
taaatgttagtgtttgtgagtcacaaggtctgtcttgcagcgactcagatctgcacttgtggcatgaaagcagccattgactgaacataaatgaagggatatgggtttgtttaatgaaactttatgtacaaacgtaggtagtcactatggtttgctgaccccagcttttccattgccccatggaactttctttgggatgcctttttgcagtgggttctaggtgagaaaaattggctcggatctggatgctgaagttgagactggtgctgtcatgtggctactgccctcgtccatcctgggtgacttctgactgttgtgatgagcagggccctttgtggctgcctagctcctggtgccaagaatgatgaaccctctgcattgccctctgcaaagcagaccacaggacagccaccctgaattgctcgttctcactgtgtccaccttgcctaagatggttgggcacattcactggctggttaattccagatagtgttatctcattaatgccaggcagtaccttctagaagaggctcctaccatctgcactagactatggagcttctccggggtgctagtgctctgtcacctgaatatgcttcagggatttgctaaacagaatgtccttcaggccctcccatagaacacagggaaacattttgttttcccttgtgtgactgcaaaagggaaaacaaaaataagcctgggaaagggtgatttaggactttgatgatgtcgaggctgggaactcccatcagagtttctatatatgatggggaggggccaattttttgaaagtcagcattgactggccattggacacaggtggccctacattgactctctcttgcccaggacctctcctcaaaaagtctcaggtgattcagccccacagcagcaggggcacgacaccttctgtcctgaaggctgataaccggtgatgtggacagctgccattcactctggggaagatgctgcctaattccacacccaccgcctgcatgtctagtgagagcctgcctattcctatggggacaccccaaaattagctccaccaagaagcctcctccacctccattctccacagaagacactcatcttatatgcttggctacaggtcctgtttgctctgctattatccctatcacctgtccctgtctgttcaattgtctcacatgagcagagagacgatgtctcattcagccttatttcccatgggtattaataaatattcattgagtcaattaaaaattcatgtaataacctatcaatgcatgtctctgtgtgaggtaaagaaagcatcctgattgtaaatataactctcatgttaaaagctgggagcagtggctcatacctgtaataccagcactttgggaggctgaggagggtgaattacctgaagtcaggagtttgagaccagcctgatcaatatggtgaaaccccatctctactaaaaatacaaaaattagcagggcatggtggcgtgtgcttgtaatcccagctactcgggaggctgaaacaggagaatcacttgaacctgggaggcgaaggttgcagtgaaccgagatcatgccactgcactcctgcctgggtaacagagcaagactccgtctcaaaacaaacaaacaaaagcattcttacagattatcttggcttttattcctttattctaccaataagttgttagcctctcttatgtgccatttgttacaaaaaatcagctgtcatttttatggagactgagaagtcccctgatctgtccattgtaagctgaagacccagtagggccggttttatggattagtccaagccccaaggcttgagaaccaggggagccactggtctaagactcagtccaagggaaggagaggatcaaggtcccactcatgcagtcacacacaaaggaggaattctccctgctggtgccttttgttgtatccacgccttcagtagatttgatgatgccaaccacacagaggagggcaaagtactaacttagtccaggcattcaaacatgaatctcatctggaaacaccctcatagacacactcagaaatagtgttcaatctgggcacctcatggcctagtccatttgacccataaaacttaccattactatcattaaaatggcatacgttatgtatattttgttaccataaaaaatttacattctgaaaataaagtacagtgtcttagctcatttgtgctgctacaacagaatacttgaggttgagtgatttacaaagaacagacagttatttctcacagttgtggaggctgggcagtccaagatcctggtgagggcttttatactgcattctcatgtggcaaaggcagaagggctggagaaagctaaaggctgcatgaagcctctttcctaagggccttaatcctctcaagagtgaggagctgtcatgccctaattgcctcttaaaggccatctcttttaacactaccacactggcaacatctgaattttggagaggacacattcaaactatagtagcaagtttaatttggaaataattctactcaaaaaagcattagaattgagtaatgaaaccctgtatatcccctccctggatgcaacaatggggtacgttgagtccaatccagggagcattctcgcttcctctctctactccatcttaaaaaattaacaataattttctgtccactccataatcccatttcaccaattgcccaaaatacctacagtagttatttaattatgtttactaacagaatcctcaagattccaacccttatatttgatttttacttctctctgatcgatctggcatttatcgacgaagattccatcaaaccctgggcttatgaaaaattttgcaaaaattccacagataggaaagtgttcattgtgtgcagcagaaaaatgttcatcatgcagagtggaaacatgtttatgtgtggcaagcaatggtaaagtgagtcctgcattttaaaatgaaaggacagtagatggaaattagaggtcacactgtgaaataatgaattctgttaaaggcaacaacataggttagtataaaaggcagcattatggtatttttggttagtaacttctctttggaaacctatcacaagcagagagactgaatccataattaaaaccttccagccaaagaaagtccaggaccagatggcctccatgttttttatatcagccatttaaagaattagcatcaattcttatcaaactctgaaaaactagaagaggaagaaactattcctaacgagcccaacatgaccctgaccgaagtcagttaaagaccctacaagatgtgacaactaaagaccaatatacctcgtgaatataggtgcaaacatcctcaaaatgtgtgccagcaacatgaatccaacagcatattcaaaagattatgtcatataactaagtgagattaatatcaggaatgtaaggagggttcaatataagaaaatgaatcaatggaatatacaacattaatagctcaagagagaaaatacatattccaaataacatagaacaacaaaatccaacaccttctctaaatgaaaaaaaaaaagcacccagaaaactagaagtagaaggaaacaacctctgtgtgataaaaggcgtttgtaaaaatcccacaacaaacttcatactcaataatggaagaccgaaagctatccctctgacatctccggatgcctaaccttatttaagtgagttcagcaaagttgcaagatgcaagatcaccatgcaaaactcattcatatttttttttggggggggatggaatcttgctctgttgcccaggctggagtgcagtggctcaatttcggctcacctcaagctccgcctcccgggttcacaccattctcctgcctcagcctcccgaatagctggaactacaggcgcctgccaccaagcccagctaattttttgtattttttagtagagacggggtttcaccgtgttagccaggatggtctcaatctcctgacgtcatgatccacctgcctcggcctcccaaagtgctgggattacaggcagagccaccatgcccagcaactcattcatattttatatgcaccagcaatgaacatctgaaaaagaagttttaaaagtaactctatttacaagaccaccaaaaagaatacaaataaatttatccaagaagatgaacttcttgtacactgaaaatgtcaagacatttctgaatgaaatgtgcagagatgcctcaggtggctcctgcatattccgcccctggtgaagcatgtttgcattttcttgggaactgagcacctcctgcttggtcgtaaggcagacaggccacacagagaagaataattcctccctttgggccagcagttcagggatcaagaaatcctagacctgaggagtaatttctgaatctacacctagaccaaggtggtgtctgagcctccagcagtcagtgaagagcaaccagcagtggtcaacagagagtcacatggcaaagccgcctggagctgggctggacctgcatgtcagggagatgctgacatgcagggagggtcagtgaccatgacctaacactggggggaaaaatgtccttctttttctagagtatcatcgttaacattgatgtacaaactcttttgccccatgtctcttacatctggctcttttagaatttgcttatttcacagcaacaagttcaagtcttatactacattgcatcccagcccacccaattatgctaaaactctggatctgtcaaacactttcagagcagcagatttgtacctggccctaaacgcatagtggggacactgaggcacagctcctagggccttcccctgaagctccaccaagggcaaaaacttatacaagcttcatggatattaaaaacctccatgttcacttagcaagggagaaattttattcaagttctgcagctcaggagctgtgctcaagagcaagacccagaacttctcaaagcctggttttggcacctgtagaatggagcccaaaaacgcagacagacttacctcggagctctatagggccaggacagcccaggagtaaagccagtttgagacacaatttggggtgaagatgtcggcccagaatagaaccaggagaggaagaagaaacccgtgtgctgagagtgggtctgctgggaccactcctctccttcctgggccctttggggctgagcccttctctaaaaaccacagagctactccagcagcagcccctgactctgctgatttgcatcatggccgctttatccagcaaggggataagagaggcctgggaggaacctgctcagcctgggtcttgggaagcagcatcgggggtgcctcagccatggcctggacccctttcctcctcggcctcctccctcactgcacaggtgctgcccccagggtctcactcacttgcccagccccaggcctctgggtccagcctggccctaacactgagctcagtagggccctacctgtggtgggcaggatgctcatgaacctgccgcagggcagggggctggtggggcagaaatccccccacactgtgctcctgttctcttggtgccctaagggcacttttattcctggggctcaggtcagttcaggcaagtggcaagatattctttggttaatccccagagtttcaggccttttcgctcctcttttctctccttgcaggctctgtggcctcatatgtgctgacacagccaccctcagtgtcagtggccccaggacagacacccaggatcacctgtaggggaaataatattggaattaaacctgcttaatggtaccagcagaaaccaggccaggcccttgtgcaggtcatctatggggatagcagatggccttcagggatctctaagtgattctccagctccaactcggggaacatggtcaccctgaccatcagtggagcccaggctggggacgaggctttcctctcaggtgtggggcagtggcactgcacacagtgacagaggcagacaaggaagtaagacacagaccccttccccatctgtgctgctgtcgtcctccagcccggcaacactgtggacaaagccatgagcatgcatgacccagttcacctggatctgagacccccagtctttacttccttcagccctccaggcaggctgtgcagagggggcatccagaatggatttagggctgaggtgaccaggatgtattggggttttgtggactccactgtgattcagggaaattagatcttccaagcagaccaaggtcaatatcctcagttatctctggatttccataggtggtgataggccagtccttggccgaaatgtcctgaatcagtccccagaactgcccagctgaggctcctgtcattctctacagaaaaactagtggagtggacactgtgggatcctcccagatcccctcttatgagctcacccacacagcactcctgggagcttctggcagctcagagctgttcggtgcagaaatctgcctcccccaggtttatgtctcttctcagggaggtttggtttcatgactgcctgtggccaaggtctcaagactcttcctcagtataacaggacctgaaaatcctccaagatccatagctccttgtagggctgactgaagcctcaatatgtgtcagggcctccttctgcctggtgttgcctccatcactttcttaatcatctgtgtatgatattctccatctcagagtctgtttccagggaacccaaactaagatcaccagccatccccaacacgggccatgagggagctgaagaggccactgtacactagaaagcatcagtttactcttaaattaccactgcgagtctgcaaatgcccagcgagacctgagtggttttttttttcatttgtgtgaaatgaaaagggagactgacatgccagatgctctgggttctgagggagagttggagtcagatcctcctgcaggaatccaggggcagcaggagcagcctcgccccatgcagggaccacagatgcacccagagggtgagctgcaggatggacactgcccacctccaatctgtatatcctgtgcaaaaaaatcattgttttcaccccttcttcagcctatcaaagttgtcacttaaaaagccactacatctcatcctgtgaacaggaaacccatccacatctccatcagccacataatctccacataaagattcttcaaaaaatagtaataatagctgtgaaaaagtatctaaaatattgcatgacaatcatacttagattacatatgaaaatggcactatttttgatatgctaggtaaataaaatatattatttgaagtcatttaccttcttctctttatatgtctaatgtggtgactagactagcctagtgggattcccattaggctcatcatactgtgattgaacagtgctggtctgcacctcttcaggttaacaggggctgtggagtgacctggtgcaggaaatatcatctccatccataggatatcagtgtgaacccagggagaggcactggtgcaagagagatgagaacaggggtgtggagtaggggactgagccttcactttgagccgaagaagtttcctttcctatcctcaatcctgaacaagagggatttctggacttctttttgttttcaagtttgtgccccttcagatttggggctgtctggaatcctgccaggggacaccgagaaaaaataggagtctcacactgactgttgtatttcatctgctggggccatcccaaaccactgcgtacaatttcctttcctggtgctcaaatagctgctccacgcacttgttgtggtttcagagatgaatctgggtgggaagacaggacagtgtatgttataatatttaaatggaacccaaatccattaatatttattttaatatggaacattaaaagagttttgtaataggcaatgggaaaaggtaaaaaagataaaagctttttgagaaaaaaaacaaaaacaaacttatagaatgtctatgtgtcttcagtgttgcagggttgagagagatcagctttatggtgccccatggatgtgctgagatggggaaaatcaagaaagaaggaagtatgtaccactgtgactcaacaaataaatcaaagtaaaatggacttaaatctttcaataagtcattcacaataaatatcactctggtgcacacagaaatgcctgttagcaaactttcccttccccctggccatgtctccatggatcacctgtgtgcagagtggctccggtcagtgctctgtgttccctccacagggctccccacaacatgtgccctgtgtggatgtgggtgcatcgcctggggtggctgatgtgctccagggattcgatgctgcagatgcctcagcaccaagggtgggggtgggaatgggacaaggctgcagctggggagaccaaggatcaaccacacacagcaggggtttccacggggtgagcagcctcatttcctgacagtagagcgagcctaaaggtaggtgccaggcagtggtatctgtggggtggcccaggcctggagggtcacagagacacaggcaccacacagcagagacactgagggccaggagctcactcaggtgagggacttcagcagatctttctctcctggtacaaagagatcaagttcctaccatcagaatagacaaacaaggactttaatctcctcagctgagccccactgtccagggaagaagtctctgagcccaggcccaggtgagagtgggatgaggagaggagccaggacacagattttcatggatgccccgccctcctctgaggcagagcggataagacagggctgggggcatacccagtgcttgagtctcaggaggcagcgctctcgggacgtctccaccatggcctgggctctgctcctcctcaccctcctcactcagggcacaggtgatgcctccaggaaaggggcctcagggacctctgggctgattcttagtctcctgctcctcaggctcacctgggcccagcactgactcactagagtgtgttttttcctttttccgggctctcgggctcagtctgccctgactcagcctcactcagtacccgggtctcctggacagtcggtcaccatctcctgcactggaaccagcagtgacgttgggcattataactatgtctcctggtgccagcagcacccaggcacatgatttatgaagtcagttataggctctctggagtctctgatcacttctctggctcccagctctggcaacatggcctccatgaccatctctgggctccaggctgaggacgaggctgattattactgcagttcatatacaagcagcaacattttccacagtggacataagattgattctcaggctccaagtctggccagtgagcttctttgagactccctgggatcccagcagtgacactgatcactattgctgtcccacacatcccaagtgatgaggaagtaagaccaaaaccctcctgagattcctgacttgtgtcctgacaccagggctgttgggattcctgtctttccttcaagattgttcaaataagcagtgacagtcacttccatgtgagatatgagaagaagaataattccatatgaaccaaatccacgaagcctacactgaagcctgccaagttctctgcagtccagcgcgatgaagggagcattttcgtgggaacttttgggaatatgaggggagccaggctcagctatgggttccagagacaaagctcctggatgtttctccccggccttggtccatcacctgctacctctcctcactctttccacagacactgccccaggctaagcccccacaggaccctaagcctattcctgaccctgagctcagcccaggtgatgcttcaggagatgggatcctgagaatgagccccaacatctctttaacctaaggtgtggggtcatgagacacctgttagccataagacacctgtcccccacctgctcaggagacagtggagcaggcaacagtgcagagagaaccagcaggagccaggccaggccctgcatccaaagcaggccccagtccccacagattctccagctctagcctgtggtacagcccccactttctgcaggctgaaatgggcttctcaggatgggcaggccatgatgggggatggcagtgtgtccacaggacacagccctgctgcctgcctgaccctcatgccccctccttccccaccctggttaatctccaccagaaagggcccaggttcagaactcaggacacctggatcagctcctggacttgcccccactgctctctgttctcctgagccacttagtctcttttggcctcagtgttacctgctgtgaagtgaggaggcttatactgaactgaggaagctcttttcttcattcaaaattaaaagacagaaaaacaatgaaagtcatgtaaattaaagcctgctgaggggatgtcatttaatgggcttcagtgggtttcagacgtggaacttcttgtcttttctctgcagggattccaagacaggggctcaaaagagcttgctttctgtatggtgggaacagcggtccctagctgagaataagcaggagattcccagcttcatcaggaaggcagactaggctagtgtagaaatcctctccgtacaaactctgagaggtgttgaataaaataaagataaacataatttcatgttttcatggtgccgatgatggtgatgttagctcacaactaagctgcagtgcctggaacatcaggaaatcacagtgaatcacagctgctcttattgggtgggaggtgcaccagtttgatgcctaagtacatagaaagcctgggtccctgtaggatggcacatgcatctctctggactttgaaagctttgcagaagagcttcagttgactcactctaattagtccggactgaacaaaaccactagaggagggcatttcaaccctgagacacttctatagccccaacttcctaccctgcgtgtgcgaactctctgtgctgggctgggcagggcagattgggtcaccctgcacagaatggggctggactgtctggtcctcaacttctgaggtgacaggtgctgtggaggcacgtggaagaaaaaagctcctgggctgagtctcctccaccagctgggggcagcagagctgcagccaggagcagtcaggattaaggctggggctgcccagctggggcaaagagaaggccagcctggcgttcaacaggtgtccaagaatcagtcttcagactgaaagtgagtgcagttcatcctatcccctcaggctgcagtgaccattctctgagggtcagactcatacagtgtcaccccaggacactgacagaagcccggcacagtgaaggcctcacctgggaaatgcagctggaggaggctgggaccaggtgtcaactggggcagcttactcaggaaggggatttctttggagacatcccaaggttgaggtgctctaggagggggcacagcgtgaggtgacggggctcccagggcccgggttcttcacccaggatggctgtctgagcctcctgccactctcagggccttgtccctctcagtccagcagcaacctggggagctgagccctctgtcctgggcacttccagatacaccatacctcacttccttctgcctcaccttccagctccaggcggactctgactcagggggaaactcctgtgctcaggggagtctcgggtgggtggggtgaagcatttgggatcctgatcccttcatggggcatccccagcatccttaaggagacactcttcagagggacagggcttctcacctgcctcagctctgaccatggggctgtccacactcagtgacaggacactgaccagggatctgactggagtgaccaggaacctggctggggcaaccagggaccacccaccctctggagctcacatgctgtgcagagaccatgaccctgggaccccttcagagaccatggggcctgaagttagattttcagtccagtgtggttttctcctgctttttgcaagtttacataaaacattgatgagaaaaacatacataaataacagacgagctgagggtgccaattgctaatctcttgtggcaatgaggggtgatgtagcaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctgggccacctgctgctgagtcaggtgtcagcaagatctctccgcagagcccagctcagcccatggccaacctcctggaaggtccacagctctgctgagcctggcccaggacagaccccaggtcagcgaggtttgggacagtggtcatgagattaattcccagaaaggtgactgtgatcacagggcttgaaggctgcagctgattttctaatctgagaccctgcttcttcctcctgttgcctgtgctgccctcacagctggtttgagtgacatctctccaggaggaatcgcagaggatgtaaatttgcataaacgccaaacactgactgcccccaaaagctggagagggaataagagaggcctggggagcccagctgtgctgtaggctcaggaggcagagctctgaatgtctcaccatggcctggatccctctcctgctccccctcctcattctctgcacaggtgctgcccctaggctcagtctccacagaccccaagttgagcctgacctgaatcctgagcaaagccctgccactgcctctgggggggattcctggcaatgcgtcctttgtcctcaagccccctctcctgtcttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatctcacagtgacacaggcagatggagaaatgagacacaaaccccttgccatctgtgtcaccttcttcctccagccccaggaggactgtggacaaagccacgaacaggtctggcccagtacacccagatcagagactctgaggcctccttccttccagatctctacggaggccctacagaaggtggatcaataataaattcggggttggcaggtccagtaggtcctggtgttttctgggctggagtgtgacttggggaaaaatgacttgaatggaagtacagtcagtgggagacatctattgagtggtgatggtcccagtatttccttgtgtggtgactgaacctagggcagtgccactactctgtggcccaaatgccctgggttattcctctgagttccccgtgtattattgagatgctccagcccccactctcatggtatcctgatctgaagaatcatggccagtgcccattgcagtgtctccatctaggtgccattttcaggactcatgcatccagcatccaaacaaggctgtgtgggagaccgtgacttgtcacagctgttccccactggaaaatgccactgagctgcagagaactgctctcccagtgatgttcccccttcacagtgtggttcaggtgcaatgcctgcctggtccctagattttaatgccatgttttcatttaaaataaccacgaagtgtctcttgctgagcgctccggtgtaacacattcccagtcatgcctctcacaattttctttctgacaaaatttcctgaaaccctattgcaatgaattctccctctcagagtaggattgcagggagttcacaaattaacaaacaaaccaaatactgtctagaagaaagaggatcaaagaggagagagctgcacagggagcgcactctggagtctgcagatattcatgagcaccgatgagcatgtgcatgggaggaaaccttctgtgatagagaaaataaccattcaaagacatttgaggaaacactccatagagctcacacacacatccatgtgcacacacatgcacaatcagaatagtgcctgttcctccgctccatgaagaaaggcccgagttaaagtgggtgagatttaccagtgagaagagctttgcctcagtactggggaaaacattgccctagacaaaaggcatctctggtgttaactaagaaagtgtacggcccctgtgctgatgcccatgtcaaagaccatcacacgtattttaaccaactagcccagagttgtcaccaagagtttgatcttacaataattctgcaatgaacatccctattcagactccttggagttcacctatgaagattaccatagaataaatctctagaagttgaattgttaggtcaaaaagaagtacgtttgtaattttcactgattattctcagattcctattcacgggggggttgtaccaatttacagtgccagccataaatctttgacgtgagtatgctgttgaaagtttgggtttttgccaacatggtagattaaaattttgttgtcttgtaacagtgttattttggatttctcctattctgcttgaggttgaacattttctcaaacatttcagggctcttatattttaggatttagtgagcttttttctaaaatggccaggtaaggagggttttagcccctgtgggccaagagtcaactttgaccatattatgagggaacttataactccagttacaatgtaaccatttaaagctataaaaaccactctcagctctgggaccacacaaaacaggtggcaggccaggggtggccacaggatgtggtttaatggtccctgttttgtagggtcatttgaagtttaaaaatttcaccagcatatattttaggtggagatctttttgtgggtaatactgtatttcaccgcctatagtggcctgagatttctctctagataagaacacacttttcttattttttggatggattttgggtctatctgtgatagccctgtgtcataaactcataacttttgtgtccgtccttttactgtgatttttgggagtgtgacagtatatcaggaatacactatccagggtggaaaatcagagagagggggaggagcaagtgggcaaggaagcttgtaccaaagctggaatatccactgcagcaggctcagagaaaagggtcctaatatcagcatttgactgaagccaaaaccacaagagaccatagaggttctgaggatgacaaataaaaacatagtttaagttttaatgcattcattatttttataatccacaaaaattctaaaactcagaatttaacaatgggataaggaaaagagtttgagatgttaaacgataaagaccccaaggaaagttgccaggaaaagaacaggacctttttggtggaactatgtttatgctgtaaattaccctcttctatatgtctatatatatatttaggtataagagaacatctcatggaacacccttcttcaccacagtcaaagatcaccctcacccaaggagggaaccgaaagggaacgtcaatatgagacagaaaacataatgcacttttgtataaacattaggagagtctctatttgcatatcaaatgtggatgcttaatgttaacattggaaatagtaggttaatatgcatgtgaggtgagttttcttttgactatttctgtctgtgatttatctttcttaatagggacatttctgcccttagaacaacttaacttgtgatattttttgttctattatctgtatcagctctgttttttttttttcaaacagtggcaaagatatcccatgactaatgattaataaattcaattaatgggtatttaaattatttcaagagtggacagttgtgacttccccacatctaactcacagatgtcgctgatgctgactcactcttctcttccaatcatagcaaataaagtgggagctttgacttttctgaagacccagatgacaacaggagagaggaggtgaaaccccctaaagctgttatcctttaaaccctcaggaggaatcatcctggagaaacacccacacttgagttggattatacctaaatgagagtttggtcttagagttggtgctgagttagttcaggatttgggttgttgggatggagtgaatgcgctttacaagtgaaaaatacatgagtttttgggtccataggttggagagttcttggctgaattgtgtcccccagagttcatacaatgaagctctaatgcacggtgtgtgactgaatttggagagaatctttaaagaggtgattcagtgaaaatgaagtcatgagggtgggttcttatcgaatctgactggtgttctcgtgagaagagaaaatttgcacacacaaaaatgagacactcgagatgagcgtgcagaggaaagaccgtgtgaggactcagcaaggaggtagcgacccgcaagccaaggagagaggcctcagtgaaaaccaaacctataaacactttcatcttgactccccagcttcagaactgtgagaaaataagtgtctgctctttaggccagcaggtctttggtatctcattaaggtagcactagcaaatgaaaacaaaagggaccccaaagaccttggatgcgggaggaggaggagatggagcagggtgcaggaggtggggcagggaggggctggaagttcaggctctgaggtcatctcctgggtggaatcctgactccactcactgctgtctggggacttggggaaaaacaattaaccgcccaatattaattccatagtaaagatcgggccttgagcacaggattcctcatcttccttttttatatgatgaaagtcttcttgaggtcatgcttgtaaaacactcagcaatgtatctggcatacactatggtctcagaagtggttattatgaattttctagtgatatgtagaggatgacattggtcctgtgggcagagggggcactgtggaccttggtttgaggactctgaaagacaccaagtccgctggtagtgctcaagagcgaagagcatcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgaggagtagatttgcattcactgctcatcagagagcccacccaacaaggatacaagaataaaagaagtagatttgcatgaagagcctctccttcccatgataagagaggcctgaaggtccctccccagccatgggctcagagacagagctatgtggcatctccaccgtggcctggacccctcccttgctcaccctcctccgtctctgtgctgcctcccagggctcagcccccaaaggaccagagatcagactggccctgagcttcagctcagcacagggagtgatgcagagtgtggggctctgggaatgaccctcatcctcataattaactctcctgtcctctcttgtaggctctgtggcctcctccatgctgactcaggagccagtagggtctgtggccctgggacagtcagccagggtaacctgccagggagaaaacctaagaagccatggtacaaactggcaccagcagaagccaggctaggctcctgtgcaggtcatacatcgacaaaataaccagccctcagggctcccagaccaattctctggctccaagtcaggaacacagccaccctgaccatcactggggctcaggttgaacatgaagctgactattaccatcactcatgggacagcagtgctactcacctcacaatgacacagacagattgggaagtgagatctaaagaccttcactgtctgtgtcaccctcttcctccagccatagcaggactgtggagacagccatgagcagggctggcctgggtcacctgcatcgaagtcctccaagctgcccttccccccagctctccaggtagtctctgcagagaatgagtcaggataggatttggggctggcagaaccaggctgtcctgctgttatttggaatggatgtaccttggctcaagatgacctgagccatcttactggaaggacttactggaaggacggtaagagggagacagctcctgagtgctcatggtcactgaatttcctcctgtgtgttgactgaacccaatgcagtgcctctactctgtggcccaaataccctggattatttttctgaactgcccgtgtttaactgagaccctcaagccccagctttgtgcatcctgatgttctgaacatggaagcctttcacagtgtgcactgtgacatccctcagattcccgtttcaggacttatgcacccaccatcctcccagggctgcagggaggccctggcttctcacagctctccccaccagaaactgccatgcagtacagagaatagctttgctcaaagaattgcccatttcagagtatgtttcgggggcaatgactccctgatgccttaatctgaaagtcatgctttaatttaagaccctgaatatcaaattgaagtgccttctagctgaacactcaattgtaaaacattcccagtcacacactccacacttctttcctgagaatatatcctgaaaccctattgcatggaatcctccctctcagagtaggattccagggaacttaaaaattaaaaaaaaaaacaacacaccagtctagagggaaaaatattgaagaggagagagttagggagttgcacaaggaaagaactctgaagtctgcaaatatgcatgcactgaagagcacttgtgtgtaaagaaactccctctgaaagagaaagacccttgagggaacactccaaagagtgtgcatgcgtgcgcacacacacacacacacacacacactccagtcacagaggaaaggcctgagttacagagcatgaggtggactcatcagaagagcttcggctcagtattggggaaaatgtcggacagacatagggctactccactgtcaactaagaaagtgtagaagcaaactgggaaaagttaagacagtttccaagtaactttactgaatccaaaaataaaagaccaaaatagagaagaaaatgcaaaaggattataaactcaacaaagaaaaattcacaatgattggcattctgtcaatatttcttgcaagcaaaaaagaaaatatatgctttaacacagagaaaaatgaatcaatccaaagtggccaaaaattgcacacatgatagaccttgtaggcacgaattttggagcaattctttttttttttttttttttttttgatggagtctcactctgttgccaggctggagtacagtggcgcgatctcagctcactgcaacctccgccacccgagttcaagcgattctcctgcctcagcctcctgagtggctggaactacaggcatgtgccaccacacccagctattttttttttttaatttttagtagagacggggtttcaccgtattggccaggatggtctcgatctcttgacctcatgatccacccgccttggcctctcaaagtggtgagattacgggcgtgagccaccgcgccagccttggagcaattcttataactcttttctccttcctcatgagaatggaggatctattgaatgtgttaagtggagaaatggaaagcataaagcaagatgcaagttaaacttttagaaatggcccctaaatatctgcattgaaaaaatacactggatgagactcattgcagattagaagctgtgaaggaatagatgagtgaacttgaagatatggcaatggaagttatgcaagatgaagcacaaaaaaagtgaagagagcatcagtgagtttcaggacatcttcaagctgacttactggttataattaaagacatgaagggagataacattggtggggggagaggaaaggtagaaaagccatttaaaggaatcatggccacaatttcccaaatttggtgaaagctagaaacccactactccaaaaagcttaacaagtcacatacacacacacacacacaaacacacacacacaaataacacaccaccaacactcaccataatgaaattgctaaaaacctattataaagacatacttttaaaagtagccataaagacatggtatgtacagatgaacaacatcataaaaagaacagatttctttttctttttaaaattttcttaaacatctgtgggtacagagtaggtgtatatgtttgtgggatacatgagatattttgatacaggcattgccatgtgaaatagtcacatcatggagagttgggtttccatcccctcaagcatttatcctttgtgttacaaactactcaattacactatttcaggtattttaaattgtacaattaagttgctgacatgttatcaaatagtattgatgtaactctgacatgctatcaaatagtaggtcttattcattctttctattttatttacccattaagcatcccctaataagagcagatttcttcttagaagtcatgcaagcaggaggcagtggagctatatttataaaatattaaaagaaaaaacttactaccaaaacccatccacagactcaatgcaatccctatcaaaatacaaacgacattcacagtagtagaaaaaaactctatagttggtatggaaccacaaaatcccctgaatagccaaagcaataccaagcaaaaagcccaggctgaatatgtcacattatctgaatcaaaatatactacaaactacagtaaccaaaacaagatcgatggtattggcttaaaatcagacactgagactaatataatggaatagaataccccaaaataaattcatatatttacagccaactgatttgcagcaaaaatgccaaaaacatacgttgagaaaatgacatacttttcaataaatggcgctgagaaaaactggatattcataggcagaaccttgaaactagacttttatctctctccctatacaataatcaactcaaaatttattaaaactccgaaatataagacccaaaactataaaactactagaagggaacgtagagaacacaggggaagttcttcaggacgttggtctagacaaaaattccatagctaagacttcaaaagcacagggaacaacacgaactagacatatgggacttcattaaactgaaaatcttctgaaaagcaaaggaaacgatcaacagagtgaagacaacttctagaatgagagaaaatatttgcaaactattcaactcaaaagggcctaagatccagcataagaaaataagacaaggagctgaaataactcatcagcataaaaaacaaataatacaattaaaaagtggataaatgatatgaatagacttttcacagtcaaagacatacaaatggccaacaggtatatgacaaaatgctcaatatcactaatcatcaggggtacgcaaatccaaacctccatgagatatcatctcatcccagttggatggctatcatcaagaagacaaaaaaataacaaacactggtgaggatgtagagaaaatagaagacaaaaccacatggtcatctcaacagtcacatcaaatgttttcatgcgaggaaacattaccatttgttgtttttctagtcttgctagagcatcataaaaagataagatttgtggtgccactattggagaaaatgttattacatgcaaagactctggctatcccacaccaaactacatgaacacttactgttaaatgctaaaagaggccaggcacggtagctcacactcgtaatcccagcactttgggagaccgaggcaggcggatcacaaggtcaagagatccagaccatcctggtgaaaccccatctctacaaaaatacaaaaattacttgtatttttgcacggtggcacacacctgtagtcccagctactcgggaggctgaggcaggagaattgcttgaacccgggaggtggaggttgcagtgagccaagatcacgccactgtactccagcctggcgacagagtgagactcaggcaaaaaaaaaaaaaaaaacctaaaagattacaattctgcatttccaaatgttctggtggtcagagaccacttccttgacaagtggtgagtacggggatctgatgggataggtggcatttaggcaggtattgggtgaagaatagtgatatacacaagaaactttcaaagagaaaaacacacggaagttggaacacagaagagaacataatatgtctgagaaataaggaaagtccagactcactggagctgagtgagaacaagaaaaatggcataagccatgtatttctctctggatatctcatcaaaatattgtctcctccccaacacaccacccatgtgaattataaaaatgcccgtttttaatttttgtttgcatgtcgtgacagagtcaagcacgtgaatcaagctgagtttgatgagtccagggctgttaagctccagacccaggtggcctcagaaggacttggtggaacaagggcttgttgtcaaaagcagaggaagtgagattttccattgtggcttagaccagagattcttaaattccagtggacacacaaggccccttaaggatctggttaagatgcagatgcagcctcagcagttctggatgtggccccaaattctctgtgtccggcaactcccaggtgaggctgctgctgctggtcctcccaggaccacactttgagtggctgaactcttattcacccacctcactcaagccacgggtgagactcacacaaggagggcaccttctagaagcacaggtcacttctcactcctccccttgtgtcttagatcctttcctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggcgagccagtgtgtgctgaggtcaatgaggggaaggaagcaagagagaaagggaagataccagtctcatttaaataagcagctcttctggaaacagaggaaattcactcaccccaagtgagggcattaatctattcatgagagatccactcctatcaccctaaaagctcccattaattcccacccccaacactggggattcaatttcagcataagatttgcaagggatgaagatcaaagccatagcaccctgaggcttggccacacacttgctcatctccacatttgtcccttccttcaggaccgggatcctgactgctctgactcagtctccgtctacctcatggacacctggcagtcggtcatcatcggttttgctgaatcagcagcaacattgggggtaacaattgtgtctcctggttccaccagagacagagtagagacccacacagctgaagtgtggggtcaaatattaaaactaagagacataagattgattctcaggctccaagtctgacaagtgagcttctttgagactccctgggatcccagcagtgacactgatcactgttgctgttccacacatcccaagtgatgaggaagtaagaccaaaaccctcctgagattcctgacttgtgtcctgacaccaggtctgttcttccctcccctagaataaaacatctcttaagcacaaggctgaagaaatgtggcctcctcctttctcccacagctggtcaaagtggatacctgagagaattggctcactgaggcctcttgggaacaaaggctgggttcctgcctgtgatctgtgtactgagacacattccggacctgcccaggaaaggcaagtatagatgatgtttagttgtcacagagtccaagtagggacaattcagcggtgtcttcttgggacccctgcctctggctattttcatctactttataatgggccagggccattatttccaacttgtcatatcctttttctcctttcctcaccaggtaaggaggtggaggacagttgatgagggctggcttatgagttaccccaggatgcaaatgactttgaagtcaagcccatgtggggtcaagctcagtctataaccagggtcttttgagctctggaggagccaggcatcccagccatcaaagaggtcttgcatttgctaataaatcctcttcttccaacccacagcttatcttggctgcctaccctcatctctgtcaggaagcaatccttcgttgtttaacaccaaattattcttacttggtcagtttaaaagtcccttcctcagaaaggtcatctgtggcctgaagacaaagtgagaaggctttgctgcattttcatttggaaccttacattgccccttctgcaatgttctaaccacacatggcacatatttacaggacagcgtgataattcacttttgaaaatacagaatgtgctcatggaacaggacaatgtcatacttttggggcctgatgagcatgtccttttcacaggaccccccagagctgcccatgcatccagaaggtaccattctactctatgcaaaacgatggggcatttctatattgcagtttcttagggttccttagaaagaggccacccccaacacagagctgcacaccttgtgaccacttactgtcaattcctcaatgctgtctccaagtctcaccatgcacaagggaggaacacagagaccctggattcctagagacttgcatttcttggatgaacaaatctggggtttggttggtggcagagagctcagggctcatgtgtgagcatcacctgatgcttcctccagggtcagagtccagcccctaccctggaaggatgaaagatattgtccacagaagtggtataaaggtaacagcatcgaggacggagctgcctcttgaaatgggctattgctttgcacaacgctggagacctaaattatgttgactataatggaagagtagtccctgcggatggcctctaattgggtggaagaaagcagagggtctgcgtctgagagagcagcaatgggcagattcagcacaggcatgggcagagcagcaatcaagggtacctgagcagcaatggccccgggagaggcctggcacctgccggaagtgacgttggagacagagaaacatctaagacttaaggcttctctttctgtgcaatcccccaccccacagtttatgtgtcacagatattggcacctccttactgtaaggggtcatatgaataatacagtcctcaggggcatgggttcgaggggcagccaggtttatcctcgaagcccacttctgttacctgcagctgtgtggctgtaagcaaggcatttaatctctcagaaaaccatcctaatgagaggttaagaacctctgagaaaaaaacttagacaagaattgacagtaattcttcactattgaggctgcagggatgtaacttaatcatgtttgtaaagtgcataacacagaccctgacatgccccagctgctcctgagttggcagcaattattcctgacatcactcatgagaattggacctggaatggggatggagggaaggcagtgcagagggtttcagagggttaggaaaagagagactttaatgatttaaaatgaaggcctaggagtggagacaagcgtcctgggacattctcctgccaactctcacaatgtctcagagactgttccaaggtgaagtctactagagagctaagggaggagtttgcagaatcaaggtttgcaatgtcatgcatgagggggcagagagtcagcgggagggaagacagctgagctcatctgaagggtatttatggttttctggccctagagtccttggccatccctctatgaccagggcctcagataagcagagagcttatctgcttctctcctccaacgatagttcctggttatcctgagcccaggtcagtgcagctgtggcccattctctcctctttgtgctcagtggactgacctggaggaaacagtaggaggttcccctgctctctgtccccagggtcctttcctttcagtggcaccagcccagccctagtgtccatccatctgtgcctgcccagtcaggcctccatgctgccccctgtaatggccacaggtcaaaaactgattgtcagtcttgagcagattgtcctgactctttctgcaaaactgagcctctcacccagcaccaggacgtcacaagcaaggccagctgtaggaaggcaagtaggggagtaacgtgcatcacagagtctggacaagacaaagtagttctgctgggacacatcctggtgatgtttctcaggatggttcaggtccctgcaattgcaggcccagagaacaggactgaaggctggaagatgtgctccctttctcctgtacacaaaacagtgccatgtgtgcatgtgagtaaatgcatatgcctgtgtgcttgtgtgtgtgcacctgtgtaaatgcatatgcctgtatgtgagagagtgtgtgtgtaaatgcatatgatgtgtgtgagtgtgtgcatgtgtgtaaatgcatatgcctgtgtgtgtgcatgtgtgtaaatgcatatgctgtgtatgagtgtgtgtgcatgtgtgtaaacgcatatgcctgtgtgtgtgcatgtgcatgtgtgtaaatgcatacactgtgtgtgagtgtgtgtgcatgtgtgtaaatgcatatgcctgtgtgctggtgtgtgtgcatgtgtgtaaatccatatgcctgtgtgtgagtgtgtgtgcctgtgtgtaaatgcatatactgtgtgttggtgtgtgcatgtgtgtaaatgcatatgcctgtgtgtgtgtgtatgcatgcgtgtaaatgcatatgactgcgtgtgagtgtgtgtgcatgtgtgcaaatacatatgcctgtgtgctggtgagtatgcatgtgtgtaaatgcatatgcctgtgtgtgcatgtgtgtaaatgcatataccttgtgtgtgtgcacatgtgtaaatgcatatgcctgtgtgtgagagagtgtgtgtaaatgtgtgtgctgtgtgagtgtgtgcatgtgtgtaaatgcatatgcctgtgtgctggtgtgtgcacatgtgtgtaaatgcatatgctgtgtgctggtgtgtgtccatgtgtgtaaatgcatatgcctgtgtgtgagtgtgtgcatgtatgtaaatgcatatgctgtgtgtgtgtgtgcatgtgtgtaatgtatatgcctgtgtgtgtgcatgtgtttaaatgcatatgctatgtgtgtgtgcatgtgtgtgtgagtgtgtgtgcacgtgcatgtgtgtgtgcatgtgtgtaaatgcatatgctgtgtgactgtgtgtgcatgtgtgtaatgcatatacctgtgtgtgagtgcatgtgcatgtgtgcacatgtgcatgttagtgttgccagggagtgcttcaagtatcgaatgtcccaaattcacaacttttctattttcctcacttacctcctccctgacacatgcttctcagttaagtgagttcatatgcgcaaggcctacaaacaggcaaggcatgggccatagtcagtgctgagtcagtgtcatcaaatattgttatgcttatatagaaccttgtccagggtgggccaaatgtatgcccctgtcttgtcctgacagagcagcagaaagggagactgagacaaaacaatggccagggccctggcaacacggagacaccttcccactcctgtgagcttcacagacaaccctgggtatgggattcctgtcattcctttaagattgttcaaataaacagtgacaatcactctcatatgatatatgagaagaagaagaattccatataaaccaaacccatgacgcccacactgaagcctgccaagttctctccagtcgagcccaatggagggagcattttcatggggacttttgagagtatggagaagacctgaggaaaccaggctcagctgtgggctccagaggcaaagctctgggatgtctccccatggcctagacccttcgcctgccacctcttctcactctttgcacagatgcttcccccaggctaagcccccacaggaccctaatcctagtcctgaccctgagctcagcccaggtgatgcttcaggagatgggaccctgagaataagccctaaagtctcctcaacctgcaggctctgtagtctcttaaagactcaggtacctccagtagagttggccatgagacatctgtccctccaactgctcaggagcaggcaacagtgcagagagaaacagcagcccaggccaggccctacactcaaagcagcccccaatccccacagatcctccagcgctaacctggggtacaggccccacctctgcaggctgaggtgggctcctcagcatggctaggccatgacgggggatggcagtgtgtccatgggacacagccctgctgcctgcctggccctcatgccccgtccctccccaccctggttaagctctgccccaaagggcccaggttcataactcaggacacctggatcggctcttggacttgcccccactgttctctgttctcctgagccacttagtttcttttggccacagtgttacctgctgcgaagtgaggaggcttatactgaactgaagaagcacttttcttcattcaaaattaaaagatagaaaaacaatggaagtcatgcgaatggggggatgtcatttaatgggcttcagtgggcttcagacatggaatttcttgtctttcctctgcagagattccaagaaaaggactcgaaaagagcttgctttctatatggtgggaacagcagctgccagctaagaataagcaggagagtcccagtttcatcaggaaaacagactaggctagtatggaaatcctccctgcagaaactctgagaagtgtggaatgaaataaacataaacatgaaattaatctgccaacgatggtgatgttagctcacaactaagctgcagtgccagaaacatgcggtgattgcagtgaatcatagctgctcttactgggtgggaggtgcaccagtttgcttcctaagtgcatagaaagcctggcacgcacgtctctctggactttgaaagcttggcagaagagcttcagttgacttactctaattagtcctgacggaacaaaaccactagagtagggcatttcaaccctgagacacttctgtagcaattgctcctgccccacatccctgcactgcatgtgtgacctctctgtggtgggctgggcagggcagattgggccacactggcacagaatggggctggactctctggtcctcaacttctgaggtgacaggtgctgtggggtcacctggaaggaaaaagctcctgggctgagtctcctccaccagttgggggcagcagagctgcagccagcagcagtgaggagagaggctggggctgcccagccggggaaaagaggaaggcctgcctaaggttcaacaggtgtccaagaatcagtcttcagactgaaagtgaagacagttcatcctatcccctcaggctgcagtgaccacgctctgagggtcagactcatatagtgttactccaggacactgacagaagcctggcacagtgaaggcctcacctgggaaatgctgctggaggaggctgggcccaggtgtcagcttgggcagcttcctcaggaaggggattccctggaagaagtcccgaggtcaaggtgctctaggaggggcacagtgtgaggtgacggggttcccagggcctgggttcttcacccaggatggcggcctgagcctcctgccactctcagggccttgtcctgccctgtccagcagtgtcctggggagctgagccctctgtcgtgggcacttccagatacaccctgcctaccctccctctgcctttccttccagctccaggcagactctgactcaagggcagctcctgtgcttaggggagtctcaggtgggtggcgtgaagtatttggggccctggtccctgcatggggcatcaccagcctcattgaggagacactctccagagggatggggattctcacctgcctcaggccacagccctgaccccggacctgtccatgctcagtgacaggacaataaccaggaacctggctggagtaaccagggaccacccatcctctggagctcacatgctgtgcagagaccatgaccctgggaccctgggaccctgggaccctgggaccctggaaccgtgacagaatccatggggcctaaagttagattctcagtccactatggttttctgctgctttttgcaagtttacataaaacattgatgagaaaaacataaataaataacagacgagctgagggtgccaattgcttatctcttgtggcaatgagggaatggtatagaaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctggtccacctgctgctgagtcaggtgtcagcatgatctctcggcagggcccagctcagccccatggccaaactcctggaaggtccacagctctgctgagcctggcccaggacagaccccaggtcaacgaggtttgggacagtggtcatgaagtcaattcccaagaaggtgactgcgatcacagggcttcaaggctgcagctgattttctaaccagagatcctgcttcttcttcttcctcttgtcgcctgtgctgcccccacagctggtttgggtgacatctctccaagaggagtcccagaggaagtaaatttgcataaacaccaaacactgactaccctaaaaagcctgagagagaataagagaggcctggggagcctagctgtgctgtgggtccaggaggcagaactctgggtgtctcaccatggcctggatccctctacttctccccctcttcactctctgcacaggtgctgtccccaggccctgctccaggccctgctccagtcttattccccacagatcccaagttgagcctgccctgaatcccgagcaaagcccagacgcagcctctgggtgcgactcctgggaatgggtcctttgtcttcaagccccctctcttgttcttccttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtacttatcccacagtgacacaagcagacagggaagtgagacataaacccctccccctctatttcatcctcttcctcctgccccaggaggactgtggacaaagccatgagtaggcttggccaaattcacccaaatctgaacccccaggctgcccttccctccagccctccaggcaggcactgcagagtagtcagtctggagtggatttgtgcctggcaggccaggctgtcctgtgtttctttgcctggggtttgagttgtcgatggagggtctgactggaaagacagacacagggagacatccatgcaggcatgtccaaagggacatggggaactctcaggtctcagttgaatgcagtcattgttgtatcctctgggaaagcattcctctagtgcatctaagacctccagacccacagagcctgagatcaggaggagagaatgttaaatttttgctaatggaccactgaagacatttttgagtggagccactacaatttactccttgattctggactcatggatcctgactgtgggagaaacagcaccatctattgggcactgatgcacagaacatgccctatcctggaagacattgtccagccctacacatacttgccacttgcctggtgcagtaatggtgtctccaagcagtcattaaaccattcatataagccatatgtctcagaatgtttgggacaagagtaagaatcttgattgccagaagaaaaggcccatagccctttatttgcagtgaaatgaattccttggtcagaacctcctgtggaataccatcatgatgggtgcgtcattctgtaatccagagacaacagttttggcagaagcattgctgtcaatgaaagcaaatcctctgtagaataaatgtcaattctagtaagaaaaaagagctattcctgccatgatggaagagtgcaaacgaaattaatattaagcaggcccctggctgttttccacagagaaagtcatcctatagggatctctgtgttagtctctgctgttggcagatggtcactcagcagtggctacagccaggccagctccagttagtggaaatcgacattgatgagcccatggacagcctccatccctgccaccatgggcgcttttttttatggagcccactgggcattgacaagagtggttgagggaggctgcctgatgtccacagaacaagtcaccctactcacctgattagcaaaatcacttcattttcacagaagacttggtgagtattgacatatggaaaaaattctcttactttctgcccaccggaggaggtctattcacacatctctccccctgacgtatttgtgatcaatattctcattgtgtctctctcaagtccctgaacatccttgagcatctttcaagaccctgagtcacaacctgtgaattaggaacctctgcccatctcttggcaggtgacatgagccaattgcactgcttaaaattctactttaatgagaatgttcctccaacactgctgttcagggattctcagaggccaggtggagtactagcactgtccacaccagtagtggctgcatgtcctgcagaaaactctgtaaccccagcctaagtgcctcctcctaggcagctgatctcagggagcccctcaggacgtcaaggctgtagggtgagaggaagacatggtgcagggctccggtcatgtctatttggccaactcttcatgaaacttacttgggcctcgtgacctagtccctcaagtcacaaatacatccctgccatgtgattgaggagctgctggaaatggccaaccgggactgtggttcagaccaaacctagcatactggcaacttgggtcgcatggtgagctgtgtggccacaatcacacagagcctctgctgaggcccaggagcgttcgcagtctttctcaaatggagctttctgctcattcaaaaaaataagtagagggaggctgggaccccaggaccacttagaccacgcacatgatcttgtctgattattctgaatccttgcatgctcagctatgcattatggtaaccaagccacagtgtctttggcaataaaatgccactacttggcccccacctaacctgggatcccctcaaccacatcttgctacccaaaacaggtttcacctccactgagagaaatttatttttatattgagaagatgaaagattaattatttcaattgtgaaaattttataggacagtaatgtgaaaatattttaaaagacactttacgaagagtgaaagaccttccattaaaccactcaatatatgacactgtaattggcctacccaaaccctaagttcagctccgggttgggaccttctgggaatggacccttcatcctcacgccctcctctcctctcctctcctctcctctcctctcctctcctctcctctcctctcctctcctctcctctcctctcctctcctctcctcttctgtcagccctgtgcctcctatgtgcagagacagctggtctcagtgttggtggccctgggactgacaatcatgagcacatactctggagataaccttgagataaacatgcattaaggaaccagcagaatccaggccagtccatggtgctggtcatctagtataacagcaactgaccctcagggacatctgcccaattcttaggcttcaactcagggaacatggccaccatgaccattaatggagcccaagcccgggaagagactgactattgctgaactgcagataataacagtgggagcagctggcagggactcatagtaacacagagagacagggactagccacagaactgtcccatctcggcctggctctcattctcagctgccctgtgagcagctgaaggtcaggcctcagggtcaggcgtcctctctggtcttaacctggcccctgcagggctggtgattctgagcagcttctccatcctctcagggcctgcatgtgtccagtgagaagtgagtggacagggggaagctggttggagctgcaggaacctctgtcaggtttgtggtgtacatgaaaggtttaggaatccacacaacatcacatggccccagatgtaatcacacatcacacaggggaggaaagagctgtcgcagagggtacagtcctgtggaatttctcttttccttgggtataagcagcttagtggaagctccagaggctgtgtctcctctggtttccagatgagttcagttgacctccgcattctaaaggggtgcctgaggcctgaggaggactggagacccagccccttttggccccagggccctttctgtgctgacatttcacagaaactgaagaggaagaacagacactacctttcatcccacctggggactgtctttggggcacgctgaactcccatggcccccaaagtcccatcaccttccccaggtaggtcagacctgactggatgtccctctagtgccctgatagtgtggattttatctttgggctctgggctgctttctgaggagctcactaagaacccttgatgccaagtccaggacctgcccctctgctccatgtcccaggggctgcaagcatgacgggaaggtcctgctgggtgaggatggtgcccttttccagaagagatgtctgattccagtctctagggccaggtttgttgggctttttttctcacttggaaggtctcagtctctttattaccttctttaaaagtacaattggtttaatcgtgaaatcatgtgcatgcactaaagtttacagactatggtcatcagcacatatgtacactctttctggatgggacaactgtggacacggccatactggggtctctgtctctctcattatcacaagggaggataccaacagctctctcctatgcagaccgtagtcatgtttcccaattgcacaagaatgtctcttacagttgtttaatttccttcccagccaggacgcttaagtttcccatgctgatacttggttgctatttctctctgatccaacatttttcaaacagtattgcttgcaacccaaggcttatgaaacactttaccaaaagttccacaagaaaagctcaagtttctcatgcaccgttggaccaggttcattgcgtgcagtaggaccttgctcaagtgatgagtccatttgatgttttcaccatcaaggtgaagggtattatgacttttgggcactgagttgatagaaggaagacagcagctgatgatggccctgcccaccgatgtgtgtgtgtgggcaggacctatcgatggatttagaagttgagggaactgtttattctgcagatggaatttccagcactgaatctccaccaaccagacactagcactcagcaggtgctctgtaagaagaagcccttcactgccaatcacggccattacacaggtgaaggagaggatgatttttaacagccattgaccctcacagtaaactgaggtcaaaactctggtacacaaagtgactttgagagaacaggctgaggaagcaggttaattagtagcagaaggctttgccgagagcaggaacaaaacagggttggtgaggaactagtgatgccatggtgtggaaggaacaaggcctgtaccaggagcaggaaggggcatgggaaagaccacactgccacatgtgatgagtcagcacatggaaggcacagcaaatgttgcacaaaggtttttgtgtaataacctggcaaacagctgcttctctatcaagattgatgagtcaaaaaatgttactgatgcattgctgtcacatgtgaaggtgtgtgaagaatggtgacattcaaggaaacctgttctctgcagacacctacccaccagtacagcagacaccccagctatgccaagggctttgtcttcctctggggtaagagcctgggaacaacaagttggcccctgaaaggggtgccccatcatgcgctcttcatggctgagttaagtggggagctcccagagaactttccagtaaatggtcaatctgtttgttctgggtgcattgagcatgacccaggatcaatggaagtgacagaagcttaatttccccaaggctgcaaggcgggcactgggaggacggctgaagcagtttagccaccaccccctagtggctccagccccaggtaagcagggacagttgaagggcctgcctgagcccacctgtgtctaattagttccagcatcagcagctgcatcctgtagaccaccaaggagtgtgtgtgcccagcccctcacagatcacctgagcataaacaggaaattctccttcttacacctgactgcaccacacatctgccccttgctcttcatttacaagacgctatcacatcagacacggactgatctgagtcccgggttccctcaggtttctgctgtcctctcagatccccacacacaaaagactcttcaccacagggcgttgagccagctcttcccctaacactgcctcttacaggttactcttctccaatatgatgcgggtttgatttcagtgtttctacatatatacttttgtattttattgggtaagctgagccccttgtacctgatcttgagtcaggcaggggccacacagagaagaggtgttcctcccctgggaccagcagtcctcggatcagggcatcagggacctgaacagcaggttctgaatccacacctagacccaggaagtccctgagcccccagcccacagtgtggagcggccaccagggggaagcagagagttacctggcaaagccacctggcgatggggcgggcctgggtgacagggagacgctgacatgcagcaggagccagtgaccatgatctcacacctggaatgaaagggtctttattttcatagagtattgtccttgtgtacttgacactcatgtagaaattctagaataggattttaccttcagctcttgcagatgctgcctctttctctgccacagctccaggcacttgacttctcacagtgccctctcctcacacacccagttgtgctaaaatggtgtccctgccatgtgcagtgtcctccctgaggtcacaggtgtcccctttatctcccctttgctctgggagcccctgtcctgcagacacagtggcttctcctttcctggctgctcctccactttcattgtccctggtctttccggactctctcctggggaagctgccaaatcatggctcttgatttcctggtgagtcacaaaatagttgctcattaacctttagttgacttaagttcttaatcattgatacattttccccaacaactgacgacaacttagttataataaacattcacttctgggggtcttggagtttgcagccccctctcattctctcatggagcaaacatttccttcgcctcctcatctgtctctgatcctgacagcatcctggagatactgaggcacagcagctatgacctacccaggagcttgcagccaaggcagaaacttccatcacctcatggatcttccagcactctgtgtgcacttgacaaataagaaattccattgtcctctaccactcaggagctgtgccctgcggtgggacctgcacctttccaaggtgtgtgttatcatctgcacagtggagatgaagagggaacctgcattgggttctggaaagtaccatctaaaaatatatttagacctgcaacagaaatctcctctctaacataaaatatttatgatcaggacacactgagaggcctagaccaaaattaagcactgccctcctgagccaggatagaatggaggaggggactggggaccccagataattccacagttaccagcatgactctatgatcacctcctggaccagatcaaagatcatcccatatgaaggacttcatattccttaggaaatacaaagtcacctctgagctctgctgtgaccaagtgagcccaggaatgaggctgagcacagtgtgatgtggagatgtctgcagagaatatggaatcaattgataaaggagatcctgtgggcaaagggtgggagggcaaggccacccctaacctctttgggtcccttggggctgagtccttctggaaaccacaaagctcctccagcagcagcccctgactctgctgattggcatcacgggctgttctctccaacaaggggttaagagagacctgggaggagcctgcccagcctcagacttgagaagcagcattggaggcacttcagccatggcctggcccctcttttccttggtctcctgactcactgcccaggtgctgcccccagggtctcacccacctgcccagccccaggcctccaggttcagcctggccatcagtctgagctcagcagggccctgtgtgtggtgggcaggatgctcgtgaccctgctgcagggggaggggctggttgggctgaaatgcccccactctgtgctcctgtgctcatgggtgccctgagagctcttttattcctggggctcactccagccctggcaagtagcaagatatcctggggttgagcctctcagtttcaaattttttatctcccctttccttcttgcaggctctgtcacctcctgtgagctgacacagccaccctcagtgtcagtagctccaggacagatgactaggatcacctgtggggaaaacagtattggaagtaaaagtgcttaatggtaccagcagaagccaggacaggcccctgtgtgggtcatctatggggatagcaggcggccttcagggatctctgagattctctggctcaaactcagggaacaggaccaccctggccatcaacagggcccaggctggggaccaggctattactgtaagatgtgggacattaggactcctcatcccacagtgacagaggtagatggggaagtgagacacaaaccccttccccatacgtgtcactcttgtcctccagcccaggaagactgtggacaaagccatgagcatgggtttcccaattcacctggatctgagaccccccaggctgccctttccacaggccctccaggcaggctctgcagaggggacatcaagactgaatttagggcagaggtgaccaggatatattgaggtttgggggactcagttgtgatttggggaaatggggccagaatggaaggtcaggccaaggtcaacatccttagttggtctctggatttccatagggggtgaaggccagtccttgggctgaatatcctgagtcagtttccagaactgcccagctcaggctcccatggcatcctgccattctctgaaaagggccctggcatgccaggtgctctgggttctgagggagagttggaatcagatcctcctgcaggaatccagggtcaggagaagcagcctcacctgacacagggaccacagatgcacccccacagggtgagctgcaggatggatgctgctcatctccaatcctcacatcctatgcaaaaaatcattcttttcacccctccttcagtgtatcaaagttgacacttaaaaagccttaagagcccactcttgtcaacagaaaacccattcacatctccatcagccacacaatctccacagaatgattcttcaaaaaacgataacagtagacatgaaaaggtatctaaaatgttacataaataattgaacttagattacatatgaaaatgatactatttttggtatgctaggtaaataaaatatattatttggactcctttactttcttctctttgtatttctaatgtggtgactagacattgggattccaatgaggctcacatcatattgtgattgaacagtgctggtctgcacctcttcaggtaacaggggctgtggagtgacctggtgcaggaagccccatctccaatcataggacatcagtgtgaacccagggagaggcactggtgcaagagaaatgagaacaggagtgtggaccatctgcttgtacaggggactgagccctcactttgagccaaataaactttttttctattttcaattctgaagaagaagactttcctggacttctttccgttttcagatttgtgccccttcaggtttggcctgtctggatcccagccaggggacaccgaggaaatccaggagtctcacactgactctgttgtatttcatctgctggggtcatcccaaactgctgcgtatcgtttcctttcctggtgctcaaatagctgctccatgcacttgtcacggtttcatagctcagtctaggtgggaagacaggatagtgtatgttataatatttaaatggaacctgaatccattcattgtttttgtttttttgtgtttttgtttgtttttgttttgtttcgtttttgagagagagagagagtcttgctctgtcgcccaggctggagtgcaatggtatgatctcggctcactgcaacctctacctcccaggttcaagcgattctcctgcctcagcctcctgggcagctgggattacaggcccccgccaccacatccagctagtttttgtattttagtagagatgaagtttcaccattttggtcaggctggtctcaaactcttgacctcaggtgacccacctgtcttagcctcctaaagtgctgggattataaaggtgagccaccacgcccgacccaatagtttttttaaaatatgaaatgttaaaagagttttgtcataggcattgggaaaggtgaaaatagattaaaaacattttaagaaaaaaaccaaaaatgtacttgtagactgtctgtgtgtcttcagtgttgcagggttcagagaggtcagttttatggttcactaaggaggggctaagatggaggaaaccaagaaagccaaaaacacacatctctgccactcaaaacataaatcaaagtaaaatggaaaaaatctttcaataaatcattcccaataaatatcactctggtgcacatagaaaggcctgttagcaaactttccctttcccctgctggctcatatccccatggatcacctgtgtgcagagtggactctgtggtccccatttctcaggctgagaaccagagactgggaaggacaagtcacctgctcatgagtgggaagggcaggattgggagcagctggcttgggttcaggactgtggccctggtcggtgctctgtgtccctccagagggtccctcccacatgtgccccgtgtggatgtgggtgcactgcctggggtggctgatgtgctccagggattcgatggtgcagatgcttcagcacaaaacgtggaggtggggatgggatgaggctgcagctggggagaccagagaccagcgccacccagcagaggtttccacggggtgggcagccccatttcctgacagtagagacaggctggaggtgggtgccaagcagagggcgctgtggggtatgcccaggcctagagagtcacagagacacaggcactacacagcagaggcactgagggccaggagctcactcaggtgagagacttcagcagatccttctctcctgagcaaatcaggtacaaaaaaaattaagttcctgccatcagcatgcacaaacaagaacattcatctcttcagctgagccctgctgtccagggaagcaaaagtctctgagcccaggcccacgtgagggtggggtgaggagaggagcccaggatgctgattttcatggaggccccgccctcctctgaggcaaaggggataagacagggctggggcagggccagtgctggggtcacaagaggcagcgctctcgggacgtctccaccatggcctgggctctgctgctcctcactctcctcactcaggacacaggtgacgcctccagggaaggggtcttggggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttccacagtggtccaagttcatggggaactgagaccaaaacctgcccagggccttcagacttcctccttgctctgaagatgcttcctcacccggtgcaagaggcttgctgcagcgcggccttgagaattcttctctctcagctccttccctttccaccatgaattccaacaggaaacctgccctgtggtttcccatccaggacagggacagcttcctgatgcttgtgtgctgtggtccctgaatgtgcaactcttcccagctcttcaaatgcagggacagtgacaaggagctgcctgattggtgcagtcactgcttttttcagggatgtcttcaccctacatgtatcatcatcccctacactgtgggtagaattttagcaactacattctaatggttatcgccacaactttgatcttagaaataacagtgcagtgaacatccctatgcaggctcctttgagttcctgtgtgaatacgaccataggattcatttctaaaagtgaaattgcgggtcagaaagatgtgtgtttgtgattttcacccaatgttgtcagattcccctccagagggattgtaccaattttcaatgccagctggaagtacttgttcagagtacattgttgaatgtggaaatttttgccaacgtatcagagtgaaaaatggtaccttgttacagttttatttttcagtctcccgttctgcttaaggttgggccttttcacaaatagttcagtactcttcatttttcatgatttggtaaactttataaaaaatatccagataagaagaattttagtctttgtggccagacacggtggctcatgcctgtaatcccagcattttggaagactaagacgggtgaatcgcttgatcccaggagtttgggattagcctgggccacacagtgaaccctcatctcaattaaattaaagaaaataaaaataatttttaaaaaaatcctttgtggtccaaggatcaactttggggatattacctatggacttatatcaccatttacaatgcaaacatttaaaatgataacaactactgtcagctgcagaactaatttgactccatcaaaaaaaaaaaagctaaaagattataattctgcatttccacatgttctggtggtcagagaccacttccttgacaagcagtgagtacggggatctgaagggtagttagcatttaggcaggtattgggtgaagaatagggatatacacaagaaactttcaaagagaaaaacacatggaagttggaacacagaagagaacataatatgtctgagaaataaggaaagtccagactcactggagctgagtgagaacaagaaaaatggcataagccatgtatttctctctggatatctcattaaaatattgtctcctccccaacacaccacccatgtgaattataaaaatgcccgttttaaatttttgtttgcatgtcgtgacagagtcaagcacgtgaatcaagctgagtttgatgagtccagggctgttaagccccagacccaggtggcctcagaaggacttggtggaacgagggcttgttgtcaaaagcagaggaagtgagattttccattgtggctgagaccagtttcttaaattccagtggacacacaaggccccttaaggatcggttaagatgcagatgcagcctcagcagttctggatgtggccccaaattctctgtgtctggcaactcccaggtgaggctgctgctgctggtcctcccaggaccacactttgagtggctgaactcttattcacccacctcactcaagccacgggtgagactcacacaaggagagcatattctagaagcacaggtcacttctcactcctccccttgtgtcttagatccttttctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggggagccagtgtgtgcagatgtcaatgggggagaggaagcaagagagaagacaaagatgccaggctctttttaataaccagctctttcggaaacaggggaattcactcaccccaagtgagggcattaatctattcatgagagatccactcccatcaccctaaaagctcccattagttcccacctccaatactggggatccaatttcaacataagatttggaggtgacaaagatcaaagccatagcaccctgaggtttggccacacacttgctcatctccacatttgtccctcccctcaggactagggtcctgactgctctgacttagtctccctccaccttatgggcacctggcagtcggtcatcatcagctttgctgaatcagcagcaacattgagggtaaaaattgtgtctcctggttccaccagaaataaagtagagccccacacagctgaggtgtggggtcaaaaattaaaactaagagacataagactcattctcaggctccaagtctggccagtgagcttctttgagactccctgggatcccagcagtgacactgatcactattgctgtcccacacatcccaagtgatgaggaagtaagaccaaaaccctcctgagattcctggcttgtgtcctgacactggggctgttgggattcctgtctttccttcaagattgttcaaataagcaccgacaatcacttccatgtgagatatgaggagagaataattccacatgaaccaaatccacgaagcctacactgaagcctgccaagttctctgcagtccagcacgatgaagggagcattttcatgggaacttttgggaatatgaggggagccaggctcagctatgggttccagagacaaagctcctggatgtttccccctggccttggtccatcacctgctacctctcctcactctttccacagatgctgccccaggttaagcccccacaggactctaagcctattcctgaccctgagctcagcccaagtgatgcttcaggagatgggatcctgagaatgagcgccaacgtctctttaacctgaggtgtgaggtcatgagacacctgttggccataagacacctgtcccccacctgctcaggagacagtggagcaggcaacagtgcagagagaaccagcaggagccaggccaggccctgcatccaaagcaggccccaatcccacagattctccagctccagcctggggtacagccccaactttctgtaggctgaaatgggcttctcaggatgggcaggccatgatgggggatggcagtgtgtccacaggacacagccctgctgcctgcctggccctcatgcccactccttccccaccctggttaatctccacccaaaagggcccaggctcagaactcaggacacctggatcagctcctggacttgcccccactgctttctgttcccctgagccacttagtctcttttggcctcagtgttacctgctgtgaagtgaggaggcttatactgaactgaggaagctcttttcttcattcaaaattaaaagacagaaacaataaagtcatgtgaattaaagccttctaaggggatgtcatttaatgggctccaatgggcttcagacatggaacttcttgtctttcctctgcagagattccaagaaagggactcaaaagggcttgctttctgtatgatgggaacagtgatctccagctgagtataagcaggagagtcctagtttcatcagcaagacagacaaggctagggtagaaatcctcctggcacaagctctgagaggtgtggaatgaaataaagataaacatgaaattaatgtgcctatgatggtgatgttagctcacaactaagctgcagaaccagaaacctggtgattgcagtgaatcatagctgctcttactgggtgggaggtgcaccagtttgcttcctaagtgcatagaaagcctgggtccctgtaggatggcatgcacatctctctggactttgaaagtgttgcagaagagcttcagttgactcactctaattagacctgactgaacaaaaccattagaggagggcatttcaaccctgagacacttctatagcaattgcacctgccccaccccactgaactgcgtgtgttacctctctgtgctgggctgggcagggcagattgggtcacactggcacagaatggggctggactctctggtcctcaacttctgaggtgacaggtgctgtggggtcacctggaagaagaaagctcctgggctgagtctcctccaccagttgggggcagcagagctgcagccaggagcagtgaggagagaggctggggctgcccagctggggcgaagaggaaggccagcctggggttcaacaggtgtccaagagtcagtcttcagactgaaaatgaagacagttcatcctatcccctcgggctgcagtgaccacgttctgagggtcagattcatacagtgtcacccaaggacaccgacagaagcccggcacagtgaaggcctcacctgggaaatgcaactagaagaggctgggcccaggtgtcagcttgggcagcttccttaggaaggggattccctgggagaagtcctgaggccgaggtgctctaggaggggcacaatgtgaggtgacagggctcccagggcccaggttcttcacccaggatggcggcctgagcctcctgccactctcagggccttgtccctccctgtccagcagtgtcctggggagctgagccctctatcgtgggcacttccagatacacccgacccctcctgcctctgcctttccttccagctccaggtggactctgactcaggacgcagctcctgtgctcaggggagattcaggtgggtggcgtgaagcattttggggccctggtccctgcatgaggcatcaccagcctccttcaggagatgctgtccagaggaacagggcttctcacctgcctcaggccacagctctcaccacggggctgtcctttgatcagtggcaggatctgcatggctggagggactactgaccacatgctctctggagctcatgtcttgtgtggagaccatgacctggggaccctcagaaagaccaagcagcctaaagttagattttcagtccagtgtgattctctggttcttttcgcaagtttacgtaaaacgttgatgagaaaaagtgaataaataaaggaagagttgaggatggcaattgctggtctactgtggggctgggggataccatggaaagagcagcaccacatgtcaaatgagactagagattgggatgcatccgaaatatgtgtggttgctcaaatgacaaaactcttccaactgcaatgattcataagtgtcctacagacacagtacatcatgtacataacattaccaggatggggccaagtgactcgggggtatcaggagcagggatgaaagaggagaaagatgatgcatctttggtgtacttgctgctgagtcaggcgtcatcagtgatttctcaacagggcccagctcagccccaggccaggctcctggaaggtccatagtcctgctcaatgcagcccaggacaggccacatgacacagaggtttgagacagggaccatgttgtcaatccccaggacggtgactgtgatcacaggccttggaggccaaggctgattttctgactggagaagcagacgaaggaagctggggattcaccccttcattttaagtttctcatgctgcccccagagctggcttgagggatatcccgccatgaggagtcccagagaagtaaatttgcataaacaccaaggatgcactgccccagtgggcctgagaggaaataagagaggcctgggaagcccagctgtgctgtgggctcaggaggcagagctgtgggtgtctcaccatggcatgggccacactcctgctcccactcctcaacctctacacaggtgctgcccccagaccctgccccaggctcagccctcctaagcccctggtcttaccctgaaccctgagctcagcccaggcatagcctcagggcgatactactggaatgggtttgttatcttcaagccccctctcttgtcctctcttgcaggctctgttgcctcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatccctcagtgacacaggcagatggggaagtgagacacaaactcctttttcatctgtgttgtgttcttcctccagcaccaggaagactgtggaccaagcaatgagcaggtctggccaagttctactggatctgagacctccaggccatccttttttccagctgtccaggttggctctgcagagggtggagcaggagtggatttaaggctgctataatcagaatttatggtgttttggggcctcatgagtgacttggggaaataagaactggatggaagatgaaagagatgtagagaaccatcacttgaccttagatttccatacgatggtgattgggtcactccttcttcaaaatatcctacatcagtcccgaaaaatacccacctcagctcaacacctgagcttccaggcttccatggcagcctgggattttgaacaggaaaagccaaggaggggacactgtggcatctgcctcaatacccttttctgagctcacccaacctcaactgctgggagcttctaggagctcagagctgtgccctcactgggaagtgctattagctccaaagaaaacttccttcctcatatttaggcccagttttgagagttttggtttgatgactgcctgagccaagaacccaaggccctgtcctaatagaggatgacactgaaaggccttccagatccagacatcccagtatggatgcctgaggcctcagttgcaaccctattgtgggtcagggtctccttctggtgggcgatgcctccctcactccttccagatcctctgtgcatgcacatctttttctcagagtctacttccaggaaacccaaactaagatggctggctatcaccaaaataaactaccatagacctgaggtggaaacaccagcgaatttcccaaatttccattgtgaacatccaaatgcccatttatatctgagtgttccttgtattcttataaaatgaaaatggagcctgacataccaggtttttggagtcctgaaggagatgtggagacagatccttctgcaaggaatccaccgaaaggggagcagcctcaccccatgcaggggctggagatgctcccacaggggcagctgtagcatggacgctaccaacctccaccctgcacatcctgcacaaacaatcactctttcacccctccttcagcttatcaaagttgacacttacgaagccagcacagctcacccttgtcaatcagactccttcaaacctccatcaaccacacaatctcaacataaagaatctccccaacataataataggaacagtagctatgaaaatggctataaaatatctcataaataattttagattgtgttcatgtgtaaatattatttttcacactttgggttaaataaaatatattactgaaactagtttacctttttattttttatgtctagtatggtgactagacagtaggattcacatgagactcacatcatgtgattgtacaatgctggtcttgtcttaccccttgaggtggcaggtgctttggagtaacctgcttcagcaagccccatctccacccgtaggacatatgtgtgaagccatggagaggcactggtggaagagaaatgagaacacagatgtggaccagctgtttatgcaggtgactgagtcctggagccctgatcctgttctaacctagatgtgtcacatccatctcaccagagaccgctgctggcctgccttagctcataactggggggatctggcagttcatgaaacatggtcgcttgatgtccagtgttatcctgtctctctcagggcccaataagacaaaaggagctgcttttagaaagggaagtaacactctactgcacatgacatggccttattccaaaaccccatgagtctacgttgggattctccagtggggtttgccatgtacaggaggtttcagttcccacagtagagtcagctggattctctggacccaacagcaggacactcacaaccctgcctgcacctgctgcagagcctcaatgctctgggcctggaaaacaatgggtgatatttgtggctcctgatatatgggttggagccacatccccaagtgtaaaatatgctactcctagacctttatagaccttgtgtctgtttcttcctggagggaattgaagggtataataacatgttctttaatttgtaggagactctcagctgctccagacaactgaagtcccaatttctgctaatacagaagagggaacagtttatttcccactcttaaaagtgcatggatctcacaaaagcttccagtaggccatgcccatcatgtatatgtgattcaactatgatatcaagatggtctgaaccctcatgatgatatcatgatagagataagagagctaatgatgctgggcagagaaagtgtgaatgtatactgtcgtccattccacctgaatgcacactgattctgatcctattctctgagggaaatagacaagacctcagtatctgcttcagtgaggtaactgtgcacctgcagccatagcattctgttcccagagatccccatctggcacagatattgctaatgccactattgcccatctgggtctgtacaaatccaaattcatcttccaggatcattcaactattgtagagatcagtccagtaaactgaaaacaaaaccccagaagtaatcacacgtactgcgggagaggagagagctgtctcagagggcacagtcttgttgaaattcctctgctccttgggaagaaacagcccagaaaaggccccaggggctgcgtctcatctgggttcctggatgaggcacaccccctactgcactgagattccacagaagctgggggtgaagtgcaaataccgtctttggttcatccttgggattttctttttatcacacactcgtcattttgtccacaatgtccaaagtttctaaagtgctgtctaatagatagaggttctttgtgcgctgaactaaaagctcttgggttggacaatggtgatgtttgcacaacatttttactgtacttactgccgcttaattacacacttaaaaatgattaaaaggatgaaacattttgttatgtttattttaccataataaaaatattgcatgctcaggaagcaaagtaattttgcaattatacaactgttaaaaatggaagaattatgtactgagcaccattttctctgttgtttatgctacaattcaactttctctctctctcactctttctctaattagcaatgatcttctgtctggtccaaggtcacacatttccagtcttccagaaatgtctgttgaatctgttaatttgttgccaggaagaatactcaaacttctcatgctcatatttgagtgttagctgtctccagccagcatttctaagccagaccctttgtcaaggcttttgaataattttgtgaaaagtacccccaaagatgacagtgttcactgttggcagcaggactgtttccatgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctattggacactgagtcacatagagggacagaaggtggctgaggacaccttatctctgatgagcataaggggattagatctgctggtggaacaggaagctgaagaaacctgtggctctaaacatggaatttccagccctgagtctctgctgtccgtgcccctctcatctgtatgttcctgggagatgtggaccacgggggttagaggtgaaggggattgggaagctttcatgttctctctcaccatctcccttgcttatctaacacactcttacacacctactttattggagcttctgctctacaaacatggctgagctctaaattagagacttttgaaagtgcagacggatgcaggaactcgtccatctggagactttccaccacttgaagcagtgaacacgtctgtgcaaggctcagaatttcaagtgacaggatgttgggatttcaaagaaaactaaatctttggatgaaccacgacagaagagggaaggttcacacatttccctgctgcttgggcctcagtgaggactgactcagccagtctcaggctcctggagaccgcctgggagatctgcactaggaaaccattttcagcacagcctggggctggtaaggggcccttactctgttattctgctgcctgataattttgcatccagagaagaattaggacctgtgagtccaggaatttcaaagcccatagacaaggtcccctcattctgccgtgacagcctcagctctgctttcccaaaaaaagagcatcttcccagcatgaagaaccaggagcaaagagggagcttctcccaggggtgagcagggcagaagccaccttggtcagtgggaaggaaacatgctcagctcacatctgacccagaatgactcagtcacacctgtgcagggtcacctgtgtgtgagcatcatctatttgctccatgagaaaataccttgtgtggctcttgggtaaaatcataccataggtgacatttctctgcctattgcttcagccgatgcttttcgtgattccctttaggacactggcataaggtaagcatgtcaggtgtgggacgtattgaacaggaaaagcagaggcttctcatatcaatgctcgtggcttgtatttgggcccatacctcatggaaatgggaaaaacagaaaagaaaatgatactctgctcaaaaaagcactgagaaatgctatagtattaatatatcgacaactcatttattgagctaatgaaatattaacatagatagatcatttttatagggggatccctaatccttaaacattatattaaaaatttgtcagcttaaaggatcattaaaaggcctatgtttgattgaaacctggagtactgtactttgagtcttctaatcagccaatgagtgcagggagctggctgccctcccaggtcctgactggctccatgtccaggtagagcagcgctccccacaggcagctggaggaactgacgaggggaagctgttggcatcagggcctcaaaaatttgactcaggattttcccacgtcccctccccaagtccaggcgggttccaggacactcagaagagctcatcattatgggtctaggacttccctggtcctgctcttctttcttccttccccagtggccttaagattgtcactccctgtcacaggcccttcctttccttgtcaagtgcactccctgaattctctgctcctgggtcaggaaagctctggaacttcagggaaagcagtgctgggtgacccaatggggacccagaaagctggcccagggccagatacacaggcagcagggtgggtccctacagtgctgcctggtgggcatcaggtagaggggagtgaccaggaccaactcccctgagtgtcttcagggccaggtgaactagggagggtctgggacctggtgtggacccatgcactgacccaggaataggacaggaaactcctcagagcaaggactgtgttttcctcatgctgagctcctgaaaagcagtcttgccaggatagagtgggccagggtggatatatgttgggtgaatgagcttctgtctctgttttattgcaggagtcactacgaaggtacgctggccctgtatttgtatccagaaccagtcaaagccacctgtgagtcctgcatccctcagtaccaagccccagtcccccttcaggaccacccaccacacagagagacagacgtgcagggagcctgaggaagaacctgaaacctcctctactacatggagtgtttgtatttccatcaggaatcttgagcaccttgtgccgggtcttgaggcaggaaggggccacacagagaagaggagtttcttccctgaggtcagcagtccatgaacgaagggatcagggacttgagcagcagattctgaagcaacacctggacccaggaggcccctgagcctccagcagcccgcgtagagtggccaccagggggcagcagagagtaacctggcagaagcacctggagatggggtgggcctgggcatcagggagatgcccacatgcagggagggtcggtgaccatgacctgagatctggagggaaagaggttcttcttttcttagagtatttgtccttgacaccgatgtttacattcttctggcttcctggttctcagatctgactcttggagatgatccttatttttctgacacacattcaggcactttgcctcttcccatcgacctggcccccatctcactgtcacacatgccatcccatcctgtagtcagacgtgtcccacctccctgcctttgctctgggagcccctgtcctgcagacacagccacttctccttccctggccacccctcaacgtccactgtccccggtctttcctgactctgttctggggaacctgccaattcgtagttcttgatttccttatgagacacacaatacttactcattaatcttttgttgacttaagtttttatccattgttacattttcccagcaacagaagacaacttagttataataaacacttacttcctgggtcttggagtttgcagccccctctcattttctcatgaagcaaacatttccttcacctcctgatctgtccctggtcctgacagcaccctggtgatactgaggcacagcacccatgacctgacactagaactcgcagccaaggtagaaacttaccgcatcccatggatcttccaaaattctatgtgcccttggcaaccaagaattgcattctcctctagcacagaggagctgtgccctggaatggggcctgtacctgtccaaggcttgtgccgtcccctgtgggagatgagaagcgtccctgcattgggctcttggggacccgtcttggacatgagtgagaatgaagagggtccctgcattgggctctggcatgtgactttaaatggatttaggcctgtaccagacatctcatgtctgacataaaatatttacaatcaggacattactagagaagcagaaaaaagctaaccacctccctcctgagccaggatggaatgaaggaggggactgtggaccccagataattcccctgtcaccactgtgactctaacaacctcttaaatcacggccaacatctatcccataggaaggtctttatatcccctagaaaatacagaggaagtcagctctgagcttttccacgaccaacccagccaaggagcaaggctgggcacaacctgggtaaagatgtgagcccagaccatgggaccagtgggtgaaggaaaatcgcatgggctgagggggtgggtaagcaggggccagccctcctctctctgtttcctttggggctgagtccttctctggaaaccacagatctcctccagcagcagcctctgactctgctgatttgcatcatgggccgctctctccagcaaggggataagagaggcctgggaggaacctgctcagtctgggcctaaggaagcagcactggtggtgcctcagccatggcctggaccgttctcctcctcggcctcctctctcactgcacaggtgatccccccagggtctcaccaacctgcccagcccaagggttctgggtccagcgtgtccttgattctgagctcaggagggcccttcctgtggtgggcaggatgctcatgaccctgctgcagggtgggaggctggtggggctgaactccccccaaactgtgctcaaaggcttgtgagagcctgagggactgcacctgccaggagagagtagtgagttttcagttcaaagtctccatacaacaggaaagtcatgggccactggggctggggctgattgcaggggataccctgagggttcacagactctctggagcttgtctgggacagcagggcaagggatttcataagaagcatctttcacctgcaagccaacctctctcttatttatttatttatttatttatttatttatttatttatttttatctttgcaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatcccacggtgacacaggcagatgaggaagtgagacaaaaacaccctcccagcctcggtcaccctcttgctccagccccgggaagcctgttgataaagccatgagtgaatctggcccagttcacctggatctgagcctttcaggttgcccttccctccagccccctccaggagtctctacagaagatacatcaggcataaatatggcctggaagggccagaatcatctggtgacttggggctgttgtgtgagttagagaatgaaggcttgggtggaaagacagacagaggcaacctctgtccactgtcctacccctggatggtcatatggtggggacagggcaagtccttagaccaactgtctggatcaggccccagaactactgcccagttctgctgaggtcctggcccccaggctgtgtggcagcctgtgattcccaacagagcaaaccagaggaatggacactgtgaagtctgcccagatcccctcctcaatgtgacccacctggcactgctgagaagcccagcagctcagagctgtgccctcactgggaagtgctgttggttgcagaaagcttcctcaagtttgtgtcccttttcagaggggttcggtttaatcaaccaagatctcaaatccttgcctcaatttaagatgccactgaatgaagggcctcccagctccagagctccctgtgtggatacctgaggcctcaatgtcaactccatcacgagtcagggtctccttctgccccgtgttgcctcccccactcccttctgaatcttctgtgcatggacatctctattgcagagttagcttccagagaaccccatctaagatggccagctgtccccaacatgggtcatcagggacctgagtaggccactataaactgaaaactctggtttctgtccaaatttgcagagtaaatgttgaaatgcccaatctgatggttccttgaatttttatggaatgaaaagggagcctgacatgccaggtgctctgggttgagggattgttggagtcagatctccctgcaggaaagcccggggcagggggagcagcctcacccctcacaggaaccacagatacacccacaaggtgagctgcaggatggatgctgcccacctccaccctccacatcctctgtaaatgttgctcctttctacaactccaaccagatatgtagatgtggcgaactacgtaaaatacggatcattcatcacatcaaaacccactgcaggacaccctggtcaacaaagaacccaatcacatccccatcaactacatagtttccaaattttccatctccagaaaaataacaataacaatatacatgaaaatcgatgtaatttatctcatacataatttcatgttgataacgtgaaaatgatagtattttgctctactgaaataaataaaatatatatatatatctgaatttatttgtcttatcttttcatatttaatgtggtgactagacactagggggtcacaggaggatcgtgtcataccactatgggacagagctcctcacaactctttcaggtgacaggtactgttgagtaacctgctgcaagcatccccatctccaccagaccatataagtgtgaacccaggaagaggcactggaacaatagagagaaaaacctgcttgtgcagaagacggtgcccttgagccctgctcctgctccatcctacgggtgccacattcatctcatggtgtaatatttcgtgccctgcctgagcttatgaccgaggggatatggcaggtctgactgtgtggttactggtgtctcatgaggttctggatgtaacaaagccctcgaatatagaagaggttgttttcaaaaggaaataattatctactgcacatgacatagacttgttgctaaatcccatgcgtctacactaggattctcctctgaagccttgccttaagcacaaggtttcagttcctatgtccagttcctctattatggtagagtctgctagtttctctggcccaatagcaggacactcactcccccacctgcacctgctgcagagcctttctactcttggccccaaaacactgggtgacacagttctcagacccatgatttatagtgtcagtattcaggcctcaggggtccctgatggcttctctggctccaagtctggaaacacagcctccatgaccatctctgggttccaggctgaggatgaggctgattattactgcaactcacataggagaggtggcactttccaccgtggtccaagttcatggggaattgagacccaaacctgccctgggctctcagcctctctcttgttctgaagatgcttcctcaccctgtgcaaggggcttcttgcagcactgccttgagaatttcccctctcccagctcctctcctttctcaccaggaagtccaaaaggaaacctgctctgtgatttctcatccaggacagtgacagcttcctgatgcttgtgtgctgtggtccctgaatgtgcaactcttcctagctcttcaaatgcaggcacatagtgagaaaagctgcctgactggtgcattcactgctgtttttaaggatgtcctcacccaaaatgcatcctcctcccaaattgtgaagaacaatctggacagaggtcattacagggagtttcaagaaactgcatcttattcaattgtgtccaccatggtctggtaaagatggccctcctggatggactattcctctgcatgtctgtcctgaagcagtgaccactgtgagaagatctgaacatgtttgtgaggtattaaggacgagaggaaactgttgtttttattattcttttgtttttgtttttgaaacaaacttttgctttgtcgccaggctggagtgcagtggcagaatcttggcttactgaaatctcagcctcccaggctctaccaatgctccctgcctcagcctcccgaagagctgggataacaggtgaccaccaccatgcctggctgatttttgtatatttagtagagacgggatttcaccatgttggccaggctggtcttgaactcctgatctcaggtgatgcacccacctcggcctctcaaagggatgggaatacacacaggagccactgcatctggcagtgttttttttatttttgctcctcctctttgcctcaatacctcaggttgctgagctggggagattttgcgtgacaggctcagtgctccctcaaaatcctcccgtctcaattcgctggggccctgtcctggaaactccccaaaagtggatggtgtccctataggttgggagtttccaaaatggccccacagggaagagttaacgtgagtccattccttcttcctcattgacatccagcatttgtaatttccatgggtgtcaatacttttgtagctgaaatctttcttaatctactaaaggtgagaatgaatttaataaatattcagacattagttgcatccaatatttaaattttatgagtcaattggtagacatagccattattatatataatttaggcttcataaactttgattaaataggttttattaaaaacaaagtaaccattttattatgtgtttagactatatcaacatgttgtgtacctgaaatatccacaagaaaatatatttcaaaaaccaaattgtatttattgtctattgttgcataaaaattgctccctaatatttagcatggtaagagaacacgtgtttgtgatcttgtcacttcggtgcatctggaattgagagcagcttagttttgtggttctggttctgggttggtcatgaagttgcagccaagctgtcaggccaggctgcattcagaggccagagcaggtggccaggcccagcctgaggggcttccactgtccctaacctgtttgtctgatgtggaaaatctcagaggaaaaggagagagtgaagtgtaaggcacctgtcccagtcccccttgtcaaaggccatcccatacctgcaccatttcttattctttcctggggcgtcataggcatagagcactgcccattcattctaacgctgtagagtattctgtagtaggattttagccatgcagcctctaatggttatcaccatgattttgatcttacaaatcacactgcagcaagcatccctgtgcagactcctttgagttcatgtgtgcatatcaccataggataaatttccagaagtggaattgctgggtcaaaaggatgtgcatttttaacttttatccattgttttcatattcccctccagttctaccagtttacaataccagccctaaatattgattggaattcattggtgaaagtgcaagtttgtgccaacctatcagatatacaaagttatcttgttacacatttatttttgatttctcctattttgcttgaggttgagcatttactcaaatatttcagtgctcattatgttttaggatttggtaaaccgtttcttcaatgcctcggtaagaggtattttagtctttgccatgcacaagacaacgttgggataatatgtatgttctgatacaccatctacaacgtaatcattaaaacatataaaaaccactatcagttctggggccattaaaaaaattggtggcaggccagggatgtcccacaggatgtggtttaacggtctctggtttctagggttatttgaagtttgaacattgcacccgcatatgttctatgtggagatctctttgtgagggacactgtaattcacctcctctaggggcctgaggtctttctttggataagaacctacctgtaccatgtgtttgattggatcttgtgtctgctcaagacagccctgtgtcacaagctcatgactttcatcttcatccatttgctctgttttgtgagagcttcagtatatcaggaatagagattcctccgaggtgaaaaattagaggcagagggaggggcaaatgggcaaggaagcttgcaccaagtcgggagtgatccagtgtaggctgagagaaaaaaggtcttaaaatcagccttgtagctgaaaccaaaaacacacaagatggttggtgttctgagcatcattaacaaatgataaatgaagttgaacttttaaatgtattgcaaatttttataaagcaagtagatcgttaaactcagaatgcaacaatggaataaagaagagagtttgagatgtttttaaaatttatttatttatttatttatttttgagatggagtctcactctgttgccaggctggagtgcagtggcacaatcgcggctcactgcaacatccacctcccgggttcaagaaattctcctgcctcagcctcccaagtagctgggattacaagctctcgccatcatgccaggctaatttttgtattttttgtagagacatggtttcacaatgttgaccaggatggtgtcaatctcctgacctcatgatccacccgtctcggcctcccaaagtgctgggattacaggcatgaactaccgtgcctggctgagtttgagattttaactgtaagtcctccaactaagttgccatgacaagaacagggatgatgagagtggaaatatgttatcctgcaaattatcgttttatgtaaaagaatattttccctcttttaggtaaaggaagcatcttctggagcaccttctctctgactatcaaagcaccattaagccacaaataaactgtaacatgaagtaggaaacaactgcccttttatataaccattgagaggtggctttatatgcataccaaaatgttgatgctcaatgctaaaattggatttagtaatttaatatgcctacaagaaattaattttctttggattatattatttctgtgtacgatttatcttagttaacttggaaatattctgctctaaaaacaactcttgttttttgggttatattttctgtatcaactatagctcttttccaaatgctgtcagagatagcccatggctactgatcacaaaattcaattttatggcatttaaattattctatactctaaattattttaaaagtgcacagatgtgaatttttcacatctgactcaaaaatgttgctgatgttgactcacttttttatttcaatcttattgaagtaggagtttacttttctggaacctggatgataacaggagactggagaggaaaccccccaaattgttttcctttaaaccctcaggatgaatcatcctggataatcacccacacttgatttgggtgatatctaaatgagagttgggtcttagagtaggtgctgagttagtttaggacttgcgctgttggaatgagttgaatgtttttacaagtgagaaagacatgagttttttggagtccagagggtggggggttattggctgaattaagtcccccaaaatgtatgcattgaagctgtaacacacaatatgtgactgaaattgtgcatagggtctttaaagaggtgactaagtgaaaatgaaaaaattagggtggattcttctcaaattggactgatgtcctcctaggaagaagaaatttgcacacacagaaatgaggcaccagaggtgagcgtgcagagaaaagaccaggtgaggattcagcaaggaggtagcaacctgcaagccaaggagagagtcctcaggggaaaccaaacccactaccacctttatcttgggttttccagcttcagaactgtgagaaaatatgtttctgccatttcggtcactaattctttcctatcttcttgtgggagctctagcaaaaacaagagggaccccaaagaccttggatgagggagaaggaggagatggagcagggtgcaggaggcggtgcaggaaggggctggaaggtcgggctctgaggtgcatctcctgggtggaatcttgactccactccctattgtctggaggacttgggaaaaacatttaacctcctaatattcactcactaataaagatgggcttgaagcacaaggctccccatcatcctattctatattacaaaagtcttcttgaggtaacacttgtaaaactctcgctaatgcatctggcatgtattatggactcataagtagcccttctgagtgatctagtgatgtgcagaaaatggcattcatgctgtgtgcaccagggggcactgtgaggtttagtctgaggcccctaatgagtccaagcccctagtaatgctcaagggcgaagagcctgactgttgcttcctatgaggccccttctagtgggtaaatctgaaaatgcacttggcccttcttctgatcttgagaaattactcagagaaggccatcaggctcagggctcagacaagaaccaggacaaatgttttagggaatggagaacagatttgcatccactgctcaccagagccacctaacgacgacacaagaataaaggaagtagatttgcatgaagagacttcccttcctatgataagagaggcctggaggttcctccttagctgtgggctcagaagcagagttctggggtgtctccaccatggcctggacccctctctggctcactctcctcactctttgcataggtgctgcctcccagggctcaaccccatattatcatgctagctgtgccaacctggccctgagcttcggctcaacacagggagtagtgtagggtgtgggactctaggcgtgaaacccttatcctcacctcttctgtcctcttttgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatctcacattgacacagacagatggggaagtgagacagaaaccccttcactatctgtgtcatcctctctctccagccccagcaggactgtgaacaaagccataaacagggctggcccagttcacctgcatctgagacctccaggctgcctttccctccattcctccaggtaggctctgcagaaggtgggtcaggatgatgtgaggcttgaaggaccaggctgttctgctgttgtttagactgagtgtgccttgcctcaagatgacctgaatggaaggaccacaagaaggagatgggcagctgttgagtggtcatgatccctggagttcctcttgtgtggtgactggatctaacacaatgcctgtactttgtggcccaaatgccctggattattggtctgaactccccatgtttaactgagaccctcaagccccagctccatgcatcctgatgttctgaacaggaaagtcttttctagtgagcactgtggcatcccttggcatcccagcttcacacagcaattccccaccaaaaaatgcctttgagtgcaaagaacggcttcatgcaaagatgtgcctccttcagaatgtagttcaggagcaataactacctgatgccttaatcccaaagccatattttaatttagaatgaccttgaaatgccttctagctgagcagtcagttgtaacacattcccagtcacgcctcccacacttctttcctgacagtatgtcatgaaaccctactgcatggaatcctgcctcttagagtaggattccagggatctcaaaaattgtttagaaatgaacaaaaacagtctagttggaagagtatcaaagaggaggcagttgcacatgcagagaactctgaggtctgcaaatatacatgaactgatgagcacttgtgtgtaaagaaacacctccgaaagagaaaagaaccacgcaaagactcttgagggaacacctcacagagctcactcccacacacacccacccacgcactcacagacactcacacactacagtcacagaggaaaggcctgacttacagggcatgaggttgactcatcagaagagctttgcctcagtactggggaaaaagtcaccctagacaaaatgctgctcaggtctcaactatgaaagtgtaaaagcaaacagaaaactcaaactgtttttctgaacagtaaagtaactttactgaattcaacaataaaagacagaaatagagaatgaactgcaaaagaattctcaacccagcaggaaaaatgcacaatgccttcatcctgtcaatatttcctgcaaggtaaccagaaaatatatgctatatcaaacagagaagtgaatcaatcccaaatggcaataaaattgcacacatgatagaccttgtaggcaaggatatgaaagaaattcttataactctattctattctacttgttcttgaggatataagattgaaaaatcatattaagtggatacataaaacatataaagacagacgcaagttatactcttataaatgatccataatatgtctgcaataaaaaatacactgaatgagactgattgcagattggattctgtgaaagaatagatgagtgaacttgaagatatggcaatggcagctattcaagacgaagcacaaaagcgtaaacagagtatcagtgagttttaggacatcttcaactgcctaaattggtataatgaaagtcattaaaggaggtaagattggacagggaagagaaaaggcagaaaaacaatttaaaggaacaatgaccaaaatttcccaaattttgtgaaaactagaaacctcctattccaaaaagtttaacatgtcccaaagacacacacacacacacacacacacacagagagagagagagagagatagagagagagagagaaagagagaaagggagagagagagatacaggtgaacaacaaaatgacaagaacaaatttggtttttaaaaatttttttaattttagtggcttcatagtaggcatatatttttattgggtacacgagatgtttcaaaacaggcatgcaatgtgaaatagccacattatggaaaattcggtattcattcactcaagcacttatcctttgtagtataaactattcaattacactcttttagctttataaaatgtacagttaagttgttattgactatagtcatcctgttgtgctgtcaaatagtaggccttattgattatttctaactagttttttcttacccagtaaccatccccaggtaatagttgatttcttattagaagtaatgcaagcctaaatcagtggagttacatttagaaaatattaaatgaagaaacttactacccaaagcaatctacaaactcaatgcaattcctatcaaaataccaatgatattattcacagaaataaaaaatcctctaaaattggtataaaaccctaaaagacgctgaatagccaaagcaatactgagcaaaaagaacacagctgaagatatcacactactagaattaaaatatgctacaaactatagtaaccaaaacaggaagttattggcatgcaatcagacactgagaccaatataacaaaatagaaaacccgtaaataaatccatatatctatatatagctgactttcaacaaagatgtcaagaatgtacactgagaaaatggcacaattttcaataagtggtgctgagaaaactggatacccatctacagaacaatgaaactagacacttatcctctccacaaaaaaatatcaactaaaaatggattaaaggcccaaatataacaccccaaactataaaactactagaagggaacttaacataggggaagaacaaattctttaggacattgttctagataaaaaattatatggccaagacttcaaaagcacaggcaacaacaaataatagagatatgggacatcattaaactacaaagttcctgaaaagcaaaggaaacaatcaacagagtaaagacaacatgtagaatgagagaaaatatttgcaaactgttcacttgacaagggcctaacattcagtgtatgaaaattttaaaaaaactgaaataactcattagcataaaaaaactaataatatcattaaaaatgggccaagaatttgaagagacttttctcaatagaagatatacaaatggccaacaggcatacgagaaaaatgttgaacatcactaattagtgagggaatgagaatcaaaaccccagtgagatacaatctcaccctagctggaatggctatgatcaaaaagacaaaaaatgcaaagctggtgaaggtaggtgacttcacatttctctagtccgattctctgggaacaatgagagtgctctgtctttgctctccctctagtaactatttttcacacgcaaaaatatggaccctagtgggaaataatgcctaagaccaccaacaccttaatcatttgttcatcacactagaaatgaaactgttttccaaataatattaacatctatctgtgtctatcgccattgtgtcaatgtctgtgtgatcctataacatttagaaggcctagaagaatgcccttgctttttgcaatatgaaaatggccgatatcatagatgatatagatatagatagatagggggttgtattttgaaatgtatttctctaaaggacttctttcacttcaaatttgaaattattcttgttttaaatgtcacaaatgataaaccttatagaatgataacacaattgtatgtgttataaagtcacagggtctatcaaatgatgaaccaatcattcggtgttgaggttagtagtattttttttatttcgattctcactaaatgagaacacgttttgtattgaggggccatgccctaaccataccacatcgtggggttgctcagagactgtgaggttctgcccacactaagccagaaggagaattttattcctaagccaggatgagaattttattcctcacactgctctctgcacttgtttgtatcccataatatcccccaaaagtgagcatgagaagttcattttttaagctgcttgttcattctcttacatttaatacatgtaccaaaaattgtcttcatttttaaaataaaatgttatgctatcttgtaatctataaccctatagaataatcttgatccatacacttttgctatcacaagcagaacaagatccacttcctctctctgggataaatcccatgaccgctgctctttgagcattatttttcttaagttattttttaaacagaaatttatctgacttaccttaaccaaatgtcttttcaaagtaaccgcatttcttttaagtgaaaaattaaatagttaccttctgttatcaagaattatctgaatacaaaatatttattgtttcaactttagaaggaatgaaaaacatctacaggttactaatctaaaaatgcaggctctgggtttctatggtgttaacatgtcttccaaattttaagtaacaggtatttaaataacatgaactttgttttcaaacttagaaaatgtttcaaccttttggctgggcatggtggctcaagtctataatcccagcaatttggaaggacgagctgcgagttttgtctgatcccaggagctcaagaccagcctgggcaacatgatgaaactccatctctaccaaaagttataaaactttgccaggcatggtggcactgcctgtagtcccatctactcaagagactgagatgggaggattgctggagccagagaagttgaggctgcagaaggtaaactgtagaggctaaaacatgataaatatttaattcatcacttaaaagaaatgttggttacattgaaaagaaatttgattaatgtaattagatatatttctgtttaaaaaataattgaagtaagccctgttagcaccactgcattccagcctgggcaacagagcaaaacctgttaaagaaagaaagaaagaaagagaaggaaggatgaggaaggaaggaaggaaggaaggaaggaaggaaggaaggaaggaaggaacgaaggggaaagaaaaaaaggaagaagatatttcaagctttacagtaccagagccactctgtaatcaataagcaacaggaccaaaacagaaagagattctgtagaacagtctaaccagcgatacaattatacatttctgttcagatatcaaaaccattttcaatagtaaatatatggaatgaactccccacagagatcaagtaggatgtatgatgtgtgaatgaaattatgagttgagagtaggaaatttataaatttaatcaaacaaattaaagcattatgaggaagttgtactgctaatgtattacttggcaagctgttcagtggaacaccaagatattcttaaggaagttgcaaatatcttttaaaatgttatcattgaagtggatttttaaaaaatgaggacatgaatacctttacaaagtattcagggataaagagagaaaaataaatttagattgtgcatacatatataaaatttattttaaaagataagcttgtcttttttatcccttaaataaaaggagcagatatttaaattccttgtcttttattttaaaatttagaaaatgcttacagcttcccacactgaaatttatactaagacagataatctaatcaagggataacaaaatcaaaacagaattctcttgatgaatctattttcttgatttttaagtctcagtgtgtactctatagtaaaactatttataattgattctgctgtttgaaaatatttactgatcgtttatcttgcaccaagtgatctccagctctgaagataggtcagtgggaaaacatacaaagttgcccagcttcgttaaacttaaattctaatgaggaaaaaagaagtaattaatcagggactttaaaacaggagtgttgtgatatggcttggaattctaactgcttcctgtgcttgctgtgtggagactggattgaaaaatagggcgatagaagcttaaattcatatagaatatggctagcctgtattttgagggcccctgaaataagaatgtatagtagttctcattatttcctcaagaaatctgtgcagtagagctttggccttgggagggaagtactatagtcaccaagtggtgagggtgggaaggtgaatttgcaaataccacttggaatgagttcactttaaaggtaaagctggcaggattttcatacatgtcagatctgaaaaaatgtgtgtgcgtgtgtgtgtgtgtgttatagagagagagagagagagagagtgaaaaccagacagataccgagagagaacgacagatctgcagtgacagagagaattaaaagcggacaccacgaatattgagctcagaaactataaaatgggaggtgccattaaacagaatggggaagagcaagtttgaggagtatcagtggctccatgtggacttattgattttgacattcctaacagatgtccaaatggagaagtcagacagtgttgtgcgtagtctagtgttaaggtatcaaagaaaatatcaggaaatgagtgacacaaaaattagtaagaaagcaaagataagaaacattagtcaaagtcctgagtccagtggttatctaacacccaaaaagtagtaggccgggtgccgtggctcatgcctggaatcccagcactttggaaggccaaggcgggcagatctcctgaggtcgggagttcaaggccagcctgaccaatatggagaaaccctatctctactaaaaatacaaaattagccgggtgtggtggctcatgcctgtaataccagctactcaggaggctgaggcaggagaatcgcttgaagcagggaggtggagggtgtggtgagccgagattgcatcattgaactccagcctgggaaacaagagcaaaacttcatctcagaaagaaaaaaaagtgataaagacaagaagaaaccagcaaaaaagtactaggggtaattatcaaaaatgtcaaagggaaagtaggttaagtgttctggaattctctcaaagaaagttttgaaaaaaggagggaggaagagatcaactgctttcaatgctgctgatacataaattaagacaaaggctgaggaattatgcttcaattcatcatttaacgatatggatattgtttgtgctttgataagagcaattttcttggagtgagtaggtgagaaaccatattggagtggtttctcaaaggaatgcctgatctctggattcttaaggaaactttttattgaacagtggaggcacaaattggatttgttttaattccggggtcgggacacactctaaacatgtgcctctgcatgcctcgcttattacagctaggtatcctagtatctttcagtaacagaataatcacctgcaaaacccacacccatttaatagacacgctttacaaagactgatactagaagttgttggagaggatgtggttccacgtaatatcttatgagtcactgatgggcaagtaagctggtaaaatgtctttggaaaactcactatacctgctatactaaaacattcagataccaaacaccagaaattccatattgtaatatatttctatgagaaaaaaacaagagccctgtattaaaatatagattattattaaaaataatcacactgggtttcctgatttttttattagcaagtcagtctctgcctgattcaatagtacaacctctatctaatatatatatatagtgtttttaatcaaccactaagaaaaagtattatattttatatcaattctacattcagtgccgaaaccagcattttgtagattccagagatttgttgaataaataatgaataacttaaataagttaatatttatagtatccatatacaaataatacatcatctcagaatacaataataacgtttgttatgcagaaaatgatttcaatctcagttaaaaatattttgggcttaggagttactgtcatatatggatgctcacattgttttgtttatacgaaaatgtttgtagttaacgtacgtttttggtacttaagccttttgttcttgctgccatagcaaatagtgtgcctattaggaacaagaaccagaggtttacttcatcttaacagatttcttaataaaatacatgccatactgtttggtttaatgcataagcaaagagtcattcactccgccattgctacgtgtccctcctctaatacggctcctgaagatgttaccgatagcagaggactttgtgttcaacctaagcactttatagccctttcactttcaactaagtatgagataaaataattcagcaccaataaaacaaacacttcttaaatactgaccctttttttgagcctgtttcacgttacgcagcaagacagagtacacttctctttcccagcaaatcagtgttggcactacaccctctacactctgaaaacttgtattattggcttccttagaaacacaatttgagcttataatttagatgtcatcaaataatgtacaaaaatatgctacttccttccccttcacttctcttctcttctcttcttatcagataattgtcagttgttttttctctccaactcctttcctccgactacctgatttttaaaagactttctgcacatttccaatcttagtattgtagagacaaaatgtgtggtcaaactgcatatataggaagagctgaattatatgcaagcatttttaaatacacaattcctcctcagttttctgtgattatttcatataatcaaatgtcttccagatacacatcccaaacgagtggttgtcaagctctgctttgtggtctaatttcatcagaattatccaaaattcttatgataaatacagataaattgacataactccagatttatgaaatcaacatttccagaacccaggaatatgcattgaaaaagtgtattcctcagatgatgctgacatgatacgggatccgagtttacaatgcaaggaaaattaccttccttgcccttcagctgacccttgtatccagaggtcctcttcccctttcatattctgccctctctccttctgcacctttctcctttcctccctccagttctgctcatccagatcccaagccctcccccatggattccctaaacctcccaaatggtcagttgccactaaagttccctctgtctcatgaacaagttatgtgggcaaatgtaaaatttaagcttggaccaagctgactcaagagcggcaattacaaatttccctaaacccagaggggaccagcaaacacttgtagaagattagagatttcctgtgagtgcaaagggctcagagtgtcctgatgctgtagaccaaatcttactgtcccctccaattcatgtgttaaaatctaattccctatgtgatgggatttggaggtgaggccttggaaggtgattaagtgatgaaagcagagaacccgtgaaggggatcagtgtccctatcaaagggacggctgagaactcctcatcccttctgtcatgtgaggacacagtacaaagatggccgtctatgaaccaggaaggaagccctcaccagacacaaaatgtgctgaccactcactgctgactccagtgagtcagaggagcgcaggccacatacctgggtctctgcctccatgcctcccacagtgcccagggctgagagcagagtggcagctgctgactggggctgtgctggccacctgctctcttctacctcttgctcaagccatgctttcagccccatggctgaggccagtggctagagcaggtgccatgatgtcaggcagctccttaatgggctggtccttggcaggaccagggcaggggcaggagggctctgcagctgcctctagctccagttctgtccctgaagggggctcttcccctagtgctggcactggctcatcagctggtgctggaaggtcctggattgccgcacattgagcaggagatgaaaaagaagaaagagtcaccaatgtcagtcactttccactggaatttccacacacagaatcagcctcactgaattaaaggaattccagtccaaaaacactgcccccgcaaagtctccaaaactacaggccccccctcaccatgtgcctgtgcctggaggaactccagaggctccagcaggccaaggacaatgcacggatgtggcccggatgggatcaccagtgaggcctggcctcgtagggcctgcccagggctgtcctgtggtacctgggtgcgccttcggccagaggtgcctggggtgaggaatgagcctgcatcggcatcatgggaaaaggctgtcactctgggccctcctgaagcaggagcctcaagatatgcggatgcagcatgagaacatcttgctctcctgagcatctcccaccaagggaactggctgcgggactgtctctaggatgtgggtgcctggttaccagaattctaagttctgtgagggtatatcaccaaggaagtgaagtcacttctttaaggttccgtatcctcagccccttccttccataagacctactcagaaccccctgggctgctggctgctcaccctccccccaggccagatccttacctgtacacaggtaagtccacccagggcctgcttgtacacgtgctcctgatgtgcacctgggacctaggaatccacttagggcctgtgatccaacaggggcctaatgttgtttaaaagtaatttttattattcctacaggaaagaaaaggccttctagcaataagaagcacagtttcacatcaaaaacataaaaatgatcaaaatcttggggaagaaatgtatcaattttaatcactgaaatgttaacttttgataaatatttaagtttataaggaaaaataaaaccatgctgataaaaccacagttgtagggaatgctatagagtttctcctttgtggtttgaacacagaaaggtcccacctagttaggctcataattttctaccttaatcttcttgttcttatgattaatggaaaaaataccatgacaatgatggtgatgatggttcaagtacacactgaggtttagtgacagaaacatcaggtgctcccagttacagtgcagctgttcttattggggtgggaaaatcaatcttgtgttcagtatacacgggaagcaggagtacatgtggatatgaccacatttcactggacttatattttaaacagaagatctacagtttattcttcaaaaaataataacacttgccatgcaaagtatatatataagatgtctcaaataattgtacttacattgcatatgaaagtgatacattttgatatgctaggtaaataaagtaaattatttaactcatttacttcttccctttgtatttttaatgcgatgactagacattcagatttccatgaggctcacatcatattgtgaatgaacagtgctggtctgcaccccttcaggttacaggggctgaggagtgacctggtgcaggaagccccatctccatccataggacattggtgtgaacccagggagaggcgctggtgtaagagagatgagaacacaggtgtgaaccacctgcttgtgcaggggactgagccttcacataagttgacacttaaaaagccaccacaccccacccttgtcaacaggaaacccattcacatctccatcagccacacaatctccaagattcttcaaaaagtaataacaatagccatgcaaagtatatgatatatatcataaataattgtacttacattatatatgaaaatgatactctttttgatatgctaggtaaataaaatacattatttaaactcattgacttcttctctttgtatttataacatgacaactagacagtgggattcccatgaggctcacatcatattgtgattgaacaaggctggtctgcagggcttcaggttacaggggctgtggagtgacctggtgcaggaagccccgtctccttccataggacatcagtgtgaacccagggagaggcgctggtatgagagagatgagaacacaggtgtgaaccacctgcttgtgcaggggactgagccttcacttggagccaaagttttctttcccaggttcaatcctgaacaagagggccttctggacttctttttgttttcaggcttgtgccccttcaggtttggggctgtctggatcccagccaggggacactgaggaaatccaggagtctcacactgactgttctatttcatctgctggggccatcccaaactgctgtgtaccatttcctttcctggtgctcaaatagctgctccatgcccttgtcatggtttcagagatgaatctaggtgggaagacaggacagtgtatgttataatatttaaatggaagctgaatccattaatatttattttaatatgaaacattaaaagaattttgtcataagcaatgaggaaagaggaaaagatattcaagttattttgagaaaaaataaaaatgtatttatcaaatgtctgtgtgtcttcagtgtcgcagggttgagagcagccagctttaggttgccctgaggatgcgctcagatgggaaaaagcgagaaagcaggaaacgcgtctctgtgacctgacagataaatcacagtaatggaaataagtctttcaataattcaaacattcacaataaatatcactctgatgcacacagaaaggcctggtaacaaactttccctttgacctgctggctcatatccccatggatcacctgtgtgcagagtggactctctggtccccatttctcaggctgagaactagaggctgggaaggacaagtggcctgctcatgagtgggaagggcgggattgggagcagcagactcgggctcaggactctggccctggtcagtgctccttgttccctccacagggtccctcccacatgtgcccgtgtggatgtgggtgcactgcctggggtggctgatgtgctccagggattcaatgcggcagatgcttcagcaccaaaggtagggagtagggatgggacgaggctgcagctgtggagaccagggacccatgatgcccagcagaggtttccacggggtgggtagccccatttcctgacagtagagacagcctagaggtgggtgccaagcagagggcactgtgccatgtgcccaggcctggagggccacagagacacaggcgccacacagcagagacactgagagccaggagctcactcaggtaagggatgtcagcagatctttctctcctgagcaaatcaggtacaaaaaaattaagatcctgccatcagaatagacaaacagggactttaatctcctcggctgagccccgctgtccagggaagaagaagtctctgagcccaggcccaggtgagggtggagtgaggagaggagctcagggtgcagatttgcataaaggccccgccctcctctgaggcagaggggataagacagggctggggtcaggcccagtgctgggatctcaggaggcagctctctcggaatatctccaccatggcctgggctctgctcctcctcaccctcctcactcagggcacaggtgaggcctccagggaaggggcttcggggacctctgggctgatccttaactcctgctcctcaggctcacctgggcccagcactgacttactaaaatgtgtttcttcctttttccaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttccacagaggtccaagttcctggggaactgagaccaaaacctgccctgggctctcaggccccctccttgctctgaagatgcttcctcgcccagtgcaagcggcttcctgcagtgcggccttgagaattcttctctctcagctccttccctttccaccatgaattccaaaaggaaacccgctctgtggtttctcatccaggacagggacagcttcctgatgcttgtgcgctgtggtccctcaatgtgcagctcttcccagctcttcaaatgcagggacagtgacaaggagctgcctgagtggtgcagtcactgcttttttcagggatgtcttcaccctacatgcatcaccatcccctacactgtgggtagaattttagcaactacattctaatggttatcgccacaactttgatcttaaataacagtgcagcgaacatccctacgcagactcctttgagttcctgtgtgaatatgaccacaggattcatttctaaaagtgaaattgcaggtcagaaagattgtgtgtttgtaattttcacccattgttgtcagattcccctccagagggattgtaccaattttcaatgccagctggaagtacttgttcagagtacattgttgaaagtggaaatttttgccagcttatcagacagaaaaatgttaccttgttacagttttatttttgagtctcctgttctgcttacattttggccctttcagaaatagttcagtactttttctttttttaggatttagtaaactttataaaaaatatccagataaggagaattttagtgtttgtgggcaggcacagtggctcacacctgtaatcccaagcacttcgaaagagtaagacaggtgaattgcttgttcccaggagtttgagattagtctgggccacacagcaaaccctcatctctattaaattaatgcaaataaaaataaattttaaaaagaattattttagtctttgtggcccaagaatcaactttagggatattacataggtacttataacatcatttacaatgtaaccatttaaaaagataaaaatcactgttatctctgggccatgcaaaaacagttgtcaggccaggagtggccacaggatgtggttgaacggtccctggtttgcagagttatctgaatgttgaaaattccaccagcatatgatctaggtggggatctctctgtgagggtcactgtatttcacctcctgtattcggctgaggtctttccttggataagaacatgctcacatcatctatttgatgggctcatgggtttgcccaagacaaccctgtgtcacaatcacataacttttatctgcattgcttgttctgagttttgggagagctttaatatatcaggaatagactcctcctaagggaaaagtctgagggatatggatgggcaaggggtcaagaaagcttctaccaaagctggaatatccagggcaggctcagagagaaggatcctaatatcagcatttgactgaagccaaaaccagaagagaacatggacgttctgagaataataagtaaataaacagtttaaattttaaatgtattgaatattcttatactccatgaaaattctagaacggaatttaacaatgggataaggaagagagcttgagatgttaaactataaagaccacaaggcaagttgccaggaaaagaacaggacctttttagtggaaataggtttctgctgcaaattacctttcctatgaaattggtttttaggtataaggaaacatcccatggaacattcttctttcctacagtcaagatcaccctcaccccacaagggaacctcaatatcaaatagaaaaaataatgcactttgtataaccattaggagagtctttatttgcacatcaaaatgaggatggttaatggtaacattggaaatagtagtttaatatgcataagtgatgaatttcttttgactataccatttctgtctgtgatttatctttcttaatagggacatactctgttcttaaaacaatttaacttgtgttatcttttgttctattatctgtatcagctctgttttttttttcaaacactggcaaagttattccatggttaatgattattaaattcaatttatggatatttagattatttaaattatttcaagagtggacagatgtgatttccccacatatacctcacagatgttgctgatgctgacttgttcatctcttccaacctctgcaaacaaagtgggaaattggatttttctgaacacccagatgacaacgggagaggaggtgaaacccccctaaagctgttatcctttaacccctcatggtgaatctcccatccacacttgagttggatgatatgtaaatgagagtttggtcttagagttggtgctgagttagttcaggatttgggttattgggatggagtgaatgtgctttacaagtcaaaaactatgagtttttgtgtgcataggttggagagctcttggctgaattgtgtcccccagaattatacaatgaagttctaatgcacagtgtgtgactgaatttggagacagcctttacagaggtgattaagtgaaaatgaggtcatgagggtggcttcttctccaatctgactggtgttctgagaagagaaaatttgcacacatagaaatgagacactagagatgagcatgcggaggaaaaaccatgtgatgacacagcaaggaggtagccacctgcaagccgaggagagaggcctcagggaaaaccaaacccaccaacacctttatcttgactccccagcttcagaactgtgagaaaataagtgtctgctctttaggccagcaggtctttggtatctcattaaggtagcactagcaaatgaaaacaaaagggaccccaaagaccttgggtgccagagaaggaggagatggaggatggtgcaggaggcggggcagggaggggctggaagttcaggctctgaggtgcatctcttgggtgcaatcctgactccactcactgctgtctggggacttggggaagaatcattaacctcccaatattaattccataataaagattgggtcttgagcatagggctgctcatcctcctattccatatgatgcaaatcttcttgaggtcatgcttgtaaaacactcagcaatgtatctggcatacactatggcctcagaagtggttattctgaattttctagtgatacatagagaatggcattgttcctgtgggcagaggaggcactgtggaccttggtttgaggactcagaaagacaccaagtcctctggtagtgctcaagtgcgaagagcgtcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgcggagtagatttgcattcactgctcatcagggagcccacccaacaaggatacaagaataaaagaagtagatttgcatgaagagcctctccttcctatgataagagagggctgaaggtccctccccgctgtgggctcagagacagagctctggagcatctccaccgtggcctggacccctcccctgctcaccctcttcactctctgaactgcctcccagggctcagcccccaaaggaccagagatcagcctggacctgagcttcagctcagcacagggagtgatggagagtgtggggtctgggaatgaccctcatcctcataattacctcttctgtcctctcttataggctttgtggcttcccgtaagctgactccagagccagcagtgtctgtggacagtcagcaagggtaacctgccagggagaaaacctaagaagccatggtacaaactggtaccagcagaaccctgccagatgcctgtgcaggtcatacatggtaacaacaaccagccctcagggatcccagaccgattctctggctccaagtcaggaacacagccaccctgaccatcactggggctcaggttgaacatgaagctgactattaccgtcactcatgggacaacagtggtactcatctcacagtgacacagacagattggaaagtgagatctaaagaccttcactgtctgtatcaccctctttctccagccatagcaggactgagcagggctggcccgggtcacctggatcgaagcccttcaggctgcccttccctccagccctcccggcagactgcagagagtaggtcaggataggatttggggctggcagaaccaggctgtcctgctgttatttggaatggatgtaccttggctcaagatgacctgagtggaaggacagtaagagggagacagctactgagtgctcatggtcactgaatttcctcctgtgtgttgactgaacccaagacagtgcctctactctgtggcccaaataccctggattatttctctgaactgcccatgtttaactgagaccctcaagccccagctttgtgcatcctgatgttctgaacatggaagcctttcataatgtgcactgtgacatccttcagattcccatttcaggacttatgcacccaccatccacccagggctgcagggagttcctggcttctcacagctcttccccaccagaaactgccatgcagtacagagaatagctttgctcaaagaattgcccatttcaaaatgtgtttcatgggcagtgactccctgattgccttaatctgaaagtcatgctttaatttaagaccctgaatatcaaattgaagtgccttctagctgaacgctcaattgtaaaacattcccagtcacacactccacacttctttcctgagaatgtatcctgaaaccctactgcatggaatcctccctctcagagtaggattgcagggaactcaaaaattaaaaacaaacaaacaaaaaacagtctagagggaaaagtattgaagaggagagagagagtgcacaaggagacaactctgaagtctgcaaatattcatgcactgaagagcgcttgtgtgtacagaaactccctctgaaagagaaagacccttgagggaacactccaaagagcgcgcgcgcacgcgcgcgcacacacacacacacacacacacacacacattccagtcacagaggaaaggcctgagttatggggcatgaggtggactcatcagaagagcttcggctcagtattgaggaaaatgtcgccctagacatagggctactctgctctcaactaagaaagtgtagaagcaaactgagaaaagttaagacagtttccaagtaactttactgaatccaaaaataaaagacgaaaatagagaagaaaatgcaaaagaattataaactcaacaaagaaaacttcacaatgattggcattcaatcaacatttcctgcaaggaaaaaagaaaatatatgctctaacacagagaaaaatgaatcaatccaaagtggcaataaaattgtatacgtgatagatagaccttgtatgcaaaaattttggagcaattcttataactcttctccttgctcatgaggatagaggattgattgaaggtgttaagtgaagaaatggaaggcatgaagaaaaatccaagtttaacttttagaaatggtctctaaatatctgcattgaaaaaatgcactgaatgagaatgattgcaggttaggtgctgtgaaagaatagttgagtgaacttgaagacatggcaatggaagctattcaagatgaagtacaaaaaaagtgaagagagcaccagtgaatttcaggacatcttcaagctgacttacttggtataattaaaggcatgaaaggagataacattggtgaggggagaggaaaggtagaaaagccgtttaaaggaatcatggccaaaatttcccaaatttgttgaaagctagaaacctacaactccaaaaatcttaacaagttacacacacacacacacacgcaagtaatacaacaccaatactcatcataatgatattgctaaaaaactatgataaagacatacttttaaaagtagccatagagtaaagacatggtaggtacaggcgaacaacataagaagaagaacagatttcgttttctttgtaaaattttcttcaacatctgggggaacatagtagatatatgtatttgtggaatacatgagatattttgatacaggcatgcaatgtgaaacagtaacatcatggagaattgggtatccatcccctcaagcatttatcctttgtgttacaaactactcaattacagtattttaggtattttaaattgtacaattaagttgttatcgatgtgctatcaaatagtattgacataactctgatgcgctatcaaatagtaggtcttattcattctttctattttatttacccattaagcatccacaaataagagcagatttcttcttagaagtcatgcgagcaggaagctcgcatgtggagctatatttataaaatattaaaagaaaaaacttactacccaaacccatctccagaccatgaatttctctctggatatcttattaaaatattgtctcctatcaaatctctatcaaaataccaatgacattcacagaagcagaaaaaaaattctgtaactggtatggaaccacaaaagcccctgaatagccaagcaataccaaacaaaaaaccccaagatgaatatatcacattatctgaatcaaaatatactacaaattatggtaaccaaaacaggatcaatggtattggcataaaatcagacattgagactaataaaattgtatagaacacaccaaaataaattcatgtatttacatccaactgattttcagcataaattccaagaacatacattgagaaaaggacgcacttttcaataaatggtgctgagaaagtggatacccgtatacagaagaatggaactagacccttgtctctctccgtatacaacaatcaactcaaaatctattaaaaaccccaagtataagacccaaaactataaaacaactaggagggaacgtagaggacatagggaaagttcttcaggacattggtctagacaaaaattccatagctaagacttcaaaaacacaggcaacaacaaaaactagacatatgggacttcattaaactaaaaatcttctgaaaagcaaaggaaacaatcaacagagtgaagacaacttgtagaatgagagaaaatatttgcaaacaattcaactcaaaaggacctaagatccagtataagaaaataagacaaggagctgaaataactcatcagaatagaaaaccagtaatagcattaaaaagtgtacaaatgatatgaatagacttttcacagtcaaagacatacaaaaggccaataggttaattaaaaaatgcccaatatccctaatcaccggggcatgcaaatcaaaacctccatgagatatcatctcatcccagctaggacagctatcattaagaagacaaaaaaataacaaatgctggtgacgatgtagcaaaaatagaagacaaaaccacatggtcatctcagcagtcacatcaaatgttttcatgtaaggaaacattaccatttgctgtttttctagtcttgctagagcaccataaaagataagactagtggtgccaatactgtagaaaatgttattacatgcagagaatctcactatcccataccaaactacatggattcttactgttaaatgctaaaagattacaactctgcatttccaaatgttctggtggtcagagaccacttccttgacaagtgatgagtacggtgatgtgaaaggatagttagcatttacgcaggtattgggtgaagaatagtgatatacacaggaaagctttcaaagagagaaacacatggaggttggaacacagaagagaacataatatgtctgagaaataaagaaagtccagactcactggagctgagtgagaacaagaaaaacggcatgaaccatgtatttcactctggatatctcattaaaatattgtctcctccccaacacaccaccgatgtgaattgtaaaaatgcccgttcttaaattattttttgcacatcatgacagggtcaagcatgtgaatcaagctgagtttgatgagtccaggtctgtctgatgagtccagacccaggtggcctcagaaggacttggtggaacgagggcttgttgtcaaaagtagaggaagtgagattttccattgtggcttagacaagagattcttaaatttcagtggacacacaaggcccctgaggggtctcggtaagatgtagatgcagcctcagcagttctggatgtggccccaaattctctgtgtccagcaactcccaggtgaggctgctgctgctggtcctcccaggaccacactttgaatggcttagctcttattcacccacctcactcaagccacaggtaagactcacacaaggagagcatattctagaagcacaggtcacttctcactcctccccttgtgtcttagatccttttctgttacaacaaagaagtacccaaggctgggtaatttatagagaaaataaaaggtttatttggctcacaattccaatggccacagagttcaagatatggcatctgctcttgttgaagacctcaggctgcttctagtcatggtgaaaggtgaaggggagccagtgtaggcagaggtcaatgggggagaggaagcaagagagaagaggaagatgccaggctcttttaaataaccagctctttcggaaacagtgggaattcactcaccccaagtgaggacattaatctattcatgagagatccactcccatcaccctaaaagctcccattagttcccacctccaacactggggatccaatttcaacatgagatttggaggcgacaaagatcaaagccatagcaccctgaggtttggccacgcacttgctcatctccacatttgtccctcccctcatgactggggtcctgaccactctgactcagtctccctccacttcatggacacctggcagtcggtcatcatctgttttgctgaatcaacagcagtattgggggtattcaacattccacatttgtattgtttgaaaattgcccaatcttaggtgttttgttattgctacacaaacagactaagacatttactatttaatggttacatttcattctctttttatgaaattttgttgctaacagggactttctgcttggtcagaagattaacaattgtgtctcctggttccaccagaaacagagtagagacccacacagctgaggtatggggtcatagattaaaactaagagacataagattgattctcaggctccaagtctggcaagtgagcttctttgagactccctgggatctcagcagtcagactgatcattattgctgtcccaaacatcctatgtgatatggaagtaatatcaaaaccctcctgagattcctgacttgtgtcccgacatgaagtctgttgggattcctgtcattccttcaagattgttcaaataagcagcaacaatcactctcatatgagatatgaaaagaagaattccacatgaaccaaaccctgaagcccacactgaagtctgccaagttatctgcagtccagcgcgatggagggagcattttcgtggggacttttgagagtatggagaaggcctgaggaaacgaggctcagctatgggttccagaaacaaagctctgggatgtctccccatggcctcgacctctcacgtgctacctctcctcactctttgcacagatgctgccccaggctaagcccccacaggaccctaatcctagtcctgaccctgagctcagcccaggtgatatttcaggagatgggaccctgagaatgagccctaaagtctccttatcctgcagcccctgtggtctcttagactcagctacccccagtagagttggccatgagacacctgtcccccacctgctcaggagagagtgcagcaggcaacagtgcagagagaaccagcaggagccaggccaggcgctgcattcagagcagcccccaatccaacagattctccagctctagcctggggtacagcccccaccttctgcgggctgaagtgggcttctcaggatgggcaggccatgatggggattggcagtgtgtccatgggacacagccctactgcctgcctggccctcatgccccctccctccccatcctggttaagcaccaccccaacgggcccagtttcagaactcaggacacctgggccagctcctggacttgcccccactgctctctgttctcctgagccacttagtctcttttggcctcagtgttacctgctgtgaagtgaggagccttatactgaactgaggaagctctttcttcattcaaaattaaaagacagaaaaacaacgaaagtcatgcgaattaaagcctgatgaggggatgtcacttaatgggcttcaatgggcttcagacaaaacttcttgtctttcctctgcagggattccaagaaagggactcaaaaagagcttgctttctgtatggtgggaagagcagtccccagctgagaataagcaggagagtcccagtttaatcaggaagacagactagggtagtgtagaaatcctctcagcacaaactctgagaagtatggaatgaaataaagacaaacaagaaattaatggtgccgacggtggtgatgttagctcacagctaagctgcagaaccagaaacatgcggtgatgggctgagtctcctccaccagctgggggcagcagagctgcagccaggagctttcaggagagaggctggggctgcccagctggggcaaagagaaggccagcctggggttcaacaggtgtccaagaatctgtcttcagactgaaagtgagtgcagttcatcctatcccctcaggcttcagtgaccacgctctgagggtcagacacacggtgtcaccccaggacactgacagaagcctggcacagtgaaggcctcaccagggaaatgcagctggaggaggctgggcccagatgtgagcttgggcagcttcctcaggaaggggaatccctgggaggcgtcccaaggtcgaggtgctctaggagggggtatagtgtgaggtgatggggctcccagggcccgggttcttcacccaggatggcggcctgagcctcctgccactctcagggtgtcatccctcctggtccagcagtgtcctggggagctgagccctctgtcctgggcacttccagatacacccgacccctcctccctctgcctttccttccagctccaggcggactctgactcagggggcagctcctgtactcaggggagtctcgggtgggtgtggtggggcatttgggaccctggccctggatgggcatccccagcctccttcaggagacactcttcagagggacagggcttctcacctgcctcaggccacagctctgaccatggtgctgtccacgctcagtgacaggacactgagcaggggcctggctggagtaaccagggaccacccaatctctggagctcacatgctgtgcagagaccatgaccctgggacccttacagagaccatggacctaacgttagattctcagtccagtgtggttttctgctgctttttgcaagtttacataaaatattgatgagaaaaacatgaataaataacagacaagttgacggtgctgattgctaatctcttgtggcaatgaggggtgatgtagcaggagcagcaccacgactgaaatgagaccagatgccatgttgactccacaggggtgtgtggttgcttaaatgacccaaatattcccactgaataatcagcaagtgtcctaatgacacagcacagcatttagatgaaatgaacaagaggggactgagtctgagggaccaggaggaggaagatcatgggtccctgggccacctgctgctgagtcaggtgtcatcatgatctctccacagagcccagctcagccccatggccaacctcctggaaggtccacagctctgctgagcctggcccaggacagaccccaggtcagcgaggtttgggacagtggtcatgaggttaattcccacaaaggtctatgatcacagggcttgaaggctgcagctgattttctaaccagagaccctgcttgttcctcctgttgcctgtgctgccctcacagctggtttgagagacatctctccaggaagagccacagaggatgtaaatttgcataaacgcttaacactgactgcccccgaaagcctgagagggaataagagaggcctgcggagcccaactgttctgtgggtccaggaggcacagctctgggaatctcaccatggcctggatccctctcctgctccccctcctcactctctgcacaggtgctgaccccaggcccttccccaggctcagtccccacagattccaagttgagcctgacctgaatcctgagcaaagcccagacacagcctctgggtgggactcctggaaatgggtcctttgtcttcaagccccctctcttgttcttccttgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtacttatcccacagtgacacaaggagacagggaagtgaaacataaacccctccccctctatttcatccccttccttctgccccaggaggactgtggacaaagccatgagcaggcttggccaaattcacccaaatttgaacccccaggctgcccttccctccagccctccaggcaggcgctgcaaaggagtcagtctgcagtggatttgtgcctggcaggcctggcagtcctgtgtttctttgcctggggtttgagttgttgatggagggtctgactggaaagacagacacagggagacatccatgcaggcatgtccagagggatgtggggaactctcaggtctcagttcagtgcagtcattgttgtatcctctgggaaagcattcctccagtgcacctaagacctctagacccacagagcctgaggtcgggatgagagaatgtcaaatttttgctgatggatcactaaaggcatttttgagtggagccactacaatttactccttgattctggactcgtggatcctgactgtgggagaaacagcaccatctattgggcactgatgcacagcacatgccccatcctggaagacattgcccaaccctacacatacttgccacttgcctggtgcagtaatggagtctccatgcagtcattaaaccattcatataagccacatgtctcagaatgttggggacaagagtaagaatcttgaatgccaggagaaaaggcccatagccctttatttgcggtgaaacgagttccttggtcagaacctcctgtggaataccatcgtgatgggtgcatcattctgtaatccagagataacagttttggcagaagcattgctgtcaatgaaagcaaatcctctgtacatgccaatgctagtaaggaaaaagagctgtctctcccatgatggaagagctctaatgaaattaatatcaagcaggcccctggctgttttccacagagaaggtcatcctatagggatgcctgtgttggtctctgctgttgacagattgtcacccagcagtggcttcagccaggccagctccagttagtggaaattcacattgatgagcccattatcagcctctatccctgccaccatggccacatttttttggagtctgttggacaatgacaggagtggttgacggaggctgcctggtgtccatagaacaggtcaccctactcacctgattagcaaaatcacttcattttcacagaagacttagtgagtatttatatatggaaaaaaattctcatgctttttgcccactggaggaggtctactcacacatctctccccctgacatatttgtgatcagtattcctgttgtatctctcccaagttcctgaacatccttgaccatattccaggaccctgagtcacagcccatgaattaggaacctctgcccatctctttgcaggtgacatgagccaattacactgcttaaaattctgctttaaggagaatgttcttccaccactgctgttcagggattctcagaggccaggtggagtactagcaccgttcacaccagtggtggatgcatgtcctgcagaaacatctgtaaccccagcctaattgcctcctactaggcagctgatctcagggagccactctggaggccaaggctgtagggtgagaggaaggcatggtgcagggcttgggtcatgtctgtttggccaactcttcacgcaacttacttggccctcgtaacctaatccctcaagtcacaaatacatccctgccgtgtgattggggagctgcctaaaatggccacccgggactgtgtttcagacgaaatccagcatatcagcaacttgagtctcgtggtgagctctgtggccacaatcacacagagcctctgccaaggctcaggagccctcgcagtctttctcaaatggtgttttctgctcattcaaaacaaaataagtaggggggggggctgctcacgtgcttccagtctgggacactaggaccacctaaaccacacccacgatcttgtctgattattttgattccttgttggctcagttatgcattatggcaaccaaaccacagtgtcattggccataaaatgccaatccttggtccccacctaccctgggatcccctcaaccacatcttgctacccagttaaggtttcagcaacactgagaaaaatgtatttttatattgagagaggaaacattctttcaattgtgaaaaatttataaggcaggaatgtgaaaatattttaaaagacattttacaaagggtgaaagaccctccattaaaccactcaatatatgacactgtaattggcctcccaaaccctgacttcagctctgggttgggaccttctgtaaaggggcctttcatcctcaagccctcctctcctctcctctcctctcctctcctctcctctcctctcctctcctctcctctgctctcctctcctctcagcctgtgcctcctacatacagagacagctgctctcagtcttggtggccctgagactgacaaccatgatcacatgctctggagataaactcaggataaacatacacttaggaaccagcagatgccaggccaggcctcggtgcttgtaatctggtataacagcaagtgaccctcagggacctctgcccaattcttaggctccaaatcaaggaacatggccaccatgaccattagtggggcccaggcccgcgacaaggctgactattactatactgcagataataacagtgggagcagctggcagggactcatagtaacacagagagatagggactagccacagtactgtcccacctcggcctgcctctcattctcacctgccctctgagcagctataggtcaggcctcagggtcaggtgtcctctctggtcttaacctggcccctgaggggctggaggttctgagcagcttctccatcctctcagggcctgcatgtgtccaatgagaagtggacagggtgaaggtggtcagagctgccaggacctttgtcaggtttgtggtgtacatgaacagtttaggaatccacacaaaagcacatggtcccagttgtaatcatacgtcatgcaggggaggagagagctgtcgcagagggcacagtcctgcagaatttctcctttccttgggtaaaaccagctcagtggaagccccaggggctgtgtctcctctggtttccagatgagttgacccccacattctaataggttgcctgatgcctgacaaggactggagacccagccccttttggcctcagggccctttctgtactgatatttctcagaaactgaagaggaagcacagacactacctttggtcccacctgggaactgtgtttggggcacactgacctcccatggcccccaaagtcccatcaccttccccaggtaggtcagtcctgactggatgtgcccccagcgccctgatagtttggagtttatctttgggctctgggctgctttctgaggagctcactaagaaacccttgatgccaggcccaggacctgcgcctctgctgcatgtcccagggctgcaggtgtgaagggagggtcctgctgggtgagggtgatgcccttttccaggagagatgtctgattccagtctctagggccacatttattgggctttcttttctcactaggatgtctcagtctttttatttccttctttaaaagtacaactggtttagggtgacctgctcgggtccccttccacattgtagaagctttgttatttcactcttcacaaaaaatctcgctgctgctcactctttgggtccatgccaccttaaaaaaaaagtacaactggtttaatcatgaaatcatgtgtacacactgaagtttacagattattgccatcagcatatatatatatatatatatatatatatatatatatatactgtttctggttgggacaactgtggacaaggccatactggggtctctgtctctctcgttatcacaagtgaggatactaacagctctcttttatgcagactgtggtcatgtttcccagttgcacacgaatgtctcttatggttgtttagtttccttaccagccaagacccttaagttttcatgcagacaattggatgttatttctctctgacccaacatttttcaaacagtattccttggaacccaacaaaagttccacaagaaaagctcaagtctctggtgcacagttggaccaggttcattgtgtgcagtaggaccttgctcaagtgatgggtccatttgatattttcactatcaaggggaagggtgttacgacttttgggcactgagttgatagagggaagatagcagctgatgatggccctacccaccaatgtgtgtgtgggcagtacctattgatggatttagaagttgagggaactgtttattctgcagatggaatttccagtactgaatctccagcacccagccactagcattcagcaggtgctctgtaagaagaccttcactgccaatcacagccattacacaggtgaaggagaggatgacttttaacagccactgactcacagtaaactgaggtagaaattcagcttcacaaagtgactttgagggaacagactgaggaagcaggttaattattcgctgaaggctttgcccagagcaggaacaatacagggttgatgaggacgtagggatgccctggtgtggaaggaacaaggcctgaaccaggagcaggaagaagcatgggaaagaccacgctgccacatgtgatgagtcagcacatggaaggcacagcaaatgttgcgcaaaggtttttgtgtaataacctggcaaacagctgcttctctatccagattcatgagccaaaaaatgttactgatgcattgctgtcacatgttaaaatgctgggaagcatggtgacattcaaggaaacctgttctctgcaaacacctacccaccggcacaggagacaccccagctatgccaagggctttgtcttcctctggagtaagagcctgggaacaatcaggtggcccctgaaaggggtgccgcgtcttctgctctgcatggctgagttaattggggaactcccagagaacattccagaaaacagtcaacctgtctgtgctgggtgcattgagcatgacccaggatcaatggaagagacagaagcttaatttccttatggctgcaaggtgagcactgggaggacggctgaggcaggttagccaccgcccctgagtggcttcagccccaggcaaacagggacaggtgaagggcctatctgagcgcacctgtatctaaccagtcccagcatcagcaactgcatcctgtggaccacgagggggtgtgtgtgcccagcccctcacagatcacctgagcataaacaggaaattctccaccttacacccgactgcacaacacatctgcctccagctcttcatttacaaggtgatatcacatcagacagggactgatctgggtcccagatccctcaggtttccgctatcctttccagtccccacacagagcagactcttcactgcagggtgttgagccagctcttcccctcacaatgcctgttacaggtttacaagttactgttctccaatatgattggggtttgtttcactgtttctctatatatatatatttgcattttcttgggtaagctgagccccttgtacctggtcttgagtcaggcaggggccacacagagaagaggacttcctcccctggcaccagccgtccacagatcagggcatcaaggacctgagcagcaggttctgaatccacacctagaccccggaagtccctgagctcccagccgacagtgtggagcagccaccagggggaagcagagaatcaactggcaaagcgacctggggatggggcaggcctgggtgatagggagatgctgacatgcagtaagagccagtgaccaccacctcagatttagagggaaagggtctttattgtcctagagtattgtccttgacactgatgtaaaaattctagaatcacattttgtcttcagctcttttgcatgctgactctttgtctgacacagatccaggcacttgacttctcacaacgccccctcctccacacccagttgtgctaaaactgcatccccctcatgtgcagtgtcctctctgaggtcacaggtatccccctactcccatttgatctgggaacccctgtcctgcagacatagtggctggcttctaacttcctagctgcccctccacatccaccgtccctggtctttcccgactctctcctggggaagctgccaaatcacagctcttgatttcctggtgagtcacaaaatagttgctcattaacctttagttgacttaagttcttatccattgatacattttccccagcaactggagacatcatatttataataaacattcacttctggggatcttggagtttgcagccccctctcattctctcatggagcaaacatttccttcacctcctcatctgtccctggtcctgacagcatcctggagatactgaggcacagcagcaatgacctacctagaagctcacagccaaggcagaaacttccagcatctcatggatcttccaacactctgtgcgcacttggcaaataaggaatttcattgacctctatcactcagaggttgtgggctgtggtgggacccgcacctgtccaaggtgtgcattatcacctgtacagtggagacgaagagggaacttgcattgggttctggaaagtactgtctaaaaatagatttagacctacaccagaaatgtcctctctaacataaaatatttatgataggacacattagaggcctagaccaaaatgaaatacctccctccagagccaagatagaatggaggaggggactggggaccccagataattccacagttaccagcatgactctatggtcacctcccagaccaggtcaaaacccatcccataggagggacttcatattcctttgtaaatacagacaaagtcacctctgagctctgctgtgaccaagggagcccaggagtgaggctgagcacagtgtgatgtggggatgtgtgcagagaatatggaatcaattcataaaggagatcctgtgggcaaagggtgggagggcaaggtcacccctaacctctttgggtcccttggggctgtgcccttctcgaaatcacaaggctcctccagcagcagcccctgactctgctgattggcatcatggacccttctctccaacaaggggttgagagacctgggaggagcctgcccagcctcagacttgagaagcagcattggaggcacttcagccatggcctggcccctcttttccttggtctcctgactcactgcacaggtgctgcccccagggtctcacccacctgcccagccccaggcctccaggttcagcctggccgtcagtctgagctcagcagggccctgtgtgtggtgggcaggatgctcgtgaccctgctgcagggggaggggctggttggggtgaaatgcccccactctgtgctcctgtgctcataggtgccctgagagctcttttattcctggggctcactccagccctggcaagtagccagatatccttgggttgagaccctcagtttcaagttttttctgtccccttttctttccttgtaggctctgtcacctatgagctgacacagtcaccctcagcgtcagtggccccaggacagatgaccaggatcacctgtggggaaagcagtattggaagtaaaagtgctcaatggtaccagcagaagccagccaggcccgtgtgtgggtcatctatggggatagcgggcggccttcagggatctctgagagattctctggctccaacttggggaacgtggccaccctgaccatcaacaggacccagggtggggacaaggctattactgtaagatgtgggacattagcactcctcatcccacagtgacacagggagatgaaggagcaaaacacaaaaacctcttccattggtgtcactcttgtcctccagcccaggaagacagtggacaaagccatgagtgtgtgttgcccagttaacctggatgtgagacccccaggctgccctttccacaggccctccaggcaggctctgcagagggggcatcaagagtgaatttagggctgagatgaccaggatatattgaggtgtggaggaatcagttgtgatttggggaagtggggcctggttggaagatcagaccaaggtcgacatgcttagttgggctctggatttccatagggggtgaaggctagtccttgggctgaatatcctgagtcagtttccagaactgcccagctcacgttcccgtggcatcctgccattctcttcaggaaaaccagtggagtggacactgtgggatccacccatattccctcttctgagctcacccacccagcactgctggtagctctggcagctcagagctgtgccctcactgagaagggctgtcagcagagaaaactgtctcctccaggtttatgccccttcttagcaaggtgtggtttcataactgcctgaggtgaagctctcaagactccctttcaatatgggagaaacagaaaatcctcccagcttcacagctccttattgggatggtagaagactcaatgtgggtcagagtgtccttgtgcccggtgttgcctccctcacttagtttcacacctactgtgaaagcaaagctccatctcagagtctgcttccaggcatcccaaaataacataaccagtcatcccgaacgtgagccatcaggaacctcaggaggccacagtataccagaaagcaccagtttattcctaatgatcattgtgagtttgcaaatgcccaatgagatctgagtgtttcttgcatttgtatggaatgaaaagggccctggcatgccaggcactgtggggtctgagggagagttggagtcagatctccctgcagggaaacctggggcaggaggagcagcctcatcccatgcagggaccacagatgcacctgcagggtgagctgcaggatggacactgcccacctccaccctccacattctgtgcaaaaaatcattctttccacccctccttcagcctatcaaagttgacacttaaaaagccaccacagcccacccttgtcaacaggaaacccattcacatctccatcagccacacaatctccacataaagattcttcaaaaaataataacacttgccatgcaaagtatatatataagatgtctcaaataattgtacttagattgcatatgaaagtgatactattttgatatgctaggtaaataaagtaaattatttaactcatttacttcttccctttgtatttttaatgcgatgactagacattcagatttccatgaggctcacatcatattgtgaatgaacagtgctggtctgcaccccttcaggttacagtggctgaggagtgacctggtgcaggaagccccatctccatccataggacattggtgtgaacccagggagaggcgctggtgtaagagagatgagaacacaggtgtgaaccacctgcttgtgcaggggactgagccttcactttgagccaaacaagcttcttttcctatcttcaatcctgagcaagaggactttccggacttctttttgttttcaggtttgtgcccctccaggcctgaggctgtctggatcccagccaggggacacagaggaaatccagaagtctcacaccgaccctgttgtatttcatctgctggggccatcccaaactgctgcgtaccatttcctttcctggtgctcaaatagctgctctatgcacttgtcatggtttcagagatgactctaggtgggaagacaggataatgtatgttattatatttaaaaggaacttaaattcattaatatttattttaatatgaatcattaaaaaaatttgtcataggcaatggggaaggaggaaaagatattaaaattattttgaggaaaaaaccaaaattgtatttctcgaatgtctgagtgtcttcagtgtctcagggttgacagcggtcagctttaggttgtcctgaggatgtactccattgggggaaagcaagaaagcatgaaacacacatctctgtgacctgacacataaatcacagtaaaatggaagtaaatcttttaataaatcaaacactcacaataaatatcactctggtgaacacagaaatgcctgttaacaaactttccctttcccctgctggctcatatccccatggatcacctgtgtgcagagtggactctgtggtccccatttctcaggctgagaaccagaggctgggaaggacaagtcacctgcttgtgagtggcaggggaaggattgggagcagtggactcggtctcaggactgcggccctcaggaccaatgccacctagcagaggtttccacggggcgggctgccccatttcctgacagtagggacaacctggaggtgggtgccaagcagagggcactgcagggtgtgcccaggcctggagggtcacagagacacaggcaccacacagcagagacactgagggccagaagatcactcaggtaagggacttcagcagatctttctcctgagcaaatcaggtacaaaaaaattaagatcctgccatcagaatagataaacaaggactttaatctcagctgagctccactatccaaggaagcagaagcctctgagcccaggcccaggtgagggtggggtgaagggaggagctcaaggtggagatttgcatgcaggccccaccctcctctttggcagaggagataagacagggctgggggcaggcccagtgctggggtctcaggaggcagcgctctcaggacatctccaccatggcctgggctctgctgctcctcaccctcctcactcagggcacaggtgacgcctccagggaaggggcttcagggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctccacagtggtccaagttcctggggaactgagaccaaaacctgccctgggctctcaggccccctccttgctctgaagatgcttcctcacccagtgcaagcggcttcctgcagtgcggccttgagaattcttctctctcagctccttccctttccaccatgaattccaaaaggaaacccgctctgtggtttctcatccaggacagggacagcttcctgatgcttgtgtgccgtggtccctgaatgtgcaactcttgttagctcttcaaatgcagggacagtgacaaggagcttcctgattgatgcagtcactgcttttttcagggatgtcttcaccctacatgcatcaccatctcccacactgtgggtagaattttagcaactacattctgatggttatcgccacaactttgatcttaaataacaatgcagcgaacatccctgtgcagcctcctttgagttcctgtgtgaatatgaccacaggattcatttctaaaagtgaaattgagggtcagaaagatgtgtgtgtgtaattttcacccgttgttgtcagattcccctccagagggattctaccaattttcaatgccagccggaagtacttgttcagagtacattgttgaaagtggaagtttttgccaacctgtcagactcaaaaatgatacctgttatggttttatttttgagtctcctgttctgcttaagtttgggccttttcagaaatagttcagtactttttcttttttaggatttgggaaactttttcttaaatatccagataagaagaattttaatcttcgtggccggacaccgtggctcacgcctgtaatcccaagtgtgttggaagggtaggatgggtcaattgcttgctcccaggagttgagattagtccgggccacacagtgaactctcatctctattaaattaaagaacataaaaataaattttaaaaggaagtattttagtctttgtggctcaagaatcaactttggggatattccataggtatgtatagcatcatttacaatgtaaccatttaaaatgataaaagccactgtcagctctaggccatacaaaaacaggtgtcaggccagggatggccacaggatgtggttgaacagtccctggtttgtagggttatctgagggttgaaaattccaccagaatatgatctaggtgggaatctctctgtgagggtcactgtatttcacctcctgtattagcctgaggtctttcattggataagaacatgctcacatcatctatttgattgtatcatgggtttaagacaaccccgtgtcacaatcacataacatttatctgcattgcttgctccgagttttgggagagctttaatttatcaggaatagactcctcctaaggcaaaagtctgagagagagggatgggcatgtgggcaagatagtttgtaccaaagctggaatatccagggcaggctcagagagaaggttactaatatcagcatttgactgcagccaaaaacagaagagaacatggaggttctgagaatgacaaataaacaaatagtttaagttttaaatgtattgaatgtttttataatccatgaaaattctagaacagaatttaacaatgggataaggaagagagcttgagatgttaaaactataaagaccccaagccaagctgccaggaaaagaacaggatctttttggtggaaatatgtttctgctgcaaattattattttatgtgtgtgtgtgtgtgtgtgtgtgtgtgtgtgtgtgtgtgtgtgtgtgtgtaaggaaacctcccatggaacatccttcttccctacagtcaagatcaccctcaccctacaagggaacctaaacaaaatgtcaatatcaaatagaaaaaaataatgcactttgtataaccattagagagtctctatttgcacatcaaaatgtggatgcttaacgttaacattggaaatagtattttaatatgcatatgagatgaattttctttagactatttttgtgaattatctttcttaataaggacatactcttctcttagaacaatttaacttgtgatattttttctattttctgtatcagttctgttttttctaaacactggcaaagatatcctatggctactgattaataaattagattaatgtgtatttaacttaggtaagttagttcaagagtggacagatgtgatttccccacatatcctatggctactgattaataaattcaattaatgggtatttaacttaggtaagttagttcaagagtggacagatgtgatttccccacatatcctatggctactgattaataaattcaattaatgggtatttaacttaggtaagttagttcaagagtggacagatgtgatttctccacatatacctcacagatgttgctggtgcttactcactcttctcttctaatcttagcaaataaagtgggaaatttgacattcctaaacacccagatgacaacaggagagaggaggtgaagccccaaagctgttattctttaaatcctcaggatgaatcaccctggagaatcacccacacttcagttggatgatacgcaaatgagagtttggtcttagagtggtgctgagttagttcaggatttgggtcactgggatggggtgaatgtgttttacaagtgaaaaatacatgagttttggggtctgcagggtagagagttcttggctgaattgtgtcccccagatctgggttgagtgacatcccaccaagaggagtccaggagaagtaaatttgtgtaaacaccaaacatgcactgccccactaggcctgagaggaaataagcgaggcctgggaagcccacctgtgctttgggttcaggaggcagagctctgggtgtcttaccatggcctggaccccctctctgcctctccttcctcaccctctacaaaggtgatgcccccaaccctgccttaggctcagcccttacaggatcctgagctggtcctgccctgaaccctgagctcagcctaggcatagcctcagggtgacaccactggaaatgtgtttgttatcttcaagccccctctcctttcctctcctgcaggctctgtggcctcctatgagctgacacagccacccgcggtgtcagtgtccccaggacagacagccaggatcagctgctctggagatgtactgagggataattatgctgactggtacccgcaaaagccaggccaggcccctgtgctggtgatatataaagatggtgagcggccctctggaatccctgagcgattctctgggtccacctcagggaacacaaccgccctgaccattagcagggtcctgaccaaaggcggggctgactattactgtttttctggtgattagaacaatctcacagtgacacaggcagatggggaagtgagacacaaatccatttttcatctgtctcatcttttcctccagcaccaggatgactgtgggccaagccatgagcaggtctggccaagttctactggatatgagacctccaggccatccttttgttcagccctacaggttggtgctgcagagggtagagcaggagtggatttagggctgctataatcagaattttcttgtgttttcaggcccctgaagtgacttggggaaataagaacgggatggaagatgagagagatgtagagaacaatcacttggccttagatttccatacgatggtgattgggtcactccttccaaatatcttacatcagtccccaaaaatgcccagctcagctcaacacctgagcttccaggcttccatggcagcctgggattttgaacaggaaaagcagaggaacaggaaaagcactgtggcatctgcctagatatgcttttctgagctcacccaccctcaactgctgggagcttctagaagcttagagctgtgccctcacaggaaagtgctattgtttccagaaaacttcctttctcatatttaggctcagttttgagagttttggtttgatgactgcctgagccaagaacccaaggccccgccttaatacaggatgacactgaaaggccttccagctccagacctcccattgtggatgcctgaggcctcagttgcaatcttatgatgggtcagggtctccttctggtgggtgatgcttctctcactcctttcagattctctgtgcatgaaaatgtttatctcaaagtctactttcagggaacccaaactaagacggccagctgtcaccaaaatgagccaccatagacctgaggtggccactataccctggaatgcatcagcgaatttcctaaatttccactgtgagcatccaaatgcccaacgatttctgagagatccttgtattcttataaaatgaaaagggatcctgaaatgccaggtgctctgagtcctgaaggagaggtggaggcagatcttcctgcaaggattccacggaaaagggagcagcctcactccatgcagggaccagagatgctcccacgggggcagctgtaggatggatgctgcccacctccatcctgcacatcctgcacaaacaatcactctttcacccctccttcagcttatcaaagttgacacttacgaagccagcacagctcatccttgtcagactccttcaaacctccatcaaccacacaatctcaacataaagaatctccccaaaataataatagtaacaaaataataataataataaaataatagtaacaaaatagtaatagtaatagtaatagattttcaggcacagaaatagtaatatagtagctatgaaaacttctataaaaatctcataaataattttagattgtgtgcatgtgtaaatattatttttcacactttgtgttaaataaagtatattattgaacctagtttacctttttattttttatgtctactatggtgactagacaataggattcacatgagactcacatcatgttgtgattgtacaatgctgatctggtcttaccccttcacatgacaggtgctttggagtaacctgcttcagcaagccccatctccacccataggacatatgtgtgaagccacggagaggcactggtggaagagaaataagaatatgggtgtggaccagctgtttatgcaggtgactgagtgctggagccctgaccctgctctaacctagatgtgtcacatccatctcaccagagaccactcctggcctgcctgagctcacaactggggggaaatcgcatttctggcaacatggtcacttgatgtccagtgttatcctgtctctcccagggcccagtaagacaaaagaagctgtttttagaaaggggagtaacactctactgcacatgacatggccttcttccaaaaacccaggagtctacattgggattctccaacggggtttgccatgtgcaggaggttttatttcccatggtggagtctgctggattctctggccccaacagcaggacactcacaaccctgcctgcacctgctgcagagccttcctgctctgggcctggaaaacaatgggtgacatttatggctcctgatacatggattggagtcacatccccagtagtaaaatatgctactcctagatcttataggccttgtgtctctttcttcctggggaaaattgaaggttataataacatcttttttttttttttttttttttaagatggagtctcgctctgtagcccaggctggagtgcagtggcccgatcttggctcactgcaagctccacctcccagattcacaccgttctcctgcctcagcctccctagtagctgggactacaggcacgcgccaccgcacccggctaatttttttgtatttttttattttagtagagatgagttttcaccgtgttagccaggatggtctcaatctcctgacctcgtgatctgcccgcttcggcctcccaaagtgctgggattacaggtgtgagccaccgcgctcggccataacgtgttgtttattttgtaggagactctcagctgctccagacaactaaagtcccaatttcagctaatatggaggaggaaacatctttgtttatttcccactctcaaaagtgcatggatctcacaaaagcttccaataggccgtgcccatcatgtacatgtgattgaactatgatatccagatggtctgagcccccatgatgatatcatgatagggaagggagagctaatgaagctgggcagaaaaagtgtgaatgtatactgttgtccattccacgtgaatgcacactgattctgatcctattctctgaggacaatagacaagacctcagtatctgcttcagtggtttaactgtgcacctgcagccatagcattctgttccaggagatccccatctggcacagatattgctaatgccactattgcccatctgggtctgtacaaatccaaattcatcttccaggatcattcaactattgtagagatcagtccagtaaactgaaagtgaggaccccagaagtaatcacacgtactgcaggagaggagagagctgtttcagaggccacaatcctgttgaaattcctctgctccttgggaagaaacagcccagaaaaggccccaggggctgcgtctcatctgggttcctggatgaggcacaccccctactgcactgagattccacagaagctgggggtgaagtgcaaacaccgtctttggttcatccttgggattttctttttatcacacactcgtcattttgtccacaatgtccaaagtttctaaagtgctgtctaatagatagaggttctttgtgcgctgaactaaaagctcttgggttggctaatggtgatgtttgcacatttttactgtacttactgccgcttaattacacacttaaaaatgattaaaaggatgaaacattttgttatgtttattttaccataataaaaatattgcatgctcaggaagcaaagtaatactagtttaattttgaaatcacacaactggtaaaaatggaaagaaaagcaccattttctctgttctatatgctacaactcaactttctctctctctctctttctctaattaacaatgatatcctgtctggtccaaggtcacacatttccagtgttgcaggaatgtctgttgaatctgctaatttgttgccaggaagaatactcaaacttctcatgctcatatttgattgtcaactgtctccagccaacatttctaaaccaggatcctttgacaagacttgtgaagaattttgtaaaaagtaccccccaagatgacagtgttcgctgttggcagcaggactgtttccacgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctgctggacactgagtcacacagagagacagaaggtggctgaggacaccttatctctgatgagaataaggggattagatctgctggtggaacaggaagctgaagaaacttctggctctaaacatggaatttccagccctctgtctctgctgtccatgcccttctcatctgtatgttcctgggagatgtggaccacgggggtcagaggtgaaggggattgggaagctttcatgttctctctcaccatctcccttgtttatctaacacactcttacacacctactttattagagcttctgctctacaaacatggctgagctctaaattagagacttttgaaagtgcagacggatgcaggaactcgtccatctggagactttccaccacttgaagcagtgaacacatctctgcaaggctccaaatttcaagtgacaggattttgggatttcaaagaaaactaaatctttggtgaaccacgacagaagagggaaggttcacacatttccctgctgcttgggcctcagtgaggactgactcagccagtctcaggctcctggaaacctcctaggagatgtgcactaggaaagtcttttcagtacaacctggggcaggtaagtggcccttactctgatattctgctccctgataattttgctttcagagaagaacaaagacctgtgattctgggaagttcaaagcccccagacaaggtcttctcattctcccgtgacagcctgagctctgcattcccaaaaggaggagcatcttcccggcatgaagagccaggagtagagagggagcttctcccaggggtgagcagggcagaagccaccttggtcagtgggaaggaaacgtgctcagctcacatctgacccagaatgactcagtcacacccgtgcagggtcacctgcatgtgagcatcatctatttgctccatgagaaaataccttgtgtgactcttgggtaaaatcataccgtaggtgacatttctctggctattgcttcagccaatgtttttcaaaattcactgtaggacacttacataaggtaagcatgtcaggtgtgggatgtgttgaataggaaaagcacaggcttcctgtatcaatgttcatggcttgtattcatggccataactcgtggaaatggaaaaaaaaaaaaaacagaaaagaaaatgataccctgctcaaaaaagcactgagaaataccattgtagtaatatatcttcaacttataagttgagctaattgaacattaacttagatagatcatttttatggggggattcctaaacctaaaacattgtattaaaaattttgtcaggttaaaagatcattaaaaggccaatgtttgattaaaatctggagtcttttactttgggctgcaatcagccaatgagtgcatggagttggctgccctcccagaccctgactggctccacgtcgaggtagagcagcgctcccgacaggcagctggaggaactgacgaggggaagctgtttgcatcagggcctcaaaaatttggctcaggattttcccacgtcccctccccaagcccaagctggtcccaggacactcagaagagctcatcattatgggtctaaaacttctctgatctcgctcttctttcttccttccccagagaccttggaattgtcagtccctctcacaggcccttcctttccttgtcaagtgcactccctgaattatctgctcctgggtcagcaattctctagaacttcagggaaagcagtgctgggtcacccacatggggccccagaaagctggctaaggaccagacacacaggcagcaggctaggtccccacagggctgcatggttggcatcgggtagaggggagggaccaggaaccactcgctgagtgtccgtagggccaggtgaactagggaagggctggaacctggtcaaagaattgtgtactaagcaccactttctctgttctatatgctacaactcaactttctctctctctctcttctctaattaacaatgatatcctgtctggtccaaggtcacacatttccagtgttgcaggaatgtctgttgaatctgctaatttgttgctgggaagaatactcaaatttctcatgctcatatttgattgtcaactgtctccagccagcatttctaaaccaggatcctttgacaagacttgtgaagaattttgtaaaaagtagcccccaggatgtcagtgttcactgttggcagcaggactgtttccacgcagtagggctactgcaagccacacctgtccccacacagtagcatcttcctggaggtcaagagtgattttgtttgctatgctgccccagatcacctaatttattacctgtgaatttcacacactacacatcctgcctgtccccaaattcttcacttatgggcaaatgtcacatctgacctgaactggtttacatcccagatccccttcaggcttcccactgtcctttcagatcctcacacacccaagacccttctccgcagggcacagacacagctccctgcacacgcttccatcacttgtctcttcactccttcctcaaaggaactccacagactcttcttcagggaggccttctccaatcactgaagctacagcagccagccagtcagcttctgtcagaactttcaatgattagctgcatagagcttacaattacacatttgttttttctatcgttatcttttgactgatttatttctattaatcattgcattatcagtcagaaatgctttttcactacaagaacacatgtggcaggaaccagggagcttccaattttcttccacaaaaataagtctgcacgtgcttggtggttgttttccagatgctctccagttccataggaagctcaaatatttctacctctccattccctttcaatgagatgttgactttgttttcattgttgttgatgtaagacctcagcatggctgctgcagctccagctatcacacccaagttcaagagaaaaagcaaagcacaaacccaatctagtccttccttcataagaggaaaagtttcctgagaagaatctcagccatctgactcttacatcctatggaccaacgctgggctacatggtcactgctggctagaagaaactggaaatttgcctgactttcaagtgaatagaggggatgacacacaagtagaaggtggtagggagtatctgctgggtctgtaaacccaatctgcctactgcactgatccagcaacaggacaggaaactcctcagagcaaggactgtgtcttcctcatgctgaattcctaaaatgcattcttgccaggacagagtgggtcagggtgaatatttgttgggtgaatgagcttctgtctctgttgtattgcaggagtcaccaccagtgcacattggccctgtatttgtatccagaaccaatcaaagccacccctgagtcctgcatctctcagtaccaagctccagtcccccttcaagaccacccaccacacagacgtgcagggagcctcaggagggcactgtcacctccttctccacatgtgagtgtttgtatttccatcaggaatctgagcacctcgtgcccaggtttgaggcaggaaggggccacaaacagaagagaaatttcttctctgaagtcaacagtccatgaatcaaggaatcagggacctgagcagcagattctgaagctacacctgaacccaggaggcccctgagcctccagctgacagtgtagagtggccacctgggggcagcagagagtaacctggcaaaaatccctggaaagggggtggagctgggcatcagggagatgctgacatgcagggagggtcagtgaccatgacctgagacctggagggaaagaggttcctcttttcttagaatatttgtcattgacactgatgtttaaattcttctgacctcctgtctctcagatttgactcttggaaatggtgcttatttttctgatacagattcagacaatttgcctcttctcattgccctggcccccatctcactgtcacacatgccattccattctgtagtcacgcgtgtcccacctccctgcccttttctctggtagctcgtcctgcagacacaggggcttctccttccctggccactcctccacgtccactgtccccagtctttcccaacactgtcctggggaacctgccaaatcacagctcttgatttccttatgaggcacaaaatacttgctccttaatcttttgttgacttaagtttttatccattgatatattttcccagcaagtgaagacaacttagttataataaacattcacctccagggtcttggagtttgcagccccctctcattctctcacaaagccaacatttccttcacctcctgatgtgtccctggccctgacagcaccctggggatactgaggcacagcacctatgacctggcattagaactcacagccaagtagaaacttatcacatcccatggatcttccaaaactctgtgtgcacttggcaaccaagaattgcattctcctctagcactgaggggctgtgccctggggtggggcctgtactggtgcaaggcttgtgctgtcccctgtagagtgggaagtaaaaggtccctgcattgggttctggattgtgtcttcaaaatgaatttaggcctataccaaacatctcatgtctgacataaaatatttatgaccaggacatttctagagaagcagaagaaagttaaccacctccctcctgagccaggatggaatggaggaggggactgtggaccccagataattcccccatcaccactgtgactctggtaacctcttgaacagggccaaccactatcccataggaaggactttatatcccctagaaaatacagagaaactcagctctgagtttttccatgaccaactcagcccaggggcaaaagtgggcacaatctgggtaaagatgtgaactcagaccatgggaccagtgggtggaggagaatcccatgggctgagggggtgggcaagcagtggtcaccccttttctctctctctctgtgtcccttgggactgagcccttctctggaaaccacaaagctcctccagcagcaacccctgactctgctggtttgcatcatgggctgttctctccagcaaggggataagagaggtctgggaggaacctgcctagcctgggcctcaggaagcagcatcagcagtgcctcagccatggcctggacccctctcctcctcagcctcctcgctcactgcacaggtgctctgcccagggtatcaccaacctgcccatccccagggctctgggtccagtgtggccatgactatgagctcaggagggccctgcctgtggtgggcaggatgctcatgaccctgctgcagggtgagggactggcggagctgaagtcccctcaaactctgctcagaggcttgtgagagcctgaggggctgcacctgccaggagagagtactgggttttcagttcaaaggctccatgcagagggaaagtccatgggccactggggctagggctgattgcaggggataccctgagggttcacagactctctgaagcttttccaggacagcagggcaggggatttcatacggatcttttacctaaaagccatcctctcctttttttttttttttaatctttgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgatcatcccacggtgacacaggcagatggggaagtgagacaaaaacaccctcccagcctcggtcaccctcttgctccagccccgggaggcctatggatagagccatgagtgaatctggtccagttcacctggatctgagcctcccaggccgcccttccctccagccccctccaggagtctctatagagcatacatcaggcatacacatggcctggaaggaccagaatcatctaatgacttggggctgtcgtgtgagttagagaatgagggcctgggtggaaagacagacagaagcaacctctgtcctctgtcttacccctggatggtaatggggtggggatgaggccagtccttagaccagctatctggctcagtccccagaaccaaccctgctgaggtcctggcccccaggctgtgtggcagtctgtgattcccaacagaccaaaccagaggaggggacactgtgaagtctgcccaggtcccctcttcaatgtgacccacctagcactgctgagaagcccagcagctcagagctgtgcccacaatgggaagcgctgttggttgcagaaagcttcctcaagtttatgtcctttctcagatggttttggtttaatcaaccaagatctcaagtccctgccttaatgtaagatgccactgaatgaagggcctcccagctccagagctccctgtgtggacggacacctgaggcctcagtggcaaccccattatgagtcagggtctccttctgcccactgttgcctccctcactctcttccaaatcttctgtgcatggaaatcattgcagtcaccttccagggaaccccatctaagatggccagctgtccccaacatgggctgtcagcgacccgaggagtccactatccactgaaaattctggtttctgtcctaaattttcagagtacatgttcaaatggccaatctgatggttccttgaatttttatggaatgaaaagggagcctgacatgctctaggttgagagatagttggagtcagatctccctgcagggaaacctggggcaggcagagcatcctcgccccacgcagggaccacagatgcacccacagggtgagctgcaggatggacactgcccatctccgccttccacatcttctccaaatgtcacccctttctacaaccccaacccaaatcattgatctccagaaaaataacagtaacaatagccatgaaaatctatgtaattcatctcataatttcatgttaacatgtgaaaatgatagtattttgctttattgacataaataaaatatactatttatccaattttatttgtcttatatttttatatttaatgtggtgaccagacactaggggtcacaggaggatcgtgtcatactgttatgggacagagctggtcaggactctttcaggtgacaggtgctgttgagtaacctggtgcaggaagccccatctccaccagacccaggtgtgaacccaggaagaggcgctggaacaatggagaggagaacctgcttctgcggaatacagtgcccttgagccctgcccctgctccatcctacgtgtgccacctccatctcaatgtggatcatttcttgccctgcctgaggtcatgactgaggggatctggcaggtctggctgtgtggccactgctgtctcatgtggttctggttgtaacaaagcccaggaacatagaagaggctgttttcaaaaggtaaataataatctactgcacatgacatagacttgttgctaaatcccatgggtctacagtaggattctcctgttgaggtttgccttaagcagaaggtttcagttcctttgtccagttcctctattatgatagggtctgcagtttctctggcccaatagcaggacactcacacccccgcctgcacctgctgcagagcctttctgctcttggccccaaaacaacgggtgacacagttctcagacccatgatttatggtgtcagtattcaggcctcgggggtccctgacggcttctctggctccaagtctggaaacacagcctccatgaccatctctgggttccaggctgaggatgaggctgattattactgcagctcacataggagaggtggcactttccacagtggtccaggttcatggggaattgagacccaaacctgccctgggctctcagcctctctcttgttctgaagatgcttcctcaccctgtgcaagtggcttcttgcagcaccaccttgagaatttcccctctcccagctcctctcctttctcaccaggaagtccaaaaggaaacctgctctgtgatttctcatccaggacagtgacagcttcctgttgcttgtgtgttgtggtccatgaatgtgcaactcttcctagctcttcaaatgcaggcacatagtgagaaaagctgcctgactcatgaagtcattgctgtttttaggggcgccctcaccctaaatgcatcctcatctcccacgctgtgcaggccaatctgcacagaagtcattacagggagtttcaagaaattgcaccttagtcaactctgtgtccactatgctctcgtgaagatggccctcctggctgggctattcctctgtacctctgtcctgaagcagtgaccactgtgagagctgagcatgtttttgagggattaagaaccagaggaagctgttgtttttcattattattattattattattattattattattttgagacagagtctcgctctgtcaccaggctggagtgcagtggcacaatcttggctcaccgtaacttcagcttcccaggttcaagcaattctccctgccttagactcctcagtagctgggattacaggtgcccaccaccatgcctggctaatttttgtatatttggtagaaacggggtttcgtcatgttggccaggctggtcttgaacttctgacctcaggtgatccacccgccttggcctccgaagtggtgggaatacacacgtgcgccaccacacctggctgcgtttttcttatttttgttcctcttctttgcctcaatacctcaggttgctgagctggggagattttgagtgacagactcagtattctctcaaaatccccctctctcacatcgctgaggccctgtcctggaaactctccaaaagtggatggtctccctataggatgggagcttccaaaatggctccacagggaagagttaacctgagttcattccttcctcctcattgacatccagcatttgtaatttccatggccatcaatactactatagctgaaatcttcattaatctactaaaggtgagagtgaatttcatacatattcaaacattagtttcatccaacatttaaattttatgagtcaattggtaaacatagccatgattacatgtagtttaggcttcataaactttgattaaatggattttatttaaaacaatgtaatcattttactatatgtgtatcctacctatatcaacatgttgttacttgaaatatccacaagaaactatatttcaaaaaccaaattgtatttattgtctattgttacataaaaattgctccctaatagttagcatattaagagaacacgtgtttgtgatcttgtcactttggtgcatctggaattgagagcagcttagttttgtggttctggccctgggttggtcatgaagtcgcagccaagctgtcaggccaggctgcattcagaggccagagcaggtggccaggcccagcctgaggggcttccactgtccctaacctgtttggctgattggaaaactcagcggaaaaggagagagtgaagtgtaaggtgcctgtcctggtcccccatgtcaaagaccattccatacatgcaccatttcttattctttcctgcaacatcctaggcatagagcactgcccattcattctaaggctgtagagtattccacagtagaattttagccatgcaacctctaatggttaacaccatgattttgatcttacaaataacactgcagcaagcatccttatgccgactcctttgagttattgtgtgcatatgatcataggataaattttcagaagtggaattactgggtcaaaatgatgtgcatttgtaatgtttacccattgttttcacatgtttcaccagtttacaatgccagccctaaatattgattggaattcattggtgaaagtgcaaatttttgccaacctatcagatataaaaaagttaccttgttacacttttatttttgatttctcctattgtgcttgaagttgagcatttgctcaaatgtttcagtgctcattactttttaaaattcggtaaactttttcttaaatgtataaataagaagtattttagtctttgccacacaggagtcaactttggggatactatgtaggtactgacagcaccatctgcaatgtaaacattaaaatatataaaaaccattttaacccattaaccatccccagataatagctgatttcttattagaagtaatgcaagccagagtcagtggagttatatttagaaaatattaaatgaaaaaacttactacccaaagcaatctacaaactcaatgcaattcctttcaaaataccaatgacattattcacagaaatttaaaaaaacctctaaaattggtataaaaccaagaaagatcctgaatagccaaagcaatactgagcaaaatgaacacagctaaagatgtcacactactagaattaaaatatactacaaactatagtaaccaaaacaggaaggtaggtattggcaatcagacactgagaccaatataacagaatagacaacccagaaataaacccatctatcatatagagccaatcgattttcaacaaagatgccaagaacatacactgagaaaatggcacaattttcaataaatggttctgagaaaactggatatccatgtacggaacaatgaaactagacacttatccccctccatataaaaaatcaactaaaaatggattaaagactcaaatataagacccaggctataaaactactagaaaggaacttagagaacattggggaagaacaattctttaggacattgttctagataaaagttgtatggccaagaggcaacaacaaataatagagatatgggacatcattaaactgaaaagctcctgaaaagcaaaggaaacaatcaacagagtaaagacaatgtgtagaatgagagaaaatatttgcaaactactcacctgacaaggacctaatattcagtataagaaaagttaaaaactgaaataactcatcaacaacaacaaaaaaaactaataataccattaaatagtgggccaagaatttgaatagacttttctcaatagaagacatacaaacggccaacaggcatatgagaaaaatgttcaacatcactaatcagcgagggaattaaaatcaaaaccccagtgagatacaatctcaccctagctggaatggctatgatcaaaaagacaaaaaatacaaatgctgatgaagatatgcgacttcatatttttctagtccaattctctgggaacaatgagagtgctctctttgctctccctttagtaactatttttcacatgcaaaaatatgggccctactgggaaataatgcctaagaccaccaacaccttaactgtttgttcatcacactagaaatgaaactgttttccaaataatattaacatctatctgtgtctatcaccattgtgtcaatgtttgtgtgatcctataaagtttagaaggcctagaagaatgcccttgctttttgcaatacaaaaatggcctaacagatatagatgacatagatatagatatagatatagatgatatagatatagatatagatgatatagatatagatatagatagatagggggttgtatcttggaatttgtttctctaagggacttatttcacatctaatttgaaattattctggttttaaacattatagaatgataacacaattggtgaaccaatcattctgtgttgaggttaacagtatttttttacttcaattctcactgaatgagagcagtttttatacggaggggccatgccataacaatatcacatactggggttgttctcagactgtgaggttctgcctacaccaagccaggatgagaattttatttgtcaaactgctctctccacttgtttgtatcccataatataccccaaaaatgagcataatttcattttttatgctgtttgttcttacatttaatacatgtaccaaaaagttgtctttgtttttaaaataaaattttatgctatcttttaatctatgtccctatagaaaaatcatgatccatacacatttgttatcacagaaagaacaagataaatttcctctctctctcataaatgccatgaccgctgctttttgggattatttttcttaaattattttttaaacagaaattcatataacttaccttaatcaaatttcttttcaaagtaatcacatttcttttatgtgaaaaattatttaccttcttttatcaaaaattatcttaatacaaaatatgtattgttttacttttagaagaaatggaaactatctacacattactaatctaaaaatacatgctctgggtttatatggtgttaacatgtcttccaaattttaaggaataggtatttaaatgtcatgcactttgtttttaaatttagaaaatgtttcaaccttttgcctgggcatggtggctcatgcctagaatccctgcactttgggaggccaaggtgggaagatcacctgagctcaagaccagcctgtgcaatatggcgaaaccccatctctacaaaaaatttcaaaaattggccaggcatggtggcaccacccacaatcccagctactcgagaggctaagatgggaggattgctggagccggagaagttgaggctacagaaggtaaactgttgaggctaaaacatggtaaatatttaattgttcacttaaaagaaatgttggttacattgaaaagaaatttggttaacgtaagttagataaatatctgcttaaaaaataatttaagcgagctgttagcactactgcattccagcctggtcaacagagcaaaatctgttgaaagaaagaaaaagaaggagagaagggaagggaagagggaagggaaaggggaaggggaagaggaagacagaggtggagggggaggggtggaggaggaagagggaaggggagagagagagagaaagagacaaagagagaaagaaagacaaagaaagaaggaaagaaagaaagaaagaaagaaagaaagaaagaaagaaagaaagaaagaagaaagagaaagaaaaagaaagaaggaaggaaggaaaaaaagaaggagaaaagaaagggacagaaaaaggaaggaacgacggggaaagaaagaaaaaaagaaaaaatatttcaagcttttcagtagcagagacacttcgtaatcaataagcaacagaaccaaaacaaaaaaaaaaatctacagaacagtctaaatacaattataaacttctgattcggatatcaaaaccatttcaataataaatatatggtatgaaaacctcacaaaggtcaagtagaatgtattatatttgaaagaaattacgagttgagagtaggaaatttataaatttaatcaaacaaataagcattatgaggaagttgtattgctaatgtattatttggcaagctgttcagtggaacaccaagatattcttaaggaagttgcaaatatctttttttttttttttttttttttgagacggagtctcgctctgtcgccccggctggagcccaccaccacgcccagctaattttttgtatttttagtagaaacagggtttcaccgtgttggccaggatggtctcgatctcctgacctcgtgatccacccgcctcggcctcccaaagtgctgggattacaggcgtgagccaccgtgcccggctgcaaatatcttttaagatgttgtcattgaagtggatttaaaagtgaggacatgaatacctttaaaaaatattcagggataaagagagaaaattaaatttagattgtatacatatataaaatgtattttaaaagatcagcttggctgggcgcggtggctcacgcctgtaatcccagcactttgggaggccgaggggggcgcggatcatgaggtcaggagatcgagaccatcctggccaacatggtgaaaccccgtctccactaaaaatacaaaaattagctgggcatggtggcgggcacctgtaatcccagctactggggagggtgaagcaggagaatcgcttgaacccaggaggcggaggctgcagtgagccgagatcgcaccactgcactccagcctggcaatagagtgagactctatcaaaaaataaaaaataaaaaaataagcttgtctctttttattccttaaataaaaggagcagacacttaaattccttgccttttattttaaaatttagaaaatgcttacagcttcccacagtgaaatttatacttagataatctaatcaatggataataatatcaaaacagaattctttgaccaatctattttcttcatttttaagtctaaatgtatactcaaagaaataaaactatttataattgattctgctgtttgaaaatatttactgatcatttaccttgcaccaactgacctccagctctgaagataggtcagtggtaaagtatacaaagttgcccagcttcgttaaacttaaattctaatgaggaaaaaagaagtaattaatcagggactttaaaacaggagtgttgtgatatggcttggaattctaattgcttcctgtgcttgctgtgtggagactggattgaaaaatagggcgatgataggagcttaaattcatacagaatatggctagcctgtattttgagggcccctgaaataagaatgtatagtagttctcattatttcctcaagaaatctctgcagtagagctttggccttgggagggaagtactatagtcaccaagtggtgagggtgggaaggtgaatttgcaaataccatttggaatgagttcactttaaaggtaaagctggcaggattttcatacatgtcagatctgaaaatctgtgtgtgcgtgtgtgtgtgtgtgatagagagagagaaagagagagaattagaacaagacagatacagacagacaatgacagagctgcagagacagagagaattaaatggggacaccaagaatattgagctgagaaactataaaatgggaggtgccattaaacagaatggggaagagcagttttggggagtgtcagtggctccacgtagacttattaattttgagattcctaaaccacatccaagtggagaagacagacagtattgtgtgtagtctagtgttatggtatcatataaaatatcaggaaatgaatgacacaaaaattagtaagaaagcaaagataagaaagataaaagtcccgagcctagtggttatctactgcctaaaaagtagtaggctgggcatggtggctcaggcctgtaattccagcactttgggaggccaagttgggcagatcacctggggttgggagttcaaggccagcctgaccaacatggagacacctcgtctctactaaaaatacaaaattagccaggcatggtggcgcatgcctgtaatactcaggaggctgaggcaagagaattgcttgaacccaggaggtggaggttgcagtgagtcgagatcgaatcattgctctccagcctgggcaaccagagcaaaacttggtctcaaacaaaaaaaaaaaagaaaagaaaagaaaagaaaagaaaaagaaaattagcaaagatgagaagaaaccagcaaaaagtactaggtataattatcaaaaatgtcaagaggaaagtaggttaagtgttctagaattctatcaaagaaagttttgaaaaaaaagagggagagatcaactgcattaaatgctgctaatacataaattaagcaaaggctgaggaattacgcttcaattcatcatttaacaatatggataccatttgtgctttgataagagcaattttcttggaatgagtaggtgagaaaccatattggagtggtttctcaaaggaatgcctgatctctgggttcttaaggaaactttttattgaacaggggaggcacaaattggattagttttaattccggggtccggacacactctaaacatgtgcctctgcatgcctcgctttttaaagctaggtatcctattatctttcgataacaaaataatcacctgcaaaaccaacacacatttaatggacacacttgtaaagtgtgtactagaggttgttggagaggatgtgattccacgtgatagcttacgagtcactgatgggcaggtaagctggtaaaatatctttggaaaactcaccatacctgttatacttaaatattcagataccaaacagcagaaaatccatattgtaatatatttccatgagaaaaaacaagagctctgtattaaaatattgattattattaaaaataatcccactgggtttcctgacttttttattagcaagtcagtctccgcctgttttcagtagtacaacctctatttaacaaatgttttgtatttttaatcagccacttagaaaaaatattatattttatatcaattctacgttcagtgccaaaaccagtgttttgtacattccacagaattatttgttgaataaataatgaataacttaaataagttatagtatccatatataaataatatatcatctccgaatacagtgataacatttgttatgtagaaaatgatttcaatctcagttaaaaatattttgggcataggagttactgtcatataaagattctcacattgttttgtttatatgaaaatgtttgcagttaacgtacatttttggtacctaaggcttttgctcttgctgccatagcaaacagtgtgcctattaagaacacgaacctgagttttatttcattttaacagatttcttaataaaatatatgccaccttatttggtttaatacataagcaaagagccatccactccaccattgccccttgtccctcctccaatgcagctccttaagatgttactgatagcagaggactttgtgttcaacctaagcactttatagcccttttattttcaactaggtatgaggtaaaataattcagcaccaataaaacaaacactctttaaacaatgaccctttttcttagcctgttcaacaaaacgcagcaagacagagtacacttctctttcccagcaaatcagtgttgccactacattctctacgttctgaaaacttgtattattgactttcttacaaacaccctttgagcttataatttagatgtcatcaaataatgtacaaaaacacgctacttcctcccccttctcttctcttcttaccagactattgtcagtttgcttttctatccaactcctttcttctgtctacttgatttttaaaagactttctacatatttactatcttggtattgtagagaccaactatgtggtcaaactacacatataggaagaactgaattatatgcaagcatttttaaataaacgattcctcctcagttttctgtgattatttcatataatcaaatgtcttccagatacacatcccaaacgagtggttgtcaagctctgctttgttgtctaattttatcagaattatccaaaattcttatgataaatacagatgaattagcataactccagatttatgaaatgaaaatttccagaacccaggaatatgcattgaaaaaatgtattcctcacgtggtgctgatgtgatatgggatctgagtttagaatccaaggaaaattaccctccttgccctctagttggccagaattacctagttgaccagagttgctctcttgttatctagaggtcctcttcccttttcacattctgctctctctccttctgtaccttcctcctctcctccctccacttctgctcatccagatcccaagcccttctccattgattctcctaaaactccaaatggtcagttgccactaaagtccctctgtcccatgaacaagatttgtgggcaaatgtagaatttaagcttggacagagctgaatcagagctgcaattaaagatttccctaaacccagcagggaccagcaaatacttatagaagattagagatttcttgtgagtgcaaagggctcagagtgacctgatgctatagaccaaatcttatggtcccctcaaattcatgtgttaaaatctaattccccatatgatgggatttggaggtgaggccttggaaggtgattagatcatgaaagcagagactgtatgaatgggatcagtgtccctatcaaagggactgctgagagctccctcatctcttctgtcatgtgaggacacagtaaaaagatggcagtctatgaacaaggaaggaagccctcatcagacacgaaacctgctgacgagttgaccttggattttaccatctccagaagcatgagaaatgaatttgtttctctgctacctagtgcagtgcattatcttttggcacccagattggctacagtaccaacatatcaacttgtacacgtaatttttgaaattctgatgccaaatctttgatggcaacaggtgattgatctgctggaggaatggactgacatgatccctctttccacaataaaccagagagtaaaaacaagcaaaagtaggtcaaggtcttctaaaagccgtacctgaaaggtttccagtaacagttgattagatggtaattcaatcacacaaacaaccacggcaaagatacacaactatcagacattttcagaatagcctctaaaacaacatctgacaacattagggagttaaagaaggcacgaactttcaaaaagtcaaactttatttaaatgttattgtagaaacttgtaattttaacactatggatgaattctagggcaggtggtggcatggcatggcgatttgggggcacaagtgctgagttttgaagcttcggttttgataccctttggagatgccccctggcctccacacccctgcccacctgtcaagaagagcctgtcctgggcagcacctcagggacaaacagcccagaagcccagttgagggcagacctccaaggttggaggaagaagccgcctctgggagcaggaggagctgctggatcccctcctcccaggtttcttttcctgccccccagcgcctcttgcaggcaggcaaacaaccccagcaggagcagcagcaggcccttcagccgcagggctgcagctctgctgaatgagagaagcctctctctggcgagtcagaggagcgcaggccatatacccgggtctctacctccatgtctcccactgtgcccaggactgagcccagcgtgggagatgcgggctggggccgtgctggccaccccctctcttccacctcttgctccagccatgctttcagctccagggctgaggccagtggctagagcagatctcatgatgtcaggtagctcctcactgggctggtccttggcaggaccaggacaggggcaggagggatctggagctgctgatagctccagttctgtccctgaaggggggtcttcccctggtgctggcactggctcatcagctggcgctggaatttcctgtgttgctgcacatggaacaggagatgaaaaagaagaaagactcaccaacgtcagtcactttccactggaattttcacacacagaatcaacctcgctgaatgtaaggtattccagcccgaaaacactgcccctgcaaaggctcatagactataggccacctcaccgtgtgcctgtgcctcgatgaactccagaggctccagctggacaagaacaatgtgcagatgtggccgcgatgggatcaccggtggggcctggcctggtagggcctgccctgggctgccctgtggtacttgggggcgcctttgcccaaatggccagaggcgcctggagtgagagatgagtgaggtattgcccctcacaagagggcattagctgcggggatccgcccacagaccctgacccaaatgacggatgaataaaacgtacactgacacagagttattctgctttgccagtcctgctgagtgtcccactgcctgcacaccaagagaggtttgtcactgcagctggccgtgaatagctcgcactgcaggcatttatttagtatagaatttacaacggaagctttgagtaaatactcttgtggataattaacatggttaagagagtagttctaccaatgattaaagctcaggtaccatggtttaaagtaaataccactgggggcaatttcccgggtctacctcccccctcctccccaagaggactatctggctcaaaggctagttaatggaagtagggtaaacagacttaactggggaagcctctattgtccctaacatttaccctatgagctaatgctctaagataagaagcagctgccttcagcctgttcaattattacaagctatgtaacctttccgccttccaaaaggtttgtgactattccctgtaactttccctaatatttccctttaatatttctgccaccatcctgagtgaatcccaatagatgagcctgcgtcagcattgtgggaaaaggctctcgctctgggccctcctgaagcaggagactcgagatgtgggaatgcagcatgagaacatcttgctctcctgagcatctcccaccaagggagctggctgcgggtctgtccctaggatgtgggtgcctgattaccagagttctaagttctgttagagtccatcaccaaggaagtgaagtcacttctttaaggttccgtaccctcggctccttccttcaaaacctactcagaaccccctgggctgctggctgctcaccctccccccaggtcagctccttacctgtacacaggtaagtccacccagtgtctgcttgtacacctgtgcctgatgtgcacctggggcctgggaatccacttagggcctgtgatccaacaggggcctaatgttgattaaaactaattttgattattcctatggagaaggaaaggccttctagcaataagaagcagagttccaaatcaaatacgtaaaaatgatcaaaaccttgtaaaagaaaagtatcttaattttaatcactgaaatgttaactttttgataaatatttaaggttataatgaaaaataaaacaatactaataaaataacagttgcaggaaatgctattgagtttcttgtttgtggtttgaacactgaaaggtcccacctagttatggtcataatttcctaccttaatcttcttgttcttatgagtaatagaaaaaaacacaatgacgatgaatgtgatgatggttcaaatacacaactgaagtttagtggcagaaacatcaggtgctcccaattacagtgcagctgttcttactgaggtgagaaaaaaaatcttgttttcaatacacacgggaagcaggagtgcacgcggatatgaccgcatttctctgaacttatgtttttcacagaagagctacagtttatcctgcattctccgttctgtgatcaaaaaccatggaacagagaagagcatttcaacctgagactcaattataagaattgcgtctgccccacctccctgcaaccatatatgccacctctctgtgctgagcctgaggggttcacatatggcacagactgaggctggactcaacagtccttaccctcgcaggtgacaggcgttctggggtcacttggaggagggaagctcctgggctctgtcttctccaccagcagggggcagcacagctgcagacagaagagaggctgaggctgcccagaaggagcctaagagggaggccagccatgaaggctcaaaaggtgtccaaggatcagtcctcaatttggaagtccagtaaagtgcatcctatcccctcgggctgcagtaactccgtcctgactgtaagactcatgcagcgtcactcagggcactgacaggagcccagggacagtgagagcctcacctgggaaatgtagctggaggcgcctgggccccggtgtcagcctggggagcttccacagggctgggattccctgggagacgccccgaggtcaaggtgctctaggagggggccacagtgtgagaggacagggtttccagggcccaagcccttcacctagtattgctgcctgagcctcctgccactctcatggtcttgtccctctctgatcagcagcattctggggagctgagccctcagtcctgggcacttccagagacctccccccgccaccccttctccctctgcctttccttccagctccaggcatactgtgactcagggggcagctcctgtgctcaggggagtctcacgtgggtggggtggtgcactcaggaccctggctccaggatgtggcatttccagcctccttgaggagatgctctccacagggaaggggattctcacctgcctcaggccagagctctggccacgaggctgtccttggctcagggacaggatacacctcattgcaggaaccaaggaccacccaccctgcagaccccacaccctgtccaaaggctgtgtccctgggatgcttacagcgaccatggggcttaaagttgaatttcccatcaatatttcatgtaaacttgcaaaaagcacaagaaaaccacactgggctgagaactctggtgctattttgctgttttttacaagtttacataaaatattgattggaaaaataaacaatggcagagctgaggatggcaatggctggtctactgtggggatggggatggcctagaagtatcagccccatgggtgaaatgagaccagacgtcctgatgactccacatgggtgagtggttccttaaatgactcaactattctcactgaaatagttaactagtgtcctaatgacacaatccatcatttagatgaaatgaccaggatgggacatttcctccagccaggaagactgtggacaaattcatgaactgggctggcccagttcacctgggtctgagaccccctggatctgagtccctccagccctccaggcaggctctgaagagggggcgtcaagagtggatttagacttaggtgaccaggatgtattggggtttgaggactcagctgtgacttagggaaatggggcctgattgaatcatcagactgaggtagacatccatcagctgggctctggatttccattggtcatgacaagccagtccttggcctgaatatcctggatcagtccccagaactgcccagctcaggctcaagtcattctctacagaaaaaccagtggagtggacactgtaggatctgcccagattctttcttctgagctcacccacccagcactgctgggagcttgtggcagctgagagctgtgcctttcctgggaagtgtggctcagcgcagaaaactgcctcctccaggtttatgcccttcctcagcaagattaggtttcatgactgcctgaggccaagttctcaagactctgcctcaatataggaggaaatgaaaatcctcccagctccacagctccctgtaggaaagactgagacctcaatgtgcgtcagggtctctttccgcccagtgttgcctccctcacatcctctgtgcatgaattcctcatctcagagtctgcttccagggaacccaaattaagatcaccagccatccccaacatgggccatgcggaacctcaggaggccactgcacactggaaagcgcccatttattcctaaattagcactgtgagtatccaaatgcccaatgagatctgagtgtttcttgcatttgtatggaatggaaagggagcctgacttgccaggtgctctgggtctgagggagagttggagtcagatctccctgcagggaaacccgggacaggaggagaagcctcaccccatgcagggaccacagatgcacccacagggtgagctgcaggatggacactgcccacagggtgagctgcaggatggacactgcccacctccaccctccatgccctgtagaaaaaatcattctttccacccctccttcagcctatcaaagttgacacttaaaaagccaccacaccccacccttgtcaacaggaaacccattcacatctccatcagccacacaatctccaagattcttcaaaaaataataacactagctatgcaaagtatatgatatatatcataaataattgtacctagattatatatgaaaatgatactttttgatatgctaggtaaataaaatatattatttaaactcattgacttcttctctttgtatttataatgcgatgactagacagtgggattcccatgaggctcacatcatattgtgattgaacaaggctggtctgcagggcttcaggttacaggggctgtggagtgacctggtgcaggaaaccccgtctccatccataggacatcagtgtgaacccagggagaggcgctggtatgagagatgagaacacaggtgtgaaccacctgcttgtgcaggggactgagccttcactttgagccaaagaagtttcttttcctatcttcaatcctgaacaagagggctttctggacttctttttgttttcagatttgtgccccttcaggtttggggctgtctggagtcccagccagaggacagtgaggaaatccaggagtctcacactgactctgttatatttcatctgctggggccatcccaaactgctgtgtaccatttcctttcctggtgctcaaatagctgctccattcacctgtcatggtttcagagatgaatctaggtgggaagacaggacagtgtatgttataatatttaaatggaagctgattccattaatatttattttaatatgaaacattaaaagaattttgttataggctatagggaaagatgaaaagagattaaaagtattttgaaaaaatgtatttatcgaatgtctgtgtgtcttcagtgttgcagggttgagagaggtcagctttaggttggatgtgctcagatgaggaaaagcaagaaagcaggaaacacgcggctctgtgacctgacacataaatcacagtaaaatggaaataaatctttcaataaatgaaacattcaaaataaacgtcactctggtgcacacagaaaggcctattagcaaactttccctttgtcctgctggctcatatccccatggatcacctgtgtgcagagtggacactgtagtccccatttctcaggctgagaactagaggctgggaaggacaagtcacctgcttgtgagtgggaggggcaggattgggagcagtggactcgggctcaggactgcggccctggtcggtgctctgtgttccctccacaggatccctcccacatgtgcccgtgtggatgtgggtgcactgcctggggtggctgatgtgctccagggattcgatggtgcagatgcttcagcacaaagcttgggggtggggatgggatgaggctgcagctggggagaccagggaccaatgccacccagcagaggtttccacggggtgggcagccccatttcctggcagtagagacagcctggaggtgggtgccaagcagagggcactgcagggtgtgcccaggcctggagggtcacaaagacacaggcaccacacagcagagtcactgaggaccagaagctcactcaggtaagggatttcagcagaactttctctcctgagcaaatcaggtacaaaaaaattaagatcctgccatcagaaaagacaaacaagaactttttatctcctcagctgagccccactgtccagggaagcagaagtctctgagcccagcccaggtgagggtggggtgaggagaggagctcagggtggagatttgcatggaggccccaccctcctctgaggcagaggggataagacagggctgggggcaggcccagtgctggggtctcaggaggcagcactctcgggacgtctccaccatggcctgggctctgctcctcctcagcctcctcactcagggcacaggtgacacctccagggaaagggtcacaggggtctctgggctgatccttggtctcctgctcctcaggctcacctgggcccagcactgactcactagagtgtgtttctccctctttccaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttccacagtggtccaagttcctggggaactgagaccaaaacccaccctgggctctcaggctcccttttgctctgaagatgcttcctcaccctgtgcaaggggcttcctgcagcacggccttgagaattcttctctctcagctcctctcctttcccaccatgaaatccaacaggaaacctgccctgtggtttctcatcccggacagggacagcttcctggtgcttgtgtgctgtggtccctgaatgtgcagctcttcccagctcttcaaatgcagggacagtgacaagcagctgcctgattggtgcagtcactgcttttttttcagagatgtcttcaccctacatgcatcaccatctcccacactgtgggtagaattttagccaaatatggctgggcgcagtggctcacacctgtaatcccagcactttgggaggccaaggctggcagatcatgaggtcaggagatcgagaccatcctggctaatacggtgaaaccccatctctattaaaaatacaaaaaattaaccgggcacggtggcgggcgcctgtagtcccagctacttgggaggctgaggcaggagaatggcatgaacccgggaggcggagcttgcagggagccaagattcgtcactgcactccagcctgggtgacagagcaagactccatctcaaaaaaaaaaaaaaaaaaaagaattttagcaactacattctaatagttatcgccacaactttgatcttaaataacagtgcagtgaacatccctatgcagcctcctttgagttcctgtgtgaatatgaccataggatacatttctaaaactgaaattgcgggtcagaaagatgtgtgtttgtaattttcacccattgttgtcagattcccctccagaggggttctaccaacttacaatgccaaccataagtatttgttcagagtacattgttgaaagtgtaaatttttgccaacctaccagactgaaaaatgttatcttgttacagttttatttttgagtctcccattctgcttaaggttgggccttttcacaaatagttcagtactctttatttttttagtatttggtaaactttttcttgaatatccaaataagaagaattttagtctttgtggcaaggcacagtgggtcatgcctgtaatcccagcagtttggaaggcttagacacgtaaattgcttgagcccaggagttcgagattagcctgggcaacatagtgaaccctcatctctattacattaaagaaaataaacataaattttaaaatgaagtattttagtctttgtggcccacgaatcaactttggggatattacataggtacttacagcaccatttataaagtaaccatttaaaatgataaaaaccactgtcagctctgggccacacaaaaacaggtgtcaggccagttctggcagggtgagggctactatggtgggaaagggaaatggaagccagtagagcttctcctacctagaaaaatagtaaatcaaaaacagtgtcatatccctggagggattgcagagattagtgccaccatcaaggacttgaaagacacagaggtggtgatcagcaccacatccctgttcaactctcccagttggcctgtgcagaagacagatggatcttggagagtgacaatggattatcataagcttaaccaaatggtgacttcaattgcagctgctgtaccagatgtggtttcattgctcaatcaaattaacacatctcctggtagctggtatgcagccattgacttggcaaatgcctttttctccattccggtccattaggcccaccagaagcaatttgccttcaactggcaaagccagcaatatacctttactgtcctacctcagagatttatcaactctccagctttgtgtcataatcttgttttttttttcttttgagacagagtctcgctctgtcaccaggctggagtgcagtggtgcaatctcagctcactgcaacctctgcctcctggattcaagcaattctcctgcctcaacctcctcagtagctggggctacacgcgcgcaccaccacgcccagctaatttttgtaattttagtagagacggggtttcaccatgttggccaggatggtcccaatctcttgacctcgtgatctgaacgcttctgcctcccaaagtgctgggattacagacctgagccaccatgcccagccctttgtgtcataatcttattcaaagagatcttgatcacttttcacttctgcaagatagcacactcgtccattacattgatgacattattggattggattcagtgagcaagaattcacaaacacaatggacttatcggtgagacatttgcatgccagagaatttgaaataaatctgactaaaattcagggaccttctacctcagtaaaatttctacgggccaagtggtgtggggcctgttgagatattccttctaaggtaaaggatacgttcctgcatttggctcctcctacaaccaagaaagaggcgcaacgcctagtgggcctatttggattttggaagcaacacattcctcatttggttgtgttactctggcccatttattgaatgaccctaaaggctgccagttttgagtgggttccagaagaagagaaagctctacaacaggtccaggctgctgtgcaagctgctctgccacttgggccatataacccagcagatccaatggtgcttgaggtgtcagtggcagatagcaatgctgtttggagcctttggcaagctcccataggtgaatcacagtgcggtcctccaggattttggagcaaggccctgccatcctctacagataactactctgcttttgagagacagctgttggcctgttactgggctttggtggtaactgaacattgactatgagtcataaagtcaccatgggacctgaactgcctgtcatgaactgggttctttctgatcaatgtagccataaaatgggtcatgcacagcagcattccatcatcaaatggaagtggtatatacatcatcaggctcgagtaggccctgaaggcacaagaaaattacatgaagaagtggctcaaatgcccatggtctccactcttcccccctgctttctctcccccagcctgcaccgatggcctcatggggagttccctatgatcagctgacagaggaagagaagactagggcctggatcacagatggttctgcaagatatgcaggcaccacctgaaagtggacagctgtagcactaaagcccctttctagaacatccctgaagaacagcggggaagggaaatcttctccgtggacagaactttgagccgtgccactgggtgtgcactttgcatggaaggattttagccaactacattctaaaggttattgccacaactttgatcttaaataacagtgcagcgaacatccctgcatccctgcatggaaggaatgccatttcccataaatcaccaaatcactcagaatgactacgcataagcccttaatatacgccagatgcattggttattgttttacaagcgggacctcaagaagactttcataatacggaataggatgatgcaaagccctatgctcaaggcccgatctttactagaaaactagtattgggaggttacatgttttccccaaacagatctttgaggaatcccgcagatgccaaagacctgctggcctaagagtagacacttattttctcacagttctgaagctggagagccaagataaaggtgtttataggtttggtttcccctgaggcctctctccttggcttgcaggttgctgcctccttgctgtgtcctcacatggtctttcctctgcacactcatttctggtgtctcacttctgcgaatgcaaatttttattagcctgggttaataatttttatatcagcctggcagattctatcactgatttacttgattatcctatttacttgattattaaactccttctctgctgaggtcacccattggtgagcactcgcatgggatacaaatatcttcacagtttttgatcactcagagggatccatccacatagctcttccccaaatttctttgtcatcaattttccaatcatgcttcttccaagtccctgatcatccaaccaaaccattggctacagcctatgaatcagtataaaattgcatatctggacatttctccttccaggcagtgctgagaaaagtggacatccacatgcagaacaatgaaactggacccatctctctccaaataaaaaatcagcccaacaaggattacaaacctaaggataagacctgaagctataaaacaactagaagggaacatagataaaattcttcaggaccttgggatacacaaaaatttttatgactaagacttcaaaagaacagacaacaaaaataaaaatagacaaatgggagtttattcaactaaaatgcttctgcaaagcaaacaacagattgaagacacccttagaatgggagaaagtattcatgtgaataggtcctaatatcctgttcatctgaaaaggcataatatccagtgtaagaatagaggacaaggctctaaaataactgattagcattaaaaaaaaaaaaagtgggcaaaggacctgaatagacttttctctaaagaagacatacaaatggcaaacaggtatgtgaaaaaatgcttaaggtgactaataatcagggaaatgctaactaaaacccaaatgagatatcatctcaccgctgctggaatgactatcatcaaaacataacaaggctaggcgcggtggctcacgcctgtaatcccagcagtttgggaggccgaggcgggcggatcaagtggtcaggagatcgagaccatcctggctaacatggtgaaaccccatctctactaaaaatacaaaaaattagctgggcatggtggtgggcacctgtagtcccagctacttgggaggctgaggcagaagaatggcatgaacccgggaggtggagcttgcagtgagccaagatcgcaccactgcactccagcctgggcgacagagcgagactccgtctcaagaaaaaacctaacaaacacccgtgacgatgaagagaaaatagaagaaaaaatcacatgactgtctcaacagtcagatcaaatgttttctttcaaggaaacatttttgttggttgttttttctagtcttgttagagcatcacgcatgataagatttgtggtacagaagttagaggggatgttgttccatgcaaaatatctgaatatcccatacccaactcttcggttacttactgataaatgctaaaaggttacaattttgtattttcaaatattctggtggccagaaacctcttccttgacaagtctggagtacaggtatctgactccagatgattagaatttaggcaggtattgtgtgagcagtgaggtcacacacaggaaacgttccagtcaaagagaaaaacagacggaggctgaaacacagagatcatatgtctgagaaataaggaaattccatactaatgggagctgagtgagaacaagatatgaaccatctatttctctctgaatatctcattgggatcttgtccctttcccagcataccactcatgtggattttaaaattgtctgctcttaaaacatttcttgcacatcattagagagtccagcactggaatcaagctcagtttgatgagaccagggcagttaagcaccaaacccaggtgttcttagaagggcttgtagaagacaaaggtgtgttgtcaaaagcagagaaagtgagactttccattgtggtttaaaccacagcttctggaatttcattgggcacacaaatcccctgaggattctggttaagatacagctgtgccctcagcacatctgggtatggccccagattctccatgtctagcagcttccaggtgaggctgatgctgctggtcctccaaggacattttgagtggcttagctcctattcaccctcctcacgcaggcacaggtaagactcacctaatgaagaaacctgagaagcacaggtgaactctccctcccctcctggtgtcttagtaccttttgtgttgctataaaggaatacctgaagctggatagtttgtaaagaaaaaaaagggtttattggggtcatgcttctgatggctggaaagatcaagattgggtatctgcgtctagtgagggcctcaggctgtctccactcatgatagaaggtgaagggaagccggtctgtgcagagatcactgggagagagaaagcaagctttttttcctaacaaagctgcagggatgtaattgagtcatattcataaagtgctcaatacagggcgtaacatattcaagtgctccttagtggacagcaattattactgaccttgctcatgaaaattagacctcagatggaggaaaggcagtgccgagggttttagattgttcgaaataagagagattaaaatgatttaaaatagaggcccaggagctgaggcaagcatccccaggtgttctcctgccaactccccccatgtctcagaagctgttttcaggcaagtcagccagggaggaaagtgggggagtttgtagaaccaaggattgcaacttcatccatgaggaggaggtgtagccagccaggtggggagaggctgctaagctcatctgaaggctgttgaaggctttctggccccatggtcctgggccatccctccctgcccagggccgcattcctcagctgacagccacaaccttgagagaggcctgtgagtctgatcagaaatcctgccagggccccgagggggcaggcatggaagggaggtgtctaaggtcacaggagacactatttgctgcctgtggggctgggacaggctccttgagaggaaattcgggcactgtacgggaggaaaacacaggacagggaggcctctccccaaaggattgtgatgatagagaccaaagcatctgcaaagagcccagccctacaggggattctctgaacacagcattcctcggggcgtctgtgttattttgccagggttaccataataaagtagcacagactggatgctcagagaaaagaaatgtcttctccactaatctgtaggtgatgttagaatctgagatcaaggtgttggcagggttggtttcttctgaggctgagcgagggcctgttctgtgcatctccctggcttcaggtgcttctggaaggatgtgctgttccctgaattacagacaaacaccccaatctctgcctccatgttcatatggcattttccctatgtgtgtctctgaccatgtttcctcggttttttgtttgtttgttttttgctgttgttgttttgttttgagatcgaatctcgctctgtcgcccaggctggagtgcagtggcatgaccttggctcactgcaacctctgcctcccaggttcaagtgattctcctgcctcagcctcccaagtagctgggattacagatgcctgccaccaccttcagctaattttcatatttttagtaaagatggggtttcatcaggttggccaggttggtctcgaattcctgacctcaggtgatccacctgcctcagcctcccaaagtgctgggattacaagcctgagccactgcattcagccatttcccccttttataacaacaccgctcctgttggattgggagcccactctacttcagtatgatgtcatgttaacccattacatctgtaaccaccccattcccatataagatcccattttgaggttctggggctgaggacttcaatatcaattcggcgggggggagcctacaatgtaaatttgtaacattgtctctgtcatgggccagctgtcaatattccctgaatatccaggatccacccatgctctctggccatcaccagagtgagcaaatccctgacacatggataagagttgcttccatgggctcccagccaggctggaaattcttgattcatggaatcaagaatctttctccagtgggtggggctaaatgcagctgcctccctgacagtctccctgggacactaggcttatcagcttttctcctaaagctgcaggtcctgactgtcctgagccccagctctgctgtggtctttgcatcttaagatcttattcaactcgcttttgtgcctcagtggactgacttacaggaaaacagtgggagatgcccctgctctctctccccagggtctcctcccctcagtggcacaagacctgccctattgactggcagtccccccatgcccatctcaacctccacactgcccactgtgcacggtcacaggtcacaaactgattgttcactttgggcagatcaccttgacagtttctgcagaactgggtgcttcttcccagaatcaggaatttacaaacaaggccagttctagagatgcaactgggagagtaatgtgcatcacagcgaatctggacaagacaaagtggttttgctgtagttctcctggaacacattctggtgatgtgtccatctcccaggatagtcttagcaagttacatccaatgctgcatcaggacccacaagaaaaggaactggcctgcatgagtggccggcagggtcctgggaggagaccctgagatgcccagtgacaggaggagtggattcttaggttggtaagcgtgtggaggaactgcgagtgatgtgctcagccaggtacaggagcaggcgtattggtgacctgtggcctcatcttatctcagttgtctctttagaccaaactccaggaaatcagcacatagagacttctgtctgtctccgagatcatcgcaggacttcacacgtcttttctatttataatacaacatcatgttgtgattgaattactttcatcacagcctcaacagtcctaggtctgaaaactaatacatatacttagaatattaattaaggaatactttcttgtcaattatgtttattaaattaaaagacttcagtatctagtgttacagctgtcctaattcaacagccttgaccttcttagaaataaaatcctgatcccaaatttttctggggatatgactggcacaaggagccaagcagacatctggatgtcccagtgtcactgctgacatgtgcttttttgttatctgtcatggggtgaacagaggaagtgtccctacctctgtccacagaacccatcaaagacagtgcacctgattaaagaagagagggttgtgatcagaggggtccggggtcctgggatgaggtgggaggaggagactcatgggaagaaaggaagcagggcaggaagaagctgaagttcaggctctgaggtgcatctcctgcatggaatcttgactccactcacttctgtcattgtgtaatctttcaatgttggttctgtcatcagtaaacttgaggagaggttatgccataagcatagggctgaggaagggttattataaatatccagtcatggttgtgcctataaaacactcaccaaagactctgaatatattaaggtctcataagtagttgttttgcataatctagtgatacatggaggatggcattcctcctgtggacagcaggaggcactgtgggtgtatcgtttggggatgctaatagctccaagtcccccagtagagctcacgtgcaaagggtgtgactgatgtttcctttcaggtccagtctttttgagtacaatccactctccactcctgacacccacttggcccttctcctgcctttgagaaatgactaccctgaggccatcagctccagggctcagctatgagctcagacagacacgcttgggaatagagaacagatttggattcaatgctccttccttcttgagcttcaagaagaggataagataggagctggttgtgtccaggctccactgggcagcctcgatcagagctctcggaagtgcctcccaccacggcctgtgtctccttctacctcctgcccttcatattctccacaggttggagcatccagagaattcagggaaaccctttcactgctatttccccccagcactggtcctcagtggcattctttccagttctcctgtgcattcagcatcattcatgaaattatatgtttccaggtctctgtgctctgtctgtgctgacccagcccccgtctgcatctgcctggctgtgagcctcagccaaggtcacctacaccagtgaatagtatcaacagagaccaaggaggtccccctagtgtataatggaggttaagagtaatggcagcgacagcaaggggaacaggatccccagtcacttattgggctccagccctggggctgaatgctacttaattatcttcaacctccaatctgaggatgaggccgagtatcactgtggagagagccacatgtttgatggtgaggatgggtgagccacagtgacacagaccaagaagtgaggccaaaacataccccctccccttcctcttcaaggactgagagtgagaagccctatgtcatctccattgaccctgagaatgttgactctccccctttcaaatttcatcatcccagatgtcctccctcaagacacccttaggcagaggcagatgcaggccatgattgaggccattttgataagtcatcaatctgtttccaccacaccagcctgtggggactacactgggagagaccagaacagcccaggcaggaaaacggccctgagagaggggtcgggctgagatgactgcatccagtgagtgccattgcaccctgcacccctgcctcaggggactgtcatggggctctgcctgaggaggcaacatggatcttgacatgtccccagccatttatgagaactgtagttgtgtgcatcctcattaacactcaatattattgtcagtttttgtttaaagccactctaatagatctgtagcgattcttattaattttttaacttgtattttcttagcaacatcaggctgagcatcttttcaggtgcttgttatctgtatatcttctttggtgaaaagcttaatcaaatcttggtctatttttaaaattcacttttccccatattccccttcatgcagtatttttcaaaaatggtgaataaatgaaagttttgctgacatttaaaaactcacagaattgttcaccaccagactgttgctattagaagggtaaaggatatccctagacagaaggaaagtgatgtcacattgaaatgtgaatttacacaaaaaagtgaaaacatcaggctgggcccagtggctcatgtctgtaatttcagcactttgggagactgaggcaggagtattgcttgagcacaggagtttgaggctgatgtgaggtatgatcataccactgcagtccagcctgggcaacatattaagaatctgtctctattaaaaaaaaaaaaggaaataaaaaaattaaatatcaggtacagtaactacatagatacttgtgaaaacctctgtattatgttaatgccaataaaatacagttcactgatcaaagataaattaataaaatacattgtgatttataatgaaaataaaggcaaattatatgacaaagacagcacaaaatctgtggtgggtgaagaacatgttatcaaggtctcatatgggaatgtgtaacaactgcaggtagattttcataagatctctatatacataaaccttaaagtagtcattaaatcaaaccttttgatcaaaaaagaattagagcgaataagctacattagggttatccacagaaacaaaattggtaagatatatatgtgtgtataacatacatatgtgtatatacacatgcatgtatgtgagcatatcgagagagagagagaaacttaaaagaagaaattggttcataggattgtcctgtctgacaaggataaaaatctcttgggcaggctgaaggctggaaatgcaggtaagagttgatgttgcgtcctgagcctgaattcagcaatacaggacttaagaaatcctcactctttgctctaaacacctaaacactttcttttttttttttttttttttttgtgagacagagtctcactctgtcacccaggctgggttacagtggtgtgatctcagctcactgcaatcgccacctcccagcttcaagtgattcttgtgcctcatcctcccaggtagctgggattacaggtgtgcaccatcacatccacctaatttttgtatttttagtagagaccggctttctccatgatgaccaggctggtctcgaactcctggcctcaagtgatcctcctgcctccttggcctcccaaagtgctgggattacaggtgtgagccaccaggcctggcctgctctatacactttctactcatgaatgaggcccaccgcattgtgatgagtaatctgcttatacaaagtctactgagttaaatgtgagtcacatctggaaaatatcttcacataaacttctatgtttgtactggacaaaatcaacctggaaccacatcctagtcaatgtgccacttaaaattaaccatcacttaagccggcatgaagatagaaaggaaccattttttaaagcaatcaaaaacagagacagagaaagggaaagaaaaacaaggaacatatccatagattgtattttttaagtcactttttgaggttttctgttgttttcctgttttctatttcattgatatttggctcttaactatattaataccttttctctatttaaattgaatttcaatgctctccttttccttagatttatgaggtagaaccttagtttattttagatcttgcttctttccactgccaaacattcaatccaatagatttatttaaaactacttacttatatctattttttaaattttaatacatttgtttttgtgttttaaaagttcagtattttctaattttgttgtgatttttttctttgacttatgaaatatgtagttttatcttctttcatttccaaaaaattgaagatttaccacagttcatcatgtatcaattccatttaattagttaattctgcattaaatcataccttgcatgagcttcatattttcaaatttgttaacatttgttttgtggcctagaataggaagtatcatgaaaaatgttccctgtgtatttgaaatagcaatgtttattctgctgctgtgggtatagttttctacgaattcaattagcctaagttggctaatagttcaaatatatattcttactgtttttttgtgtatttattttgtaggtctgtgagagagagagctattgaaatgaacaacactaattgtagaatttcccattgcttcttttgagagaggaaaatttccagtcatggttcttaatactttattctcctgacaaaaggtcacctatgattttccaacactaatcaaggaaaaaaaaaaggcagagttaaagccacactcatggatgccacgggagcagtgggtgaccacatgatgtccctccactggttcagtagatttagcgagacattatattttggcttttaaaaatcataaatctggctaagacatccatgaacaaatttgaagacatacacattgaataaaatatgaaaattaaaagaaaggtaactgcatacgtaaaacattgctatcacagcacctgactcatgggaaatggataaaaagtattataaattcaattacatttacttacacattaaacaaatatgaatttaaaccagttcactaaactgtctcatatactgtttaggtgatggagatttattggtgcacaaaaaagacaagaatacctgctctcagagtggcatcatggaagatggtggagtacgaagctccagcaaatggtccctcctgtgaaattacttgaagtggcaagagtcatgacattaactctcataaaacaacagaatcttgtcccacatttgcagtattcagggatgtgccgatgaagagagagacataaaataatctctgtcaggtcaatttctggccatggaaataattgaacagaaactgcatggatcactctgacaaggaagctggtccttaccaaaatattttggaaatgtcaccacgcaattgaataacagcacctttcagcaagcaacatcagccaaggcagagaagagagacaatctgatttcgagagtgacaatatcataacatccaaaatacccagatctcaagaaaagtttacaaagcagacaaacataaaagaaagcaagacccactaaaaggaaagaaataaatcaactgaatgcattcctcaggaagcacaggcattgcacgtgctacacaaacacttcaaatgaactgcccgtatatgctcaaaaagcaaaaggactccatggaaacagaactaaaggaaagcagggaaatgatgtttgaacaagcatgaaatatcaataatgacaagttttataaaggaaccaagcagaaatactgaaactgcaaagttcaatagctgaaatcaaaatctcaccagaggagttaagtagtggtgtgagcagacagaagaataatcggtgaacttgaagatacatcattgaaattccacaggatgagcataaatttttttagaaaagaataaatgaacaaagcctaagagacatatgagacaacatcaagcatatcaatattgctttatgggagtttcagaaagagaagaaaaacaggaaaggaaaaataaaatacataaagaaaaatagctcaaaacttctaagtttgatgaaagattagaatctatactttcgaggagctcaataaactccaagcaagttaaactgaagtctgcagtgagacacattctgatcaaagcatcaaaagccaaatacaaaaggaaaagtgtaaatagtaacaaaaggagagttggggtagctaaagcaatttcagacaatataggcttcaagttaaaaatgcttacaagagacaaagaaaggcgttataattgatgaaataaccaactagtcaagaagacagaataattatgcaccaagggatagcacttcaaagtacataaaggaagaccaatttgaaaaaaaaaatatgtagatctataatataacttggagacttcacttctccacttttactgaccacctaggccgggcatggtggctcacgcctgtaatcccagcactttgggaggctgaggcgggtggatcatgaggttaagagatcgagaccatcctggctaacacagtgaaaccccgtctctactaaaaatacaaaaaaaaaaaaattagctgggcatggtggtgggtgcctgtagtcccagctactcgggaggctgaggcaggagaatggcatggacccaggaggtggagcctgcagtgagcagagatcacaccactgcactccagcctgggcaacagagcaagactccatctccaaaaaaaaaaaaaaaaaaaaaaaaaaaaaaagataataagagaagagacacaaataagtaaaatcagaaatttgggacaatagtacaaagcttatggaaatttaaattataatagaagaacacacaagcaattgtatgccaaatcttagaagatatggacaaattcatagtaaacacagattgccaatctgactcaagaaaaaagagaaaaaaatcaacagaaatatagaaaataagggatgtaaatcagcaatggaaacttccgaaaaaagaaaaactcaaaaccagatggcctcactggtaattctgctaaatgtaaaaaggagttgatatcaaccataatcaatctcttcccaaaacagattaagaggaagtacttcccagcacattcgaagaccctagcattagcctgacaccaaaggcaaacaaggatagtattttaaaaaaactaaactaaaggctaatattccttaagaatgagcatgcaaaaatcctcaacaaaataaaagcaaaccaaatccaacgttaagttaaggggaataaaggatttcaaagatggttctacataagaacatgaatcaacgtaatatatattaacagagtgacagaaaaagtgtatgatcatctgagtagatgcagaaaaagtgtttcacaaaattcacattttcctgattaaaaaaaaaacacacactcagcaaactcggaatagaaggaaacttctacaaactaataaaggacctttatctaaagccacagtgtacatcacattaaatggtggaagagtaaaagcttccctactaagatcagggacaaaacaaggactcctgcctccacaactactatttgacattgtacagaagttttagtcaaagctcttaggcaaagaaagaaataataggtatctagaatggaaatgaaggagtaaaatcatccctatttgcacagaacccgattctaaacgtacaatatcccaaagaatacacgcacagaaaaactaacaaagtgaataaacacattgaaccaagtttcaaggtacaggaacaactggacttgccacaacttttctttgttatcctgggcattagttctcttggcctcaattttatctttaaaactgggaggcttatactgcagttgagaaaaagacacaaaaagaacctgttagttaaagatggaataagtgaatctcagagggtggacataggttggtgaggtcctgtccatctctgggggcatttttctggagtgtgggaaagcatgttcccagatgtgttagcaagatactcgcaattttctcaaaacaacagacaaggatagtgtagaaatcctcccaccacaaattgtgaacagtgtgtgatgaaataaaaataacagtcatagaaaaagatggcgatgatgatgataatgacttaagtacacaactaaggtttagtgatagaaacatcaggtgttcccaaattcaatgcagcttttcttataaaatgggggcaccagtcttagttcccatatatttaggaattgagggtccccatgaggtgtcgctgcatttctctgggcttttatgtttatcacagaagagctacagcttaccctgcactctccagcccgcaatcaaaaatcatggaccaaagaacaacatttcagcacaagactccattatgggaattgaatctgcccaccctcccgaaaccatatacacctttctgtgctgacatgagaaaaccacagtggatcacactggctcaaagtgaggctggactcctttgtccccaacctcccagatgacaggtgctgtggggtcacccggaggagaaaagctctcctaggctcagtcttgtccaccagcaaggggcagcagagctgcagccaggagcagccagaggctggggctgcccaggtggagcctaaggggtaggcagccctgggaggtctacaggtgtccaaggttcagtcctaggattggaagtcaggacagtccatcctattgcttctggttacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgaggtgctctaggagggggcccagtgggagaggatggggctcccagggctcaagtccttcacccaggatggccatctgagcatcctgccactctcggggcctcgcccctccctctccagcagtgtcctggggagctgaaccctgtcccaggcacttccagggacgcctgacccctcctccctctgcctctccttccagctcgagactgactctgactcatggggcagctcctgtgcgcaggggagtctcaggtgggtggggcggcacattcagggccccggttcctgggtggggcttcccgggcctcctagaggagatgctctccagagggaagggggttctcacctgattcaggccagagctctgaccacaaggctgtccttggctcagtgacaagagtctgctgcattgcagagaccagggaccacccaccatccagagctcacactctgtgcaaaggctgtgtccctgggatatttgcagagaccaccgggcctaaagttgaatttcccatcaatatttcatgtaaacttgtaaaaagcaccagaaaaacacactggactgagaaccccgatgcttttctggggccttttacaagtttacacaaaatactcataggaaaaaataaataaataatggaagagctgaggatggcaatggctgatctatgtggggatgggggatggcctaaaaggagcggcaccatggctgaaatgagagcagacgtccagatgatgccacaagggtgtgtggttgcgtaaatgaaccacctactcctactgaaataattaacaagtatcctgacgacacagtacgttatttagatgaaatgaccaggatgggactaagtaatgctgggggacccagagaggagggggaatatggtgggttcttggtccacctgctgctgagtcaggtttcatcaatgatctctcagcagggccaaactcagccccaagccaggtttctagaaggcccgcagccctgctgagcctggcccaggacagaccacaggtcagagaggtttgggacagtggtcatatggccagtccccaggaaggtgactgtgatcacaggcctcagaggtcgaggctaattttctgaccaaagacccaactccttcttcagtcacctgtgctgcccccacagctagtttgagtgacatctttcaatgaggagtcccagaggatagaaatttgcatgaacaccaagcacttactgccccatagggcctgggaaggaataagagaggcctggggagcccagctgtgctgtgggctcaggaggcagagctctgggaatctcaccatggcctggacccctctcctgctccccctcctcactttctgcacaggtgcttctcccaggccctgccccaggctcagtgcccatagaccccaagttggccctgccctgaaccctgtgcaaagcccagacacagtcttagggtaggacccctgggaatgggctcttgatcttcaagccccctctcctgttttccttgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatagcacagtgacactggcagatggggaagtgagacacaaaccccttcttcatctattttaccctctccctccagccccaggaccgctgtggaccaacccataagcaggtctggcagaattcacctggttaggagatccttaagctgcttttccctccactcctctaggcagactttgcaggaatgagtcaggagtggatttgggcctggcagggccagactgccctgtgtttccttgcccacggtttgagttgtgaatggagagtatgagtggaaagacagacacagcgggacatccatgcaggcatgaacagcccagagcgacaggggaaactttcagctctcagttcaatgcagtcattgttttatctcttggaagaagcatttctccagtgcaactaagactctagactcacagagcccgaggttgtgggggaggacattaaattttgctcatggatcactaaggacgtttttgagtggagccactacaatttattcattgattcctggactcatggatcctgactgtgggagaaatagtactgcatattgggcactgctgtacagcgcatgccccatcctcaaagtcattgcccaaccttacatgtttttgccatcctgctgccacagtaactgagtcttcaagcagacactgagccattcatataagccagatgccacattggtgaagatggtaagacacttgaatgccatgaggatgggcccatggttgctgtttatttgctgtgatatgagttccttggtcaaagccccctgtggaataccatcatggtgggtgaagcattctgtagtccagagataaaaggtttggcagaagcactgcagtcaaagaaagcaaatccctgtctatactaagtgtgtattctggcaagagcaaagagctatccctgccatgaaggaacagctttaatgaaattaatatcaaccaggcatcctatagggatcttcctgttggtcttcactgttggcagatggtcactcagcagtagctacagccaggtcagctctagtgagtggtagtccactttgatgagtccatggacagcctccttttctgcaaccatagggcatttgttattgagccaattgggcaatgatggcagtggttggggcagactgccaggtgtccagagagccacccatcctaccaacctgtttagcaaaatcaattccttctcatgtcagacttcacaaaatattcacataggagataaatattctcatgctttctgcttgctcacacatctctccctcagacacagttgtgatcaatattctgattgtatttcctgtgtccctgaacatccttgatcatcttccaagtccctgagtcacagcccatgaactaggaacctctgcccgtctctctttgcagatgacatgaaccaggtacactgctctaagttctgccttaaggagagtgttcctccaccactgctgttcagggaagcccagaggccaggtgggatactagcactgtccacagcagggatggctgcatgtcctgcagaaacctctgtaaccccagtctaagtgcctcctcctaggcagctggtcccagggagcccctcaggaggcccaggctgtaaggtgagaggatggccatggggcaggagttggcccgtgtctatctggccacctcttcatgcaacttatttgtccttgtgacctgatccatcaggtctcaggtacagcccagccatgtgatggggaggccactataaatggccacctcggactgggggtcagataacatccagctcattggcagcttgtgtcccatggtgagctctgtggccacagtcacaaagagcccctgttgaggcccaggagcccccccagtcttcctctaatggagctttctgctcatttagaaaaataacaatggggaggttgctcgcctacctcaggtctagggtcactgggaccacctagaccacatccatgatcttgtctgattattctgattccttgttggcttagctatgcattagtgtaaccaagccacagtgtcttaggcactaaaatgccactacttggcccctgcctaccctggggtcctgtcaaccacatcttggtatccaattcagttttagcaccactaagagaaatctatttttatattgagaacaggaaacattagttatttctattgtggaaattttataagacaatagtgtggaaatgttttaagagacattttacttagagtgaaagaccttccattaaaccactcaataaattgctccataaatggccagcccaaaccctgagttcagaccaggcacagcctcggtgttgggaccttctgggaatgggtctctgtcatcaacccttctctaccctcctgtctgcacagccctgggcctcctacatgcagggacagctcccctcagtgtcggtagccctgggacagatgaccatgatcatatgctctggagataacctcggaataaacacgcattttggaacaagcagaagccaagccagacctcaatgtcggtcctctagtataacatcgaccagccctcagagacctctgcttaatttttaggccacaaactagcgaacatggccaccctgaccatcagcagtgcccaggccagggacaaagctgactattactgtgcctcagattgtgacagtgggggcagctggcagggactcacagtgacaaagacagatggggacttgcaacaaactgtcccacttcagcctgcctctcattcttacctgccctctgagcagctgtaggtcaggcctcagaatcaggtgtcctctctggtcctcacctggtccctgcagggccggagattcgtaacagcttttccatactctcagggcctacatgtgttcaataaaacctgtacgggggaagctcgttgaagctgcaaggaccttttacaggtttgtagaacacatgagaacttcaggaatccatatagtgtcacatggctccatgtgtaattacacgtcacacagggaaggagagagctgtttcacagggtgcaatcctactggaattcgtcttttccttgcgtagaaacagcttagtggaagccgtgtctcctctggtttcctagatgagttgaccccacattgtaatggggcacctgaggcctaaggaggacaggagacccaacccctgtgggccccaggagccttcctgtcctgacatttcacagaaactgcagaggaagtgcaggcccaacctttggttccacctggggactgtcttcagggaacactgacctttcccagtccccaaattcccaggacctgtctgacctgactaggtgtgcctccagctccctgatagcttggattttatctctgggctctgggctgctttctgaggagctcactaagaagtccttggtgccaagtgcaggacttgcccctctgctccatatcccgggtctgcaggcacaggggacaggtcctgctaggtgaggctggcaccctcttccaggagggatctctcatcccaggccctagggacaggttcactgggctttcttttctcacttagaatctcttagtctttttgtttccttctttaagagtacaactgctttttggtgaaatcatgtgtatacatcaaagttaacagactactgtcacaagcgcatatatatacacatcctcttcctagatggggtaaccgtggacactctgccatagtcgtctttttgtttctctctctctaccacaagtgagactattaatagcactcttctatgcagaccataatcatattctccagttgcacaagaacgattcttatagttgctcaatttccttgcctttcaggaccctgaagtttcccatgcccacatttggttgccatgtctctctgatccaacagtattccttggaagccgaggcttatgaaacattttgcaaaaagttccacaagaaaactcaagttccttgtgcacagttggaccatgttcattgtgtgcagtagaacctcgttccagtgttgagtccattttatgttttgaccatcaaagggaagggcattatgacttttggggactgagtcgatggaggaaagatagcagtcgatgatgaccttatgcactgacgtgtatgtggccaatgtctatagatggatttggaacttgaaggagctgttcgttctgcagatggaatttccagtgccgcatctccaccacccagccactagcactcggcaggtgctctgtaagaggaagcccttcactgccaatcagccattacacaggtgaaggtgagtgagacttaatagctattaaccctcaaaacaaactgaggaataaactcaggttcacaaagtgactttgcgggaacagcctgaggaagcaagttaattagtagcagaaggttttgcccagagcaggaggaatcacaggatcactgaggacctagtgataccatggtgtggaggtgctgtgaggcatggtgacattcaagaaaacctgttctctacaaacacctacctacccacaggcacagcagacaccccagctatgccaagggctctgtcttcctctagagtaagagcctggtagcaaacaggtatcctctgaaaggcaggtgccccatcagtcagctctgcacgactgaaacaaaaggaaaattgccagagaactttccagaaaacagtcaacctgcttgtgctggtgcattgatggtgacccaggatcagtggaagtaacagtagcttaatttccccatggctgcatgatggacaccgggagagaagtgtggaggcggattaaccaccactctaagtggcttcagccctaggtaagcaggaacaagtgagggggctgagcccacttgtgtctaatcagtcccagcctcagcgactgcatcctggagaccaacagggagtgtatgcgctcagcccctcccagattgctgagcataagcaagaaatttccctccgcacacctgacgcaccacacacctgcccccagctcctcacttacaagacaatatcaaatcagacagggactggtctgggtcccagatcccctcaggttgccgctgtcctctcagatccccacacacagcagactcttcccctcacactcctgttccaggttactcttctccaatatgatgggggtttgctttcattgtttctgtattttttgtatttttatgggtaagctgagccccttttacctggtcttgagtcaggcaggggccacacagagaagaggaattcctccccaggggccagcagtccacggatcaaggcatcagggacctgagcagtaggttctgttcctatgcctggacccaggaggcccatgagcctccagcagtcagtatggagcagccaccaggggggcagcaaagagtcacctgggaaagccacctcgggatggggtggacctgggcatcagggagatgctgacatgcagggagggtcagtgaccacgacctgacacctggagggaaaataggtccttctttttctagagtgttgtccttgacactgatgtaaaaattctagcatcaaattttatcttcagcttttgtagatgctcctatttccctgacaaaggtccaggcacttgacttccccacacatcctctcctcacacacccagttgtgctaaaatgctgtccctgtcatgcacagtgtccttcctgaggtgacacgtgtccccctccctgccctttgctctgggagcccctgtcctgtagacacagcagcttcttcttccctggctgctccccatctccactgtccctgggctttcccatctgtctcctgggaaagctgccaaatcacaggtctcaatttccttgtgaggcacaaaatagttgctcattaaccttctgttgacttaattaagtttttaattccttgatttgttttccccagcaactgaagacaacttagtcataataaacattcacttccaggggtcttgcagtttgctgacccctctcattctctcatggagcaaacattttcttgacctccttatctgtcattggtcctcacagcaccctggggacactgaggcacagcatgtacgacctgccctggagctcacagccaacgaggaaacttaccgcatcccatggatcttccaacactccatgtgcacttggcaaccaagaaattttattcttctctagcactgaggagctgtgccctggggtggggtctgtacctatccaaggcacatgctgtcacctgtagagtgtggatagagggtccttgcattaggttctggaaagtgtcttcaaaaacggatttaggcctacacccaaaatctcctctctggcacaaattattcatgatcaggatacatctagaggcctagaccaaaattcaccacctccctcctgagccagaatggaatggaggaggggactggggaccccagataatttccccatcaccactgtgactctatggccacctcctgcaacagttagggataatcacataggaagggcttcatgtatcctaggaaaaacacccaaagtcatttatgagctctaccatgaccaagtgagcccaggagtcgggttgagcacagcgtggtgtggagatatctgcagagaccgtggaaccagtttgtaaaggagatcctgtaggctgagggtgagagtgcaaggccactcctccccctctctgcatcctttggggctaagcccttctctggaaaccacaaagctcctccagtagcagcccttgactctgctgatttgcatcacaggctgctctcttcagcaaggggataagagagggctggaaggaacctgcccagcctgggcctcaggaagcagcatcgggggtgccgcagccatggcctggaccgctctccttctgagcctccttgctcactttacaggtgctgcccccagtgtcccagccacctacccagctccaaggctctgggtccagcctggcctgacagtgatctcagcagggccctgcctgtggtgtgcaggatgctcatgatcctgctgcagggggaggggctgctggaggtgaaatccccccacactgttcttctgtgctcatggtcccctgaggacacttctattcctgaaactcaggccaggcaggtgggaaggcattgttgggttgagcctctcagtttcaagtctattctattctctccccttttcttgcaggttctgtggcctcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagcaaccggccctctgggatccctgagcgattctctggctccaactcggggaacacggccaccctgaccatcagcagagcccaagccggggatgaggctgactattactgtcaggtgtgggacagcagcactgcacacagtaacacaggcagatgaagaagtgagacacaaaccctttcgccatctatgtcaccctctttctctaattcaaggaggactatgaacaaagccttacgcagatctggttaaattctctttaatctctgcccccagcctgtccctccctccagtccttcaggcggggtctgcagaaagtgcatcagtagttcatttagggtgatgtgatcaggatggactggtgttttggtgactcagctgtgacttgggaaaatagggcctgcatggaagatcagactgaggtagacatccacagttgtctctggatttccataggtggtgacaggccagtccttgccccaaatgtcctagatcagtccccagaactgcccagctcaggctcctgtggtagcctgtcattctttagagaaacaccaatggagtagacactgtgggatctgcccagatcccctgttctgagcttacccactaagcactactgggagcttctggcaggtcagagctgtgtcctcactggaaagtgctgttcggtgcagaaaacagactcctccaggtctatgccctttctcagtgaggttagatttcatgactgcctgaggccgagttctcgactctgcctcaatataggaagacctgaaaatcctcccagctccacagctctctgtaggaaagacttgagacctcaatgagggtcagggtctcctgcccagggttgcctccctcacctcctttcacatcctctgtgcatgcaattcctcatctcagagtctgcttccagggaacccaattaagatcaccagccatccccaacatgggccatgtgggacttcaggaggccactgtatgctggaaagcacctgtttattcctaaattagcactgtgagtatccacacgcccaatgagatctgagtgtttcttgcatttgcatggaatgagaagggagcctgactcgccaggtgctctggggtctaagggagagttggagtcagatctccctgcagggaaacctggggcaggaggagcagccttaccccatgcagggaccacagatgcacccacagggtgagcttaagtatggacactgcctacctccaccctccacatcctgtgtaaaaaatcattctttccacccctcctccagcctatcaaagttgacacttaaaaagccaccacaacccacccttgtcaacaggaaacccattcacatctccatcagccacacaatctccacataaagattcttcaaaaaataataacaatagccatgcaaagtatatgatatatatcataaataattgtacttagattatatatgaaaatgatactctttttgatatgctaggtaaataaaatacattatttaaactcattgacttcttctctttgtatttataacatgatgactagacagtgggattcccatgaggctcacatcacattgtgattgaacaaggctggtctgcagggcttcaggttacaggggctgtggagtgacctggtgcaggaagccccgtctccatccataggacatcagtgtgaacccagggagaggcgctggtataagagagatgagaacacaggtgtgaaccacctgcttgtgcaggggactgagccttcactttgagccaaataagttttctttcccaagttcgatcctgaacaagagggctttctggacttctttttgttttcaggtttgtgccccttcaggtttggggctgtctggagtcccagccaggggacagtgaggaaatccagcagtctcacactgactctgttgtatttcatctgctggggccatcccaaactgctgcgtaccatttcctttcctggtgctcaaatagctgctccatgcacttgtcatggttttatagctcaatctagatgggaagacaggatagtgtatgttacaatatttaaatagaacctgaatcccttaatagttattttaatatggaacattaaaagagttgcatcataggcaatggggaaagatgaagaaagattaaacgcatttggaggaaaaactaaaaatgtctttattgaatgtctgtgtgtcttcagtgacgaagggttgagagaggtcagctttaggttgtcctgaggatgtgctcagatgggggaaagtaagaaagcaggaaacgtgcatctctgtgacctgacacataaatcacagtaaaatggaagtaaatctttcaataaacctttcaagataacatcactctggtgcacatagaaaggcctgttagcaaactttcccttttccctgctggctcatatccccatggatcacctgtatgcagaacggactctgtggtctccatttatcaggctgagaaccagaggctgggaaggacaagtcacctgctcatgagtgggaggggcaggattgggagcagcggactcaggctcaggactgtggccctggttggtgctccttgttcccttcacagggtcccacccacatgtgcccgtgtggatgtgggtgcactgcctggggtggctgatgtgctccagggatttgatggtgcagatgcttcaggacaaagcatgggagtggggatgggacgagctgccgctgggcagaccaaggaccaacgccacccagcagaggcttccagtggggttgggcagccccatttcctgagaatagagagaacctggcaatgagtgccagaaagaagttacttcgaggtgtgcccaggcctggagggtcacagagacacaggcaccacacagcagagacactgaaggccaagagctcactcaggtgaagggcttcaacagatttttctctcctgagcaaatcacgtgcaaagaaatcaacttcctgtcatcagaatagacaatcaggactttagtctccttggctgagccccgctgtcaagggaagcagaagtctctaagcccaggcccaagtgagggtggggtgagaagaggagctcaggatgcagatttgcatggaggtcccgcccttctctgaggcagagggataagacagggctgggggcaggcccagtgctggggtctcaggaggcagcgctctcaggacgtcaccaccatggcctgggctctgctcctcctcaccctcctcactcagggcacaggtgatgcctccagggaaggggccacagggacctctgggctgatccttggtctcctgctcctcaggctcacctgggcccagcactgactcactagactgtgtttctccctttccagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttccacagtgttttaagtcaatgaggaagtaagatcaaaacctgccctgggctctcaggccccttcttgctctgcagatgcttcctcacgctgtataagggtttcctgcaggatggccttgacaattctcctctctcagctcctctcctttcccaccatgaggtctaaaaggaaacctgctcgtgatttctcgttcaggactgtggcaacttccttttgcttgtgtgctctggtcccttaacgtgcaactattcctagctcttcaatgcagggacgtagggacaaggagtttactgcttggtgcagtccctcctgttttcaggaacatcctcattctaaatgcatcccccatctgccacactatgcagatcaatctggacagaagccatcagggggatggcttccagtttccaggaattgcatcttgttccactctgtgtccaccacgctctaatgaagatggccctcctagctggtctattcctctgcacctgggtcctgaagcagtgaccactttaagaagacttgaagatgtttttgagggattaagaacaaagaggatgctgctgtttttctttttattgctcctgctctttgccgaaattcctcaggttgctgagctggggagattttgagtgacaggctcagtgctctcgcagaattctcctcccctcacatcgctgaggccctgtcctggaaactcctcacaagtggacggtcttcccataggatgggggattccaaaatggctccacaggaaagagttaacctgagtccacctcccttcctcatggacatcgagcatttctaattttcatggctgtcaatacttttgtacctggaatccctaataatctaatggtgagaattgatttagaacacattcggacattagctgggtccaatatttaaattttctgagccagttgttaaatacagctattatcatatatagtttaggctccttaaacttcgattatacagattatatttaaaacaaagtaactagtttactatatatatttacaaagtaactactatataacatcatgttgtgtacctgaaatataaacactaaaatttatttcaaaaaccaaagtgtattgtctattgatgcataaaaaaacactcacaaaacttagcacactaagagaacacatgtctgtgaccttgtgacttggatgcacctagaattgggagtagcttagtttggtcattctcgctcctggttaatcacgaggttgcagccaagctgtcaggccaggctgcattcaggctacatctgccaaagaggttaggaactgtggaagcctccctctggctgtggaagcctccctctggctgtggaagcctccctctggctgggagacttccgcagttcctaacctctttggcagacgtagatcatctcaaggataaaggagagagtggagtgaaggcccctgtccttgtcctccatgtaaaaggccatcccatgcatgcactattttttattctttgctgagacatcctaggcatagagcactgccccattcattcaaaggttgtagagtattctatggtagaattttagccaactcacttttaatggttattatcactattttgatcttataaataacactgcagcgaacatccttatgtagactcctttgattttatatgtagacatgaccatagaataaatttctagaagtcaaattgctgagtcaaaaggatgtgtgcttgtaattttcactcactgtcctcagattctcctctagaggggttatctacaaattcgcaatgtcagccataaatattcgaacagagtacactggggaaagtttaaatgtttttcaacctagcagatttaaaaatgttatctttttttagttttgatttctcctgttctgcttgaagttgagcattttctctaatacttcagtgctatttatttttataatttggtaaacattttcttaaatgtccagataagaaggattttggtctgtggttcccaagagtcaactttgaggatattctgtaggtatttttagcaccatttatagtgtaaccatttaaacctataaaaaccactctcagctctggggccatggaaaaacaggtggcaggacagggatggcccacaggatgtggtttaacggtccctgatttgtagggtaatttgaagtttgagaattccaccgcatatgttctaggtggagatctctatttgaaggatactgtattttacctcctatagtggcctgaggcttttggataagaacatacttgtatcatctatttaattggatcttgggtcttcccaggacagccctgtgtcacagtctcatgtttttcatctcatccatttgctctgagttttcagaaagctttagtatatcagaaatagactgaccctaggtggaaaatcagaggtaccgggagcagcaaatggtcagggaagcttgcaccaactctggaataaaccagtacaggctcagagaaaaacatcataaaatcagcattgtagctgaaaccaaaaacatgcatgatctttgaagttctggggattataaataaataaatgaagtttaaggtttaaatgtgttgcaaatttacataaagcatgtagattttaaaactcagaatgcagcaatgaaatatggaagcttgagattttaagctgttaaggccctacaacaaattgccaggaacagaacaggaacttgatagtcataatgtcttatgctggaaattatcattttctctaaatgaaatttttttcccttttttcttagacataaggaaacatctcattgaacacccttcttttccactgtcaaacacccttacccagaaaggaactgtaacattaagtaggaaacaactgctttttttcataactattgagagatttctttatttgcacatcaaaatgttgattgtcaatgctaaaattggaattagtagtttaatatgcacacaagagattaattttgtttggattatcccatttctgtctattatttgtcttagttaactcagacatattctgcttttggtattttttgttttattttctttgccaactacatgtaaaccaaaaataaaattctaatgctcccccaacaaccccaccatctgagtggactctcttctcttggtgggggcactccaaagttaatctgaaagactggttcaggccatggcagaaaaggggtgtcagacatgtctcattaagcccttttcctttttggaattcaggaaaagccaacctgcacttaacatcaatacaaatcttaagtctgataagaaacatttacaatctattctctctgaagcctgctacctggaggcttcctctgcatgataaaactttggtctccacaacttattataacccagacattcttttctattaatactttcaaccaactgctatcagaaaaatttaaaatctatctataatccagaaggccccacaaccctgcctcccatcaccctcttgttttgacttatcctgcctttctggactgaaccaatgtatatcttgaatgtatataattgatatatcttgtctccctaaaatatataaaaccaagctgtgccccaacctccttgagcacaagctctcagggtctcctgagggttgtgttcaccagtcatggtcactgatacttggctcaggataaatatcttaaaatattttacacagtttgactctttgtcaacatatggctcttttcaaaacaccatttgacacccagacataacccgctgctaatgattacaaaattcaattttattagcatttaaattattactttaaattatttcaagaatgcatggatgtgatttcccccacatctaactcacaaatgttgctgatgctgacttgctcttttctttcagtcttagcaaataaagagggagtttacttttcttgataccagaagataacaggagaaagtaggtgaaactcccgaaagctgttatcgtttccaccctcaggatgaatcacacaaggagtcacctgcacttcatttggatgataaataaatgagatggatcttagagttggtgctgatctagtcaatgatttgggatgttgggctgaggtgaatgtgtttcacaggtgagaaagacatgagttttagagtccacagtgtggagggttattggctgaagtgtgcccgagaattcatacaatgaagctctaatcacagtgcatgaatgaattggaacataggtctttaatggggtgattaagtgaaaatgaagccagtaggatgggttcttttccatctgacaggtgtcctctgaagatgaagaaatttgagcacacagaaatgagacaccatagatgagcatgcagaggaaagatcacgtgaggacacagaagaagggagtgatttgcaagccaaggagatgttacagtagataactaggcagacgtgacagggcaggagaccccctgccccaggaatgtcacgcaagcatcagatgatggtcaggtagttgttaaactgtctctgtgaattaataattagtcacagccggcaccaaggaaaggcggtctcccaatagatagaaaatacctgaagctggtgatcagcagctttctgataagatctcaggccttgggtgagtgggctcaagcaggcaaactaaaaggcaaaacagaggccaggcatggtggctcacccctgtaatcccagcactttgggaggccgaggtgggccaatcacttgaggtcaggagctctagaccagcctgaccaacatggtgaaaccctgtctctactaaaaatgcaaaaattagccaggtgtggtggtgcatgcctataatcccagctactcagaaggctgagccaggagaatcacttgaacctgggagatggaggctgcagtgagccgagattgcatcactgcaccccagcccaggtgacagagcaagggtccttcaaaaaaaaaaatgcaaaatagcagagtttaacctggatctgagactcccatgctgcccttccctccagccctacaggcaggctctgcagagagtgaatcaccagtaaatacacaaacaaatatgattacgttccttttgtttaagaagtagaggaatgattgaatatattaagtgaaaataaggaataccaacacaaagaaaaatttaactgtaagtatggttaaaaatacactgggtgagatagacaagttagatgtcgcaaaacaagagattagcaaactgtatagtgtaacactagaaactattcaaaatgaaacacatagcaaaaaataacgataaaaataaacagcatcaatgagatgtaggagaacttcagacaggctaatatacgtgtaattgaagtcctcagaatagaagatggggtaagaatgaaaagaaaaaatatttgaatgaataatgacaaaatatgttccacatttggtgaaaaccataaactgatataacccagaagctcgataaaacttaagcataggaaacacaaagacaacaactccaaaacacatcataatcaaattaataaaatctagtgatgaaaagtagtcatttaggacaaaactacaaagagcagatttctcattaggagcaatgcaagcaagaagatagtgaagcaatgtcttgaaaataataacatgcaaaatccaacaaccttgaattctttatccaccagaaacatctttcaaaactggaggcaaaataagactttttcagacatgtgaaatcctacagaattgatcaccattagactctcgctattagaaatgataaaggacacccctaaacagaaagaaaataatcctacattgaaatgtggtttgacacaaagaaatgaaaaatcagatatggtagctacctggatcaattagaaacctctgtattatgtaatgtctataaaaagaacagtaatgtctataaagagaactgttcagagaaaaattaataagaatacactatgatttgtaataaaaataaaagcaaactatatgacaaagcagaaaagcgaaggtgggtgaagaacatgtaataatggttttgtactatatgtgaatatataatagcacctgaaggtagattttggtaagttatgtatttactgtataccctaaaacaaccattaaaataaaaccctcaacaaaaaagaaatatggctagtacgctatattagacttgtccaccaaaaattaataggatatgtatggatatgaatatatatgtataatgtatctatatggtgagagagacagacagaaacttattttaagaagctggttcatacaatagtggtggctgatggacaaaatctgttgggcaggctataggctggaaatttaggtaagagttgatattgccgtcctgagttcaaattctgcaagaagctaatgtttccccaagacagcatcagctgttattatgcacactggctccaaatcgaggaaagtgtcccccctgaccattagcagagctcatgccaagaacaaggctgatcattaacatcaatcactgggaaacttcagtatttattctaaaaaccttgaactcattaatgagactcacacacattgtggaaagtagtattgatacaggagacagaaattatttaggcagatagtgagggtgacagggtcctcagcagagcttctcatctaacaaaaagcagccctaaaaatcatttcttttataacaaagagcagcctgaaaaaatcgtgctgcaaacatagataagcaagctggaagcttgcatggggcaatgccagcagctatgccaatagaaaagtactacctgggggtcagccatgtccaacatggaggctccatcttccctttttttgtcaccatgtgtatagcaatagagaaatgggcaacatggagcagctcaggcagataacccacctgcgtaataacagattagggcagggttggccagaaatgtgcaccctatgcaaatggtacacctagtcctaatcagtttttcatgccctgtgcaagtagcacacctggtctaaccagtctttgacacccaccttatgtagatcagatactgcctcctcaccagctcatctataaaattccctacatttcactgcagatccggcaacccatttttctgggtcccctctctgcagcagagagctattatctttctttcacctattaaacttctgctgtcaacctcatttgttgtcagatcatgtcctagttttccatggccctgagacaatgaactttgagtattcaccccagacaatgaggctatttcaatatgcttatacaaagtctactggtttgaatatttatcacatttgaaaaatatcttcatgacaatgtctacactggtgcttaacaaaatcaacctggtaccatgtcttagccaatctgacacttaaaattcaccaccacttaagccaggagctaaagaaaaccaatttttaaaaataaatttcaaaagagagaaaaaggaaagaggaacaatgaacatataagacaaatagaaaaaaagagcaagatggtatattttaacaaagtatattcctaatcacattaactataaatggtctaaataccacaattaaaaggcaggtattatcatctatattctaaaggagttcaggtagggttggtatgctttcttccataaaaatgtgataccagtgaagctatttgggtataggtgggcttttcttagcacggagattttaaattgctactttaatatctttaagtgtcatagacttattcagattttctatgtattcatgagtcaattttcataatttatgtctttccagaaattttacttcatttatctataattttggcatttactgttcataatattccctataaccattctcacccttttagtgtctatagtgatgtcattattttagccatggttttggcaacttgtgtttctttttcttttttttatcatggtcactttacctaaagataaaaatctattgattttattaatctttttgaagagccaagtgttttttttttttttttttgaggttttctattgttttcctattttctatttcatgaatgtttggctgtgatccctattattaccctctattcacttagaatttgaatgttcaccttttttaggtttatgaggtagaagcttagattattttctttaattctttcttctttccaatactaagcatttaatgccatagtttttcttcaaagcagacttagctgcattccttaaattttaatatgttgtgtttttatgtttaaaaaggttcagtatcttctaatttatgttgtgatttttctttgattcatggattacttaacagtctgttctttcactttcaaataattgaagatttcctatggttcttccggtattaattcaagttaattagttaattctgcattaaattatatcttctatgattttcatcctttcaaatttatcaatatttgatttatagcctaaactatgaactatcatgaaaaatgttccatatgtatttgaaaagataacatgtattctgctgttgtgggtgcagttttctacaaatttattataattaagataacttggcaaatggttcaaatctatattcttactagatttctgtgtagttattttgtagatctctgagacagagctattgaaatgaacaacacaaactgtagaatttcccaatgattattttgagagagatcatttttaaaatcatggatctaaataatttattctcctcacaaaatgtcttctatgatttccaaatactaatcaagggaagaaggcagagttaaactcacacttgtagataccacgggaacagtgagtgatcatgtgatgtgcctccagaggttaggctaatgtagttagagtggtttatatttatttatttatttatttatttatttatttatttatttagacagagtctcgctctgtcacccaggctggagtgcagtggcgctatctcggctcactgcaagctccgcctcccaggttcatgccattctcctgcctcagcctcctgagtagctgggactacaggcacccgccaccacgcccagctaattttttgtattttttagtagagacggggtttcactgttagccaggatggtctcgatctcctgatctcgtgatccgcccacctgggcctcccaaagtgctgggattacaggcgtgagccaccgcacccggctggttttttttttttttttaaacacacagttgggctaaaatatccatgaaaaaatttgaagcatgtaccttgaataaaatatgaaaatcaaaaaagttaattgcacacgtacaacattgttaccacggtgcctgccgcatgggaaatgaacaacaagtgttattaattcaattctattttcttacacattcaatgaatatgtattgaaacaaattcactgaatggtcccagatactgaataggtccttgagatgtactggcaaacaagacaaaaaaaaaaatacatgttctccgggtggcctcatggaagatggtggagtaagaagctccaagaaatggtccctcctgtgatataactattgaagtggcaagaaccatcagcattcactctaataaaactatggtatctcatcccatatttgcagcatccagggaagagctgaagaagaaagagacaggcttaaggaagtctctgtcaggtagatctctgaccacagagataactgaacagaaatttcgtggatcactctgacaagaaaggtagtccttgcgaaaatattcaggaaaagtcacaacacaaataaacaactgcacccctcagatgaacaactgcacaatatcagccaaggggcataatctgataatctgatcctgggagttaacaacatcacaatattcaaaatactcagatctcaacaaaaatttgcacagcatacaaagtcacaagagagcacgactcattcccaggaaaataatcgactgaaaatcttccttaagaagcattcatttgctcccatcttctcccttggttatataacacgtccttccacatatacttgattagagcttgtgccccacaaacatgcctggcatgtacattagtgacttctgagagggaggtgggggcaggaaacagtccctctggatacatttcgcatcacatgaaccagtgaacacatctctgcaaggtcctgcattctaataaacaagatttttctgtttaaaagaaaacttaagtctttcagaaaactgcatttcaaaagggaaccttgtctctgctgcttgggctgcagtgaggacagatttactaagtgctggttgctgtgttttgtcttctagtgtgggtacacacatctagaaaagttttaaagaagattggggaacccccacccagcactggtgggactttgagtttgctacggttgtgaacagaacatggaacagaggacaaggtggcccctcctgaagatgagagttttgcttcttgctggaagtccctggactcctggagtgttctcaggggacctcttaacaggatctcaagggaaagaatccagggtactggatccacacaatcaacctcacggatttctgagtaggtcattaacctatcatgcctttagcgttatctcaaattatacatggtatcatctcaactaatgtctaaaacaatatacggcatagatatctaaagaactagtggtacatggaggatggctttctacctctgagccctagaagggactgtgggccttggtttggggactctaatgactctaagtcccctggtagtgctcaagtgcaaagggaatgactgacgctttttttgaggccccttctattgtgtaaaatttattctgtacttgtgacacccacctggtccttcttctgaacatgggaaattgccaagatgaagtctccaggctaacggctcagacaggagctcagataaacatgctgggaagtggagagcaaattgacattcaaagctcctcccaacaagcttcaagaagagggtaacacaagaagtccttgtaaccaggttccacggggcagcctcaagcagagctcttggaagtccctcccaccacggtctgggtctccttctacctcctgcccttcattttctccacaggtcagaacatccagggaattcagggaaaccctttcactgctatttctccacaagctccaatcctcaggggcattctttccagttctcccgagcattcggcatcattcatgaaattctatgtttccaggtctctgtgctctggctgtgctaactcagcccccgtctgcatctgcctcactgggagcctcagtcaagctcacctgcaccctgagcagtgagcacagtacctacatcatcaaatggtatcaacagagaccagagaggtccccctagtatataatgaagtttcacagcgatggcagacacagaaaggaggacaggatccccaattgcttctcgggctccagctctggggctgactgctccctcaccatgtccaacctccagtctgaggacgaggctgagtatcactatggagagagccacaagattgatggccaggatgggtgagccacacacagtgacacaaagggaaagtgaggccaaaaccccccacctcccctttctcctcagggactcagagtcagcagtcacatgtccccttccaagtccctgagacttctgactctcctcctgcagagacacccctaggcagaggcagatgcaggccatgatttaggccattttgacaactcatcattctgtctcctcaacaccagtctgtggggaccatactaggagagaccagagcagcccaggcagaaggaccctgagagagtggccaggctgagatgaccgtgtcccagtgtctcactgtgccctgtgctcccttaccgggctctgccccaggaaaggacatggatcttgacctgtcaccccccatttatgagagttcaatgtgtgtgcatcctcgttagcacttgatattgtcagtttttccttaaagtctttcagatagagctgtagcgatatctaattatgtttttaacttttatttctttaatgacttattatgctaagtatcttttcaggtacttatctgtcctttgtatgtcttctttggtgaaatatttaatcaaatctttgcatttttaaaattcaggtttctcaggttcacatttcctcatgtatttgtatgagtttatatgcatgcatgtgtgtctatgcattccattctgtgtgatttcccaacatgtatcagcacaggtatccaccactacaatcaagacacaaaccaggtccatcacaacatttcctggtgtttccctttgataatatctacctcctcccacccagttccctcccttgcccaaccctggcaaccactgatttggttccctattcctaaaattttgtcttgcaaaaacgtgatacaaatacaaccctattgtagtagacagactttggggttggaattttttacttagcatcattccctataaagtcattggaaaggtgtgtgtatcaatagtcagttcctttcaattgctgagcagtatctcttggtattagtttaacaaaacctgatgaattactcacccaccgaagggtatctggattgttttcagtttggagctactacacctgagggtgctacgaacatcagtttgtatgtttcttgtgaacataagtattcagttctttgaaatgaaggtccaatattataattgctgtgtcatacactaattaggtctttagttttctgagaagctgacaaactgttccctgaagtgaatgtaacatttttttctggccagtaatgaaggaatgatcaaatttctctgcttctttgggaattgtgtgtttttactctttttttaggtaactattgtgataggtgtgtagtgatattccattttttaaaatttcatgtctctgatcgttaatgatgatcaccttgtcctgtgcttatttgccatctgtatgtcctctttgatcacgtttgtgccctttgcacattttctaattagattgtcttttgttttgctcttaactggtattcagtgttgggtgttttgtttttttgagacaggattttactttgtcattcagcctggagtggagtgatgcaatcacagctcactgtagcttggactttcctgactcaagcaatcctcttgcctcagcctcccaagtagctgggacaacacgcacacacactgcctcactaatcgtttacagaattttctttgtagagacaagatctccctatttgcccaggctggccacgaactccttaggctcacgcaatcctccctgctcaacctcccaaggtgttagaattacaagcatgagccaatgcactcggccagttttcactgttctttatgtattttttatactagtcatttactggatatgtgattggcaaatacttaatgccagtctgtagcttctgttcacatcctctcaagagagatttttgcaaagcaaaaattgatggttttgttaaggttcaatttatcagtctttcatttcatgacttgtgtacttggtgaagtctaagaattctttgcatagacatagatcttgaagattttctccttttttttttctttttttttgacagagtctcgctgtcgcccaggctggagtgcagtggcgtgatctctgctcactgcaagctccacctcccgagttcacaccattctcctgcctcagcctcctgggtagctgggaccacaggcacccgctaccacactcggctaatttttttgtatttttagtagagacagggtttcacagtattagccaggatggtctcgatctcctgacctcatgatctgcccccttcgacctctcaaagtgttggtattacaggcgtgagccaccgcacctagccgattttctcccatttttaatataaaaataatagtatcgctgggcacggtggctcacgcctgtaatcccaacacgttgggaggccaaggtgggcagatcacaaggtcaggagattgagaccatcctgacacggtgaaaccccgtctctactaaaaatacaaaaaattagccgggcatgatggcaggtgcctttagtcccagctacttgggaggctgaggcaggagaatggcgtgaacccgggaggcagcgattgcagtgagccgagatcgcgtcactgcactccagcctgggtgacagagcgagactccgtctcaaaaaaaaaaaaaaaaaaaacagataaataaaaaataaatctgagagatggctgagcaatttcactgagtttcatcatggaattctggcctcccaaacaccagcatggcccctgttcctacaatctcctgcttcaagatcaacccaaccctgctacccagaccagatgctagatggtcaagacagggctgtgagagctaaagaatcttcagggtccacgatgaatttacattggagcttccttttccacggatattcacatcaatagagaagatgactgagttcttgcctacctctgtgaatacctgagacatgaactgagatgtgtgtgtgcatatggtgcgggcagcacttcctcactcaatactagggagagtgtgaggaaactggatacagacctggagatagggcacatttttacactctctattaagccctgtccttctgtgctcaccaaggagtcacccaacaaggccacaacaggaagagaagcaggtttctatgaagagacttctctttttgtgatgagggcccaggaagtccactgtctagctatgaactcagaggcagaactctgatgcatctccaccatgacctgaatccctctcctctactcacccttcctgctgtcggcacaggttctgccttccagggctcagccccataagactagggatcagcctggccctgaccttcagctcagcacagggagtgacgcagtgtgtggggctctgagaatgagaccctcatcttcagactcacctctcctgtcctatcttgtaggctcagtggcctcctctgagcggactcagttgcctgcagcgtctgtggctttgggacagagggccaggatcacctaccagggagacagcatagaatacttttatgcaaacttttgtaccagcagaagctaggacaggtccctgtgctggtaatctatggtgacagcaactggcactcagtgattcctgaacaactctctgactccatatcagagaacatggccaccctgataatcaatgggccccaggctggaaacaaggctattactgtcaatcatgagacagcactgatactcatctcacagtgacacaggcagacaggaaagtgagacacaaaccccttcccacctatgtcaccctccccctccaacctcaggaggacagtggtcagagctataagcaggtctggcccagttcactcagatttgagacccccaggctgcccttccctccagccttccaggcaggctcagcagagtgtaaattaagagtggatacacaatgaattattagaattgtatttcagtttttcaagaagtagaggaatgattgaacatgttaagtggaagtatagaataccaaaaaaggactaattgagcttgtactgctaataattacagcatctgagacattaaaaacacactggatgtgattaacaacagatgatgcaacacaaaagattagcaaactcaataatgtagcactagaaaatattcaaaatgcagcacataaagaaaaaataatgatgaaaatgaagagagtgttacagtatatttatagaaaaaatgaagagtgagttataggacaacttcaaacagcctgaggttggctgggaggggtggctcacacctgtaatcccagcactttgggaggtctcggagggagaatccttttgagactagaagctcaacaccagactagacaacataacgagacttcatctctacaaattttttttaagaaaattaactaggcatcatagcctgcagctgtagtcctacctacttaggagcctgagacaggaagattgcttgagcccagaaattcaagatggcagtgagtgaggtacgatcatgccactgcactctaacctaggacacagagcaagttcctgggtctcactctgtggttcaggctggagtgccatggtgcaattacagctcactgcagccttgacttcccaggcccaagagatcctcccagctaagcctcccaaagtttctgggactacaggcatgcatcacatgcctggttaattctttgtattttttgtagagatggggttctccctatgttgcccaggctggtcacaaactcctgggctcgagcaatcctcccgactcagccccgcaaagtgttgggattacaagcataagccacgccacctgatgtgaagaaatatttaaatacaacaacctaaagtatgtataattgacatccatggaatagaaaagatgaggtggagggtcagtagaaaatatatttgaataaataatggccaaatatgttccacatttggtgaaaaccaaaaattggtatatccaagaaggtcaacaaaactcaagcacaggaaacatgaagaaaacaactccaaaacacatcataatcaaattataaaatctagtaatgaatacccactttaaagtttaattccaagagcacatctctcattagaagtaatgcaaggcacagtggaacaatatttcgaaaatgctgaaaggaaaaacttgtgaaccttctgttatttatctaacagaaataacattcaagagcggagggtaaataaaatgttttcagacacataaaaacttacagaattgatcactatcacttttggcattagaaatggtaacagacatccatagacagaaggaaaatcatacccagttgaaaagcaaattcacacgaagaaatgaaaacttcagatagggcaatgacatggatacctatagaaacccctgtattatgttaacatctatgaaagataactgttcaaaggaaaattagtaaaaaaatcactgtgatttattgtgaaaacaaaattaaattatatgacaaacagcacaaaagcagagaggagtgaagaacatgttataatggtcttataccctgtatgaatatctaatcacacttgaagacagattttggtaagttatatatgtaccattaaccctgaagtaattattaaaataaacccttttaacaaaaaagaattatgactagtagtaacctgtattaggattctccacagaaacaatatcaatcagatatgcgtgtgtgtgtgtgtgtgtgtgtgtgtgtattgagagaaaaaagagtgaaagaaatgtattttgaggaagtggatcatatgattgtagtggctgacaaggattaaatctgttgggcatgctgaagtctggaaattcaaataagagttaatgttgcggtcatgcatgcaaatttagcaagccagcacatcaggaaatctccatatttgttctaaataccttcaactcactaatgagtcccacctacattgtgcagagcaatctgcttatacaaggtcaactaattaaaatgttcatcacatctgaaaagtatcttcatgttaactcctatactggtgtttgacaaaatcaacctggcccatatcctagcctatctgacacttaaaattaaccatcatttaagccagaaagaaaattttaaaaatatttctaaaaataaatcagaaaaggaaacaatagaaggggaaaaataacgaacatatgggatgaataaaaaatgaggagcaagaaggtatatttcagtaggattatattactaatctcattaattgtaaatggtctaaatatcacaactaaaatattgtcaaattgaaattaacagcaagactcaactatatatgctacctagaataaacctacttgaaattttagaaccacaaaaagccaaatacaaatcaacgacaatcttcccaacccctggtttcccaacaaagcattacaaaccgaattcacagggattaacacatagttaaaaaatatgtctcacttccaccaacactcttacctctcttcagcctctaatgcctagatcccagtaccagagttgcaagaaaacagggcacacaaatgttaaatcaaggttactaagggtcaccctcaagaggtaggtgaaaagagaatgagggaattgaagccacaagggtcccacttgcatggggcagctcctgcatcacaatgttgattgatacattattgatgagtttttgtccatgttcatggtggacataggtctataactttcttttcttgtcatgactttggctttggtattggagtaatgcaggcctcaaagagtaagtagaaaaatgtttcccctgctgtataatctgaagaagttcttgtaggattggtatcatttcttaattaaaaatttgatagaaatttactatttaaaactgggtgagcttttcttagcaggaagacttttaattgccaattcaataccttcaaataccatagatctatttggattttccatttcttcctgagtcagttttgatcatttatgtcttttaaggaatttttccacttaagtcatttatacttttggcattaattgcttgtaataatttccctaaccattttaacttttgtaaggttggtagtcatggcactcttttatcatggttttagtactttgtgtcctctttcatgttttcctagtcagtctacctaaaagtaaaatcaataggttgtatttatctttttgaagagccaagttttgttttttagaggctgtctattgtttttttttgctatttcattaatatttggctctgatctttcttattaacttttcttttttttgctttgaatttaaatgctcacctttagcctaaatttatgaggtacaagcttagataattcattttagatctttcttctttccaacattaagcattaaatgcaatagatttccttcaaagcactgatttaagctgtatttcttaagttttgatatgttgtctttttgtgttttaaaggttcagtatcttctaatttatgttgtgttttttctttagctcatggattacttagttgtgttctttcctgctcaaataattgaagatttcccatagttcatcaggtattaatccaatttaattaattattttggcattaaataataccttctatgatattcatccactgaaatccactaagatttgacttgtaacctagaacacagattatttcaaaatcatttaaaaatgtgctaaatgtatttaaaagcataatgggtattctgctctcatgtttgaaagtgtaatgggtattctgccattgtgggtgtagttttctacaaattcaattaggataaattggctatttgggaggctgaggcgagcaggtcatctgaggtcaggagttcaagaccagcctggccaacatggtgaaaccccgtctctactaaaaaataatacaaaacttagccaggcgcggtggcaggcaccttaatcccagctacttgggaggcagaggcaggagaatcgtttgaacccaggaggcagaggttgcagtgagcctagataaagccattgcactcaaacctgggggataagagagggacttctctcaaaaaaaaaaaaaaaaaaaaaaaaaaagataaattggctgatcattcaagtctgtatcttgattgaatttctgtatagttgttgtgtggatcaatgtcagggagctactggaatgatttaacactaattttagaatttctgattgattttttgagagaggaaattttcatgggtctaagtactttattcttctgacaaaaggccttttatgatttcccaagactaatctaggaagaaaaggcagagttcaagccacagttggtgataccatgggagcactgaatgatcatgtgaggtgcctccactggttaggtgtatgtaaatgaagattttttaaaaaactaattgggaggccgggtgcagtggctcatgcctgtaatcctagcactttgggaggctgaggcaggtggatcatgaggtcaggagatcaagaccatcctggttaacacagtgaaaccccgtctctactaaaaatacaaaaaaaaaaaattagccgggcatggtggcaggcacctgtcgtcccagctactcgggaggctgaggcaggagaatggcgtgaacccaggaggcagagcttgcagtgagccgagatcgtgccactgcactccagcctgggcgacacagtgagactccgtctcaaaaaataattaaaaaattaaaaaatacaaaacaaatctgggctaatatgtccagaaattttgagaaaatgtatgttgaataaagcatgaaaatgtaaagcaaggtgattgcatatgtataacattgctaccacaaggccaacctcatgggaaagaaacaaaaactgttagcagttcattatgtttacttacacactgaacaaacatgaattgaaaccaattcaatgaactgtcccagatactgtttaggtacttgagatgtattggtgaacaaaagagacaaaagtacctgatctcacagtggcattatgaaagatgatggagtaggaaattccaggaaatggtcctttctgtgaaataactactgaagggtaagaaccatcagaattaaccataataaaatgaggaaatctagtcccacattcgcagcattgaggcaagtactgatgaagaaagaaacaggcataagaaaatctctgtcaggttaatttttgcccatagaagtaactgaacagaaactttatggatcactctgataacaaagtccttgcaaaattattttggaagagtcaactacacaaacgaataactgcacccttgagcagcaacatcagccaagaaggagtagggagacaatctgattttgagagttacaacatcacacattcaaaatacacagatttcaacaaaaacttaaaaagcagacaaagttaaaaggaagcatgacccatttacaggaaaaagtttaatgaactgaatgtactcacaaggaagcaaaggcattggacaaatgacacaaatacttcaaataaccatttacatatgttcaaaaattcaagaaaaccatgcgagtaacaaccaaacaaaactggaagaataatgttagaacaagtgaggactatcaataaagaaaaagaagttataataaaagaacccaagcagattttctagaactgagaagttcaatagctaaaatcaaaatttcatcagataagttcagcagcagtttgagcaggcagaaaaataatcagtaaacttaaagatacattgttgtaattacacagaatgagcataaattttaaaagaataaataaaatgagcagagcctaagagatacatgggacatcatcaagcatatcaatatacgcattgtgggagactcagaaggaagagaaaaaagaaagtataaaatacatgtaaaaataatggctagaaacttccaaaattgatgaaagatatgaatctatactttcaaggagctcagtggccttcatcaggttaacctgacacagactcacagtgaggcacaatatgctcaaaccatcgaaaaccaaatacaaaagaaaaatattgaaagcagcaagagaaagagactcatcacaaacagtagattctcatgaaattaacatttggtctttgatcagaaacaaaacagtccaaaaggcagcacaataatctataaagtgatttataaaaatatattatctaccaattctgcatttagtcaaacaaatcttctaaaataaaaaataaaataagataatcatagataagcaaagtttagtagacctggtagatctgccctaccagaaacactacaggaagtccttaagtctgagaaaagacactacataatttgaatacatgtgaagaattaaagatctcttttaaatataaagctagtgctgttgtattgttggtatggagctgctgtgttttccatgttatttatgagatatatggaaaaaaatcaataattataaagccatgtacataggcacaaaatgtttaaagatgttatttgtgacattaacaaggtctaaaaggagaggaaatggaactggataggaacagaattaatggatattattgagactaagttcgtagcaattctaacaattttaaaacattaatcgttactccaatgataactagtaaaaactaaattgagtgtataagggaaagaaaatgaagaaggaatccaaatggacccagaaaaaaattaatagaacacatgggaaacaattattggggtaatttaggaacaacaacaacaaaagataaaagatatgtagaaaacaaacagcaaaatgacagactttctttgttatcagtgattactttaaatataaatggattagattcaccacttgaagcaaaataacaaaatgaaatttttaaaagtaaaaaaaaaaaatagaatccatgatctatctacatggtgtttatggagaaccaatttagacccaaagacacaaataggttgagtaaatagtaacaaaagaactggtgtggctgtcgtgacatgatgcaatattgacgttaagtgaattatagttgtaagtgagaaaaaagggtattccttattgataaaatggtcaattaatcaagaagatataatagttatacacacgtatgcaccaagcaatagcacttcaaaatatgtgaaggaagacacatttaaaataaaagctagagagatctataatataaattggagacttcagtaccccactttaaaaaagaatagaacatatgaacaaaagattaatagaaaatgcagctattgaacactataatccagctagacctaacagatatatacaaaatactgcacaaaacaaaagcagaatacacatctactcaagagcacatggaacattctccagaatggacgctattttaggccttaaaacaattctcaacagttttttaaaacttgaagtcatacagggagtcatctaaaaccaccaggaaacgaagtttgggtaggggaggaacaatatttccttctactcaacttagatttattggccagcagtccctatcacacaagacagattaaaaaataaactcatgcacatttattaaatataatttttacttggcatgggagctttaataaggaaatgaaaactcagagaaatggctgaacctgaggactttacatttaggtatgatgaggagaatacaggtgtggagaaatatgactaagaatgaagtaaatgcagtaaatgggggaaagagcaaggcctgtgttcattcttctcagcacaccttcattttagaggaaacaatgctctcttttcctcttctttctaatcaacaactcaactttacagctcatggaacaagaaagagaaaagcaaacttaaaccaaagtccacagaaggaaagaaataagaatcattagaccagagattaaagaaatagatgagaaaaaaaactataaagaatataaatggcataaaaagttcctacttggataagaagaagaaaattaacaagctgttaggcaaaccaactaaaaccataagagagaagacacaaataacaaaaataagaaatttgggataatacaaccaacgttatgggaattaaaatgattataagagaacaccataagcaactgtatgtcaaatctagaagaaattgacaaattcatagaaaaatacaaattaccaatctaactgaagaagaaataaaaaatcagcataagaaatagattaagtcggcaattgacaatttctctaaaaagaaaagcccagagccagatgtcctcactggtaattctactagagatttaaggaggaagtaataccaatcatactcaatctcttccaaaaatagatgaggagggaacactgcctagcacattctagaggccagcattagcctcgtagcaaaaacaaacaaggatactataatacagaaaactattggctaatactcctgaagaataagcatctaaaattcctaaattaaataagagaaaaccaagtctaactacacattaaagagaacacatggaatgaaaaagcgagatttatcccagaattgcaaggatggttctacataagcaaatgaatcaacgtaataaacaatatcaatagagtgacaagaaaaagcatatgatctcagaagatgcagaaaaagcatttgacaaagttcatccactttcaagacaaaaacacttagcaaactaggaacagaaggaaacctgcacaaattgattaaagaagggcctttatcaaaatccacagtgaatctcacagtaaatggtgaaagagtgaaagcctccccacaaagatcagaagcaaaacaaggactcctgctttcacagctgctattcaacattgtccaagaagtcttaaatttcattaaaacaaaaaaggctagtgctacctcccaccacaagcatggatcagcgttaggaaattaaaataatggtaatagaaaaattataatgacagtgatgatggtgatggttttttaagtacacaactgaggtttagtggcagaaatccggtacttccaattacagtgcagctgtgcttattggggtgacggaatcaatctcgttttcagtatacatgggaagcaggagtacatgtagggtacaactgcatttctctggaactgtttttcacagaagagctacagtttatcctgcactctccattctgtgatcaaaaaccatgaaacagagaaaagcacttcaacctgagactcagtcacaagaactgcacctgccccaccttcccgcaactatatatgccacctctctgtgctgaaccatgaaggccagaggggttcacatgtggcacagacggaggctggactccctggtccgcaccctcccaggtgacgggtgctctgggatcacctggagaaggcaagtgcctgggctctgtcttttccaccagcagagggcagcagagctgcagccagaagagaggctggggctgcccaggaggagcctatgaaggaggccagcctttgtggggggtggtcaacaggtgttcaagggatcagtcctcactttggaagtttggtatagtccctcctgtcacctggggctgcagtgttcatattctgagggtcagacacacagcatcacccaggatactgacaggggcccaggcacagtgacggcctcagctgggaaacacaactggaggcacctgggccctggtgtcagcctgggcagctcccatagggctaggatttcctaagagacgctccgaggtcaaggtgctctaggagggggaacagtgtgaggggacagggctcccggggctcaagcccttcacccaggatggctgcctgagcctcctgccattctaagggtctcattcctccgtgtccagcagcatcctggggagctgagccctctacacttggcacttccagagacaccctaccaccccctccctctccctctccttccagctccaggccgactctgactcagaggcagctcctatgctcaggggattctcaggtgggtggcgtgggacatttgggatcctggtccctggatggggcattcccagcctccttgcggagatgctctccagagggaagggaatgttcacctgcctcaggccacagctctgaccatgggactatcctgggctcagtgacaagatctgtctggctggagggaccagggatcccccaccctccagagctcatgggtgttcagagaccacgacgctggaaccctcacagagaccaaataacctaaagttagtttctcagtcaggtctgggtttctggtgctttttacacatttatatgaaacactgatgagaaaaaataaagaatcaaagagcagaggatggcaatttctagtctattagagagatggggggtgtcatacaaggagcaactcaggtgagaaacgagactagactgtgtaatgaatccacatgagttgtggctgctcaaaggaccaaaccatggtaatggaaatcaagtttaggatataagtatcctaaagacacagaaccacattctaattaaactaccaggacaggaccaagtgagtctgggaaacccagagctgacttggaggaggaggaagatgatgggttcctggcccacctgctgctgagtcaggtgtcattgatgatctctcagcacggcccagctcagccccatggccaggctcctggaaggtccacagccctgctgagcctggcctaggacacagcacaggccaggatggtataaaacagtggtcatgtggccaaactccaggaggtgactgtgatcacaggccttcaaggatggagtctgatcttctgaccagagaagcagataaagtgagctgggacccacttcttcttcctcagtctgctgtgcttcccacagagctggtttgagtgacatccttcagtgaggagtcccagaggatgccgatttgcatcaaacactcactgcctcaaacggcctgagaggcaataagagagagctggtgagcccagctgtgctgtgggctcaggaggcagagctctgggtgtctcaccatggcctggatccctctcctgctccccctcctcactctctgcacaggtgctgcccccaagcccttccttcaggctcagaacccataggatcctgagctgggcctgcccaaacatgagttcatcccaggcacaacctcagggtgggaccccctgggaacagattcatcatttacaagcctcctctcctgtcctctcttgcaagctcctatgagcttacacagccaccctcagtgtcagtgtcaccaggacaggcagccatgatcacctgctcttgagataacctcaaagatgagtatgtttactggttctggcagaagccagaccaggcccatactggtgatatatgaaggcagcaagcggccctcaggaatttctgattttctgagtccagctcagggaacatggccaccctgaccatcagcagggctcagactgaggacgaggctgactattactgtcacaggtacaatagaaacagtgatgagcccacagtgacacaggcagattaggaagtgagacacaaaccccttcccaatctgtgtcaccctctttctccagccccaggatggctgtggacaaagccatgagcagggctggtccagttcacccagttctgtgacccccaggctgctcttccctccagccctccaggcaggttgtgaagagggtgagttaagaagagatttgaggctgtgtgacaggctatcctggggtttttctggccaaggataaagctggtgaaagagagcctgaatggacgggcagacagagtggcccatgcacgtagtggcaaaagacctgggtttccacatgccagcccttcaggcaggctctgcagagagtgggttaggaggagatttgaggctgtgtggacaggctgttttggggttttctaacccaggataaagctggtgaaagagggcctggatgaaaggacacacaaagcgtatctttcatctagtggtaaaggatgtgagttccatatggtgaagcctgggtcaccccttggcccagacgtcctaggttagtcctcagcatttccctagcacttaagttcctgaatctcctggcagccttatattcaaaacggtgtaagctggagtggacgctgtggggtccacctagactccacgttaaggtcgacccacacactctcagagcctacgagtggatacccatgctgtggggcacatgtcacctgacagagtggctgaccacccctgatctcttctttctgaccacttgggtgtttggcactatgtccatcatggacactctatgggctattaacctatgattcaaagtttcttctgtgtggtgcccgtgcccaaagaccacccacaggcttctgcccatactccacttcccccatttccaagtttttctcttgcagtccctggaacacctgcccaggtcatttcccactgccctaagcccctatctgccctggcatccggccactcacctttcctcacaaaatgaatgaccaggcgccatgccctcatgcaggaaagatgtcccctctccattgtctcttaatgccaccccttagtacacccatatagtgcagctgtgctctacttcatggtgatccagttcattgctgggctactctggaaatttttgctccatcagctgagcagagggactgctacccacacaacgtaagtgtaaacccagggagcagtgctagagcaagagagatgcaaacttggctgtggaccacccacaggttactcagctctggggccctgctcctgctccatcctagctgtgtcacatctgtctcaccagggatcgctgctggggtctgcctgagcacacgacgggggaatctggcagttctggctgcttggtcactgaatgtccgatgctgtcctgtatctaccagggaacaagagcacatggggagagttgttttccaaatgaatataattctctcttgtggatgacatggaattgttccaaatcccatgggattggaatcccattgggaaaatctcatgggattttcccatgagagattgcgtaaacatgagttttcagttcctatcataaattcttccattcctatcaccaattctgtgactatggtagagtctgctggattctgtggtcccaacagcaggacactcatacccctgcctgaacctggtgcagaacctccctgctctgggctccaaaacagtgggcgatgttcatggctcctgatatatgagttggagccacatccccaagggttaaatatgctgcctctagacaccagaatgaccttaaagctttgtgtttctttctggtgggaattgtaagatctaataacgtgctctttattttgtgagagatactaagctgctccagagaactcaatcctaaacatttcagctactacacaggatgaatggtcttagggcttgtttcgcactctcaggaatgcgtgggtctcaccaaagcttccaatagacagggccccctcatgcacatctgatccaaatacagaatagagccctaggaggttctcctgggtgttcagatggtcaaagcccctatgacaatatcatgaaaaagaagggagagttaatgaagttgaaaaaataaaagtataaacctatactgctgtctactccttgtatgcacaccgtttctgatcctgttctgagaggaatagaatgagtttctgcattgatggtgcctgctgtgcacctgtagccatgcatggtggtgtgttctatcagggtcttcatctggcacagcaatggcagatggaactaccagctgactgcgtctgtagaaatccacttccatcttccaggatccattcaacaattgtaggaatcatttcagtaaaccaaacacaagagcctcaactataactacaagtcctccaggagaggagaacgctgtctcagagggtgcattcctactggaatttctcttctctttgggacaaaccagcccagaggaggcacaggggctgtgtgtcatctggtttcctagatgaggtgtctcctcctcactgtcctgagattttgaagaaactggggagattggtgcagacactccttggatccttacaggaaacttccttcagaccacacactcctcaatttgttcccaagctccaaagtttctaaagtcactgtctaaagggcccacagtgtttttgtggagtggtggaaaagctctggggatggaaagtggtggtggttgcaaagcattctgaatgtacttactgttgctgaatgcacacttacaaatgattgaaatggtttaaaaattgttcattttgccataataaaaatactgcacactctggaggaaagtaaacctagtttaattttgaaattgttcaatggataccaatcaaagaatagtgtagcaagcaccatttcccctctcgctatagcagcaactgatccccttgtgctcttttggactctctcccctgctctctctctctcaataataagcaatgctcttctctccagtccaagctcacacttccccagttgtgcaggaatgcctattgtaactgttaatttatttccaggcagagtcctcaagattcctctgctcatattctgttctcagctgtctggagccagcatgacaagtgagccaagatcacttgtcatgagagacttgtggaaggttttgcaaaaagttccccaagaaaaaacaatgctcattgttgacagcaggtccatttccacacagtagggccatgctgggtgtgcagtggggctgtgcacactgtgcccacaggccaggctctgcactgctgactctgatcctgtgcttggtaggaccttgtgcactgctgagtccactgcagactcgaccctgaatgggaaggtggttcctagctgctgggcactgagtctcatagagggacagatggtattgaggatgcccggcccctgatgtacataaggggacaaggtctgctggtagaacaggaagatgaaggaacctgtggctctaaaggtggggtctccagccctcagtctcagctgcccatggcctcatctgtgtgcaccttgtcaatccagaccatgtgaattagaggtgaagggaattgaaggactttcccattttctcccattttctctcttggttacagaacgcacccttccacatatactgtattagagcctgtgctctacaaacatacctgacactaaattagtgacttttgaaagtgcagataggtacagcaaccagtccctctggagacatttcccataacatgaaccagtgaacccatctctgaaagccctcatgttttaaaagacaagatttttgaatttcaaggaaaactaaacctttgaaaaaaacatgattcaaaagagaaccttgccactttccattcctgcttgggctgcagtgaggacagatgcagcaagtgcttctgatgtctgtgtctgttcccctgtgtggacgcacatatccaggcgagtttcagtgaggtaggagacttcggcagcattggccgggctctggtttgcttctggtgctaacggaacatggaagagaggacaaggtagcgtgtcctgaagatcacatatttcctttttgcaggaagtgcctgggctcctggagtgttctcagggctttgatccaggccaccggctccgcaatcaacatcactgatatttcagcaggtcattgacctaattccattttagtgctatctcaaatggaaacattattttcttgtaactattcatatagcaacatagcacttaaatatctaaataacacacacagaaacagtagtctcaaatgcaaagctgtcacctccccacaccacacactttctcacccgagcccctgagcccacccttccctcggccccccctctcctgtgctgttagaaatctctgtcttctaacagggacagtgacacaaaacagccccccctcccgcccagcactcacaccgcagagcccctagtccatctcctgagggaacgtttacgtttctattctgacagagagaagtcgccgtgaatggagtctttaccccaaacccaggagtttctgaggaacacatggggtcagccactgtctgtgtggggaggcttcacctcagggaggcgcccggctctgggctgagggggactcaacgtgcactaaaaggcaggactaaggcaagtcccgggtcacagtgtgagggacgcacgcgccctgaggaggggtccctggtgctaggcctgacccaattctaaccccaggcacctttcctcagctcctgtggccctgggacacctccctaccctgcttcccatgaggctggtcacagctcttgtgagcaccgcctcctccatgtcacactttttctgtcaacattttgaggagccagttggttttctcctcattccatgttcctgtcccacctgcctgctgggggtggatttatttcatgtatgaggtttcctcagcctgagccacagctgcctcaaggacaccaaccctgtgggacactcctctgggaaaagcaaacaagtgccaagaggagcatctgaagctctggtgtgggagatgtcctccaccctgggtcaggggagtctggaggggatgagaagggaccaggggcctgggattgagctgtgaagggaaccaaaaggcaggagggacagggcaggggctgtcagctatgactcaggggaggttcctgggcctcaggatcctccctctgaggccaccagggggcgggggtggcacatgcctggacctgggaggtccctgctgggcttcaccctgggtgggtcctaggagctccttcctcctaagtccccctaaagagacagaggcattctggggtcctaaatctgtcatgcccccataaatgcatttctacgagggccaataaatgaactccaggtttatccaagcagcagcttcaggcgtctgcagacacagagcggggaggaattagccaacctgaggcaccctagaagggctgaagggggctgaaggggactgaagggtccctgtggggcctgtggtcctggggaggggagagctggggtgtctcccagccactctgggccctgtcctgacacttctcccacaaagaagggaagggaaatcctgggaccccacagccaggaccaaccgtgaaccacaggacaggaaggacagggacccccaaggctggctccatttcccaggcactgtcatgggctgagtctcaggaaatccaagtcaaggagtttcaatccccctggctgagccccactgtccaaggaaacagaagtctacgggcccaggcccaggtgagggtggggtaagaagaggagcttaggatgcagatttgcatggaggccccgccctcctctgaggcatcagggtaagacaaggctgggggcaggcccagtgctggggtctcaggaggcagcgctctggggacgtctccaccatggcctgggctctgctcctcctcacctcctcactcagggcacaggtgacgcctccagggaaggggcctcggggacccttgggctgatccttggtctcctgctcctcaggctcacctgggcccagcactgactcactagagtgtgtttctccctctttccaggctcttgggcccagtctgccctgattcagcctccctccgtgtccgggtctcctggacagtcagtcaccatctcctgcactggaaccagcagtgatgttgggagttatgactatgtctcctggtaccaacagcacccaggcacagtccccaaacccatgatctacaatgtcaatactcagccctcaggggtccctgatcgtttctctggctccaagtctggcaatacggcctccatgaccatctctggactccaggctgaggacgaggctgattattagtgctgctcatatacaagcagtgccacttaaccacagtggtccaagttcttggggaactgagacgaaaacctgccctgggctctcaggctccctttttgctctgaagatgtttcctcacccagtgcaacgggcttcctgaagcacagccttgagaattcttctccctcagcaactctcttttcccaccatgaaatccaaaggaaacctgctctgtggtttctcatccaggacagggacagcttccttttgcttgtgtgttgtggtccctgagtgggtgcaactcttcctagctttttaaattatgggagggtgacaatgagctccctgactggtgcagtccctgctgttttcaggaacatcctcatcctaaatgcatctgaatctcccactgtgtgcagaccaatctggacagatgttattagggggagtttccagaagccacatcttactcaactctgtatccaccacactctggtgaagatgcttttttggtgcccatcctcttgggtaaagtccactctctactcatgacagccatgtgtcccatcttctgaacttgggaaattgccacaccaaaccctcaggctcagggcccacataggagctcagaaagacgcactgggaaatggagaagagatctgcatccacccctcagtggagagacacctaactagataataagataaggaagtaggtttgcatgatgagtctccccttcttatgataagagagacctagagacccccttctcaggtgtgcgctcagaggcagaactctgaagcatctccaccatggcctggacccctttcctgctcaccctgctcactctctgcacaggtgctgcttcccagggctcaacccccacagcaccagggaacagcctggccctgactttcagctcatcacggcagtgatgcagggtatggcactctgagaatgagaccctcatcttcagactcacctctcctgtcctcgcttgcaggttttgtggccttctctaagctgactcagctgcctgaagtgtctgtggctttgggacagatggccaggatcacctgccatggagaggacttagaaagctattatgcacactggtaccaacacaagtcagtccaaacccctaatctcattgtatacaatgatagaaagctgtgctcagagatcactgagcgattctctggttcctgctcagggggaacagccacactgaccattactggggctcacgttgaagacgaggctatttttgtttttctggagataaaaacacattcatagtgacacagacagatagggaagtgaggcacaaaccccatcaccatctgtatcactctctttcttaagccccaggagtattgtggacaaagtcgtgagcagggttagcccagctcagctggatgtgtgaccccgaggcacctttcactctagtcatccaggaaggctctacagagggtgggtcaggagaaaatttggggctgaaaactaagctgtcctggtgttgtttagctaggtatgaattggcttaagatgacctgactggtaggacagtcacagcaagataaccattgagtaatcatgttgcctggatttccttttgtttaatgaccaaacctaaggtagctctctggtccaaaatgccctggattagtcccctggactcctcattctttaactgagacctttgatcccagctgtcatggcatcatgatgtcgtgaacagggaagtccattgtaatggcaactgtgacatcaggggtcatttacccactatctacccaaggccgcagggaatccttggcttctcacagctttttctcaccggaaaatgccattgagtgcagagtactgtgtcttccaaggatgtgccccctccataatgtggtttgggagcaatgattgcctgatgcctagattccaaagccatgctttaattcaggatgaccttgaagtgcctcctgctgagtgctcaattgtaacacattcccagaagagcctcccacacttattttctgggactatatacccgaaccctactgcatggaattcaacctctcagagtaactttccaagaaacccaaaaattaaaaactaaacaacaacaagaaaacaatatagagagaagagtatcaaagaaaagcaagttgtacaaagagagaactctggagtcttcaaatattaataagcatcaagcagcacatgtgtggacggaaactccattttcagacaaacagcagtccaaagacactcgcgggaacactccacagagcattctttctctctctctctctctctctctctcacacacacacacacacacacacacacacacacacaaacacaaaatatgaatcctgcttgttcctacagtcacagaggaaaggcctgagttaaggagcatgaggtcgaatcctcggaacagctttgcctcagtcctggagaaaatgtcagcctagacaataggctggtctggtctcaactaagtaagttaaaaagcaagttttaaaaagtaccaagtttccgagtaattatactaaatccaagaataaaagaccaaatagacagagaagtgcaagtatattctaaatccaacaaggaaaaactcaaaatgtctagcacctatcagatttccttgcaagaaccaagaaaatacatgctataaaaagcagaaaagttcatcagtccaaagtctccctgaaattgcacagatgatagactttgtaggaagaatacaaaagcgatacttataactatcttccacttgctcaagagggtacgggattgattgaacatgttaagtggagacacggtagacataaaaagatcaaagttgaacttacagaaattacctctaaaatgtccgcgataaaaataaatacataaataaataagggccaggcatggtggctaatgcctgtaatctcagcattttgggaaatcatggtagaaggattatttgagcccaggagtttgagaacagcctgggtgacacagggagaccctgtctctacaaaaaaataacaaaatcagatagatgcatggtgcacacccatggtcctagctacttaggaagtggtggaagaattgcttgagctctgtaggtcaggatggcagtgacctgtgatcatgccgctgaactttggcttgggtgatagaatgacaccgtctcaaaaaaaaaatgtctgagaataattgtagattagctcccgcaaaataatagattactgaacctgaagatataacaatgaagctcttcaaaatgaaacaccaaaaaagagaagataaaaaattacactgagcatcaatgagttttacgacatcttcaaggagccttaattgtataattaaatgaactaaaggagacaagattggtggagggagagggagggtacaaaaaccacttaaagaaataaggaaaaacgtgcaaaatttggtgaaaactataaacttatgatttcacatagtttaacacaacccagacacccacacacaaacacaaacacacagacatcatatacacaaaaaaacacacacataaagaaaacatcaacacccgccataatcaaattgcaaaaaaaaaaaaaacaaaaacaaaaacaaaaaaaaactgtgatggagaaatgctcttaaaagcagccagagagaaaagacatgtttgatgcaggtgaacaccataatgatgagagtagctttcccattagaaacaatacaagcaagaaggcagtggaggtacattcataaaactttttaaaacttactacgcacagcattgtacatattcagtgtaatccctatcaaaacaccgatgtcattcttcacagaaatagaaaaaaaaaatcaatcttgaaatttatatggaattacaaaagacactgaatagccaaagcaatagtgagcaaaaagaataaagctgcaggtgtcacaccacttgttttcaaaatatgctacaaggatatagtaacccaaattatactatactgttttatagtataaaacagacacagaccagtgtaacagaataggaaacacagaaataatccacatatttacagacaactggtttttgtcaaaggcaccaataacatacattggttaaaagacagccttcttggtgctgctgagaaaactggacattcacaggcacaagaattaaaatagacctcgatctctcaccacatacaaaagtgaattcaaactggattaaagacttaaatgtaaaacttgacactactaaactactagaagaaaacacagggaaaatagggaaaatgcttccggacttatgtgtagacaaagattttatacctaagctttcaaaagcacaggcgacaaaaacaaacatagaccaatggagctacattaaactaaaagtttctgctcagcaaagaaaacaataagcaaagtaaagagacaacttgtagaacaggagaaaatatttacaaactgttcatctggcaatggattcacatacagaataagacaataagacaagaaagcaaaacaattcaacagcaaaaaaaaaaaatgccaaataataccattaaaaagaggtcaaagaatttgaatagacatccctcaaaagaaacatacaaatggccaaagggtgtattttttaaaatgctcaacatcactaatcatcagggcaatgcgaatcaaaatcacagtgagacatcatctcaccccagctagagtgactaatatcaaaaagacaaaacataacacattctggcaagaacgcagtgtaaaggaactcttatacactgttatatactgttggtgagaaggtaaattttaaattaatacggccattatgaaaaacatgatagtgtttcagaaacactaaaaatagactatcatcatacaatgcaataatcccactactgggtatttaatcacaggaaaaaacgtcagtatatctaaggaattcctgcactcccacgtttactgcagcactattcataatagcaaagctatagaatcaacctgttttcatcaacagatgaatgcataaggaaaatgtggcatgcatacacgatgaaatactttccagtcataaacaaaagaatgaaatcttatcctctgcagcaacatgatggaactggaggtcattatgttaagtgaaattagccaagcacagaaaaacaaatgtcacatgttctctctcatgtgggagctaaaaaaagctgatctcatggaggtatagtgtagattaatagttaccagagaggctgggaagggttaggggttgtggggatgaggggtagttggtcaatgggcacaaacatacggttacataaaagcaataaggtctattgttgtatatcacacagcagagtgaacatagttaacataatttattgtacatttcaaaatacatagaagatttgaaatattcccaacatatagaaatgacaaatgctcaaggtgatggatatcctaaacactaattcgatccttacatactgtattcatgcatcaaaatagcacgtataccccataaacatatacaattataatgtatcagtaaaacatgttctttaaattaaaaaaaactgtcaattctgaattctttactcagtgaaaatatctttcagaagggaaggcaaaataaaatggttttaaccataaatatacttgcactattcatgacctgcagacacacactatagaaaataataaagaacacttctcagatagaaaatcatactaaagatgtgactctgaataaagaaaacaaaaacatcaaatatagtaactacataaaaacatatagaaatggtaaataaacatagatataaacgacttaaattacattacaaaacaactagacttaatagacaactatagaacagtccatccaacacagcagaatacataataatctcaagtgcatatggaacactctccagggtagaacctgcaaaaaaaaaatgagtaccttaaaaaaatagaaaatctataaagtatattctttgtgttacttcactcttgtattgctataaagaagtacctgagcttgggtaatccataaagaaaagaggtttaattggctcatggttatgcaggctctacaggaaatctggtgccagtatctgctgctggtgagggactcaagaagcttacaattatggtggaatgtgaatgaggagcaggcatgtcacatggtgagagtaggagagagagaggtggaaagtgccacactcttttaaacaaccagtctcacatgaactgggagcaacaactcattgtcatgagggcagcaccaatttattcacgaaggatccacgtggccccatgacccaaacacctcccactaggcccacctcaacactggcagctacatttcaacataagatttggatgggacaaatattaaaagtatataattccacccctggcccaccaaatctcatgcctttctcacattgcaaaatgcaataatcccttctcaataatcccccaaagttctaagtcgttccagcatcaagtttaacatcctaagtctcatctgagactaacctcctgtcacctatgagcctgtagaatctaaacaagttatttacacctaagatgcaatggtggtacaggccttgggtaaacattaccattccaaaagggagaaaacaaccaaaagaacaggccccacacaagtcctaaacccaatggtgcagtaattaaatttcaaacttccacagatctctagggcatgaaaagaattcagccaagctttttactaaggcatcacaagggtgaactttgctccagttcccaataactatctcattccatctgagacctcagcagcctggacttcactgtccgtatctctatcagcatcttggtcacaaccagctgaccagtccccaggaagctccaaactttccctcatctgtctgtcttcttctgagccctctaagctcttcaaacctgtactttttacccagttccaaagctgctttcacatttgcattatccttacatcaacaatctacttttggtaccaattttctgtgttctttcattcttgcatttttatagcacctttatagcaccgctataaagatgtacctgaggctgggtaatgtataaggaaaagaggtttaattggatcactgttctgcaggctgtataggaagtatggtgccagcatctgcttctggtcaggcccttaggaagcttacaaaaatggtggaaggtaaagtgaaaccaggcatgtcacatggcaagagaaacaaaaagaagaaagagagaaaggaaaggaaaggaagagagggaaggagggaagaaagaaagaaggaaagaagcaaaaaaggaaaggaaagaaacaaaacaaaaggaagaggaaggaaggaagagagagagagaggaagaaagaaagagagagagagagaagagatgagacgagacggggggggagagaggcagggaaggagagagggagggaggaggaaggagggagagagagagagtgaaagaagaaagagagaaagaaagaaagagagaaagaaaaaaagaaagaaagagaaagagagagaagagtggggaagtgccacactcttttaaacaaccagatcttgtttaaactagtggttagaattcattcgttattatgaggacagcagcaagccaatcatgaagggtcagccctcatgacccaaacacctcctactaggcccacctcctacagtggagttcatcttccagcatgagatatggaaggaataaacaatgatatcatcctctgaacactgatattgaaaaataaaaggtattatatgagaacactgtgaaaagctgcataccaaaaattagatgaaaagaaaaaatccctaaaaacataaaaactactaaactggctcaaggaggtatagaaagtctgattaacactataacaagagtttaaattagtcattgaaacctcccacaaagaacggcccaggcatgaagggtttcattgatgaatattatgaactgtttaaggaattaataataattattcataaacccttccaaaaatataagaaaggggaacatgagcagctcattctatgaggccagaagtatgctgatacaaaaacaaaagacatgaaaagtgaactggagcacaacagcctctatgaaaacagatgcaaaacaaccacacttcaacaaaatactagcaaaatataaaaaggattaaacaccataactaactagtattcatccccaatattcaagggattcttaacctatggaaattaattattttaatgctccctattaaagaataaaaccacatggttatttcaacagtcacatcaaatgttttcatgtacgcagacaggacttcctgttgttttcccattcctgttaaagcatcataaaaggcacgatttgtggtgctactggatggggtgctacttcatgcaaactggatatgtcatgtccaaccatgaatatacttagccataaatgctaaaagattgtaatttggtgtcagagacttggtggtcagtgaccacttccttggcaagtggtaagtacagacatctgaaaggataactaggatttaggtaggtattggataaggaggtgagttacacacagaaaaagtttcacttaaaaactcatagacgcttgaacacagaagatggctcaataggtctgagaaataaacaaagtccagaataactggagctgaatggaaacaaggcaaatgacatgaaccatctgtttctctctcgacaactcactggggcattgtctcctccctataccacccacgtggattgtaaaaacatctgttcttaaaactttcttgtgcatcatgacagcatgtagcacctgaatccagctcagttaaatgagggcaggacagtcaaccacaaaacccaggtggcccaggaagcacatcagggagacaagaccttgctgtcaaaagcagaggaagtgagattttccattgtggctaagcccagagcatatgaaatttcaatgggtacacaaaaaccatatagggtttggttaagctgcagatgcagtctttgcaggtttgaatggggccccagattctccatggcaaatagcctccagttgaggttgattgatgctggtcctccaaggaacacactttgggtggcttagctcctatgcaccctcctcactcatgcacagctgaaactcacctacataacgcaccttctgagaagcataagtgacctatttctcctccactaatgtgtctcagtcccttttactaaaaaggaatatctgaagttgggtaatttgtaaagaagcaaaggtttatttgggtcatgcttctgatgtctgtaaagttcaacagtgggcatctgcatccagtgaagacctcaaactgcttccactcctgacagaaggtgaagatgagccggtgtgtgcagaaatcaattggaaacagaaagcaagttctttcctaaaaatactgcaggagtttaatgatcatatttacaaagtgtttaacacagagcctgacacaccctagctgctcatgagttggcagcaattattgctgatgtcattcatgaaaattggacctcagatggagaaactgcagtgcagagagtttgagaagtttagggacaagaaagacttagtgacttaaaatcgagttctaggaactgaggagagcatccctgggcattttactgccatcttttccaatgtctcagaaactgtttcaatgtgacgtcaaccagagaggaaagcagaggggtttgcagaaccaggggctacaacttcatccacgggagagtgatgtagtaagcgggtgggaaggggcagctgagctcatctgaagggtgtttaaggttttctggcccagggatctttggccatctctccctgcccagggcctcattcttccactgaccggcaggagctggagagtggcttctgagtctggttagagatcccagcagcacccagagggggaagacattggagagacgggtctaaggtcactggagacactgtttgctgcctagagggctgcgacaggctccttgaaaacaaaattcagacactttaggggaagaaaacacaggatgggaaggctcctcaccaggggattgtggataacagagaccaaagcatctacaaggagcccagccctactggaggtgccctgaacacagagatcctaggggtgtctgtattattttgccagggctgccatagcaaagtagcacagccctatggctcaaagaacacaaatgtattttctcactattctgcagatgatgttagaatctaagatgaaggtatctacagggttggctccttctgagcactggagaatctgttccatgcctctcccagcttctgctggctgcggaggtgtttgctgttccctgccatggagggaaatcaccccaatctctgcctcacattcaaatggagtattcctcatgtgcgtgtctgtgtcacagtttcccctttttataaggacatgagtcgtgttggattgggtacgtactctgctgcagtatgaccttttcttaactaatttcaactgtaatcaccctatttaaatataaaatcccactctgaggtccttgcagtgaggacttcattatacaaatttgaggggactgaaattcaaattcctaacagtgtgtctgccatgactcaggcctctccttggggctctgcaggtgggatgtgcaccaccaacctctcaggtggggcattacctgacagcccagaaggaccccaggccctctgaaaaatgacgtctctttcatccaccttgagggacatgttttctggctgtccttctcatcctttgcatgctgacatgggagacatcatcctctgctttttaaagaaggactccttcaccttcccaatcaccccaagtagatgcccatgctggttccacagaatcaaaccacggtgggttacgagttatattagccaccagctgacaatattccctgaatgtccaggatccacccatgctctctgaccatcaccagagtgagcaaatctctgatatgtgggtaagagtttctcccatgggctcccagccgggctgtaagtgaggcaagaccccttcttcagtgcacggggctcagtgcagctgcctccctgaccaagtcttcctgggacactaagcttatcagtttctctcccccagggacagtttttggttgtcctaagcctagctcagctctgctatgaactttgcatcctaagagcccattaaacacccccttgtgcctcaatggaataacctggagtaaatagtgtgaggtgcccctgctttctgctcccagggcctcttctcctcggtggcaccagcactgccctattgaccagcaatcctcacctgcccattcaggcctctacactgcctaccgtgaacagtcacagatcacaaactgattgccaaatttgtgcagatcatcttgacagtttctgtggaactgggtgccttctcatagaaccaggaagtcacaagccaggccagctctagagaagcaactgggggagtaacatgcatcacagcgcctggacacaacaaagggattttgctgtagtcctactaggacacatcctagtgatgtctctgagaaccagtcttggtccctgcaacagaaagcctactaaacaggacagtaggctgcaaggttgggcacaatttgtgccgtgtgtgagccatgtagattgtgcatgtgtgtatgtgtgtacatatgtgtacatgtgcatttagtgttgcaaggaagggttgtgtcaaatgtcccaactcaaaacttttctgttttcctaagttatctgcttctatctttactacctttgtactatcataagaataaggataatgattagggttgaaataggagaaggaataatgtttaattattcattcttatgtgtttaatacatatcaagcactcttcaaaacaattcatatttattaaatcactcaatacgaactactccatgagccaaatattgtcattatctctccatttccagttggagaatctgtgatacagattttgacacatgggaaagctaaggcaaagaaaggaaaaggactttgcccgatgtcagaactagaaagtgcctgacccaggagcagaacctgagtcttccagtcccagagaccctgttctttaacaacagcctgtgggcctgtcactgtgctttaaggtaaagcactgacatctccctaagactccagaaagttctctgtactttttgaatcaagtaactcatacttgcagtgatttccaatgcagtaggaattctctggtgctgaggagtctactaggaatataatttcaatgcctttaaaatttttcagtagccacattttaaaagtaataaagaacgggtggaagcaactttcgtactatattttctttaactgagcttacccaaatattatttcaatatgtaatcaacataaaaatattgagatattttatgttattttcctacaacctttttgaaatccggtgtgttttacccccacatcacatcttaacttgaactacccacattttaaggactcagaagctccctgggactcatggttgctatactggacagagcagatccacatgaatgatgatccatttggatcacagcccctgcagtacttacttagaaccatcttggggcaatggagagtcctatgacccagagggcctccttagggaagaatggctgttccattttccaaccaaagtagaaatatggcgggctctcagaaaccagggaatttttacaatgtgtttcacacttcttcccttctcaaagacattgactataacttccagttcgaagataaatctgagccatcaaaggcatttttttctattggtcagtggaatgaatggcaatggtccctgtggattgtgctccaaggatccctttctgtgggaagattcttacaataaaaccaactaaaagtaggaagttattgtttatatgtagatctagatgaaagggggctgatcatgaggaatatagtattgaaggtgagtgtgttgctattcttcacaaagggctatttttgcctaactcacaagcatcaatcatttttatgaaggtgtattttcccagagtggtcttagcaagttacatccaacgctgtatcaggacccacaagcaagggtgtcagaactgacctgcctgagcggtcagcaggaaccaatgtggagactctgaggtctccacaccaccaaccatgtccaacctccagtcaagtgacaggaggagtggaagcattggttgggaagggcttggaggagctgcagtgacatgctcagccaagtacaggagcaggcatattggtgtcatgtgacctcatcttatctcagttatctcttttcaccaaactccaaggtgcaatgtgtggaggcatctgtctgtacccatggacaccttgggcttcacacattatttctatttctaatgaaccagtgttttgttaatgaattcatttcatcacatccttagtacttctaggttggaaaagcaatacatgtctctaagatattaggtaggaaatattctcccgccactcgtatttattaaagttaaaatgcttcagtatctaatgtgacagttgtccaaattcaatacccttcaccttgttagaaatggaatcctgatcctaacttgtctggagaggaggctggcatgaggagcatgaccacacatctggatgtccccagtgtcactgctaacacacgctcttttgttacttgccgtgaagggagcagagggagcatccacacctttgtccaaaggacttggaggacagtgcacctgattaaaaaatgcagggctgtgataagtgggttccgggtcctggatgagggaagagaagatgaggaggcatggggtaggaggcagggcagggaggagctgtaaggtcaggctctgagtatgggtgaaatcctgactccactcactactctctgggaggatttgataaatcttgtaacctcctgatgttggttctcccatcaataaactaaaggagaggtcgtgtcttaagcgtatgcttgctgtggggctactgtgaatgtgtggttgaggtggtgcctgcaaaacactctccaaagggcctggcacgtattaatgtctcaaaggagtcattctgcttaagctcgtggaggatgactttcctcctgtgtgcactagagggccttgttttgaggaccccagtgacttccctggtagggctcaagcacaaagggcatgactgatgcttcctctgaggccccttctattgggtaaaattcatgctccactcatgacacccacctggcccttcttctgaccttgagaaattgccaatatgaagccctcagactcagagctcagacagtacctcagacagacatgctgtaaagtggagagcagatttgcattcaaagctcctcccttcttgagcttcaagaagaggataagacaggagctcatagtgtccaggttccactgggcagtctcgaatagagctcttggaagtccctccaaccatggcctgggtctccttctacctactgcccttcattttctccacaggtcagaacatcccagggaattcagggaaatgttttcactgctattttcccatgagcaccagtcctcaggggcattctttccagttcttctgtgcattcagcatcattcatgacattctgtttacaggtctctgtgctctgcctgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcggttgagccacagtgacacagatgaaggggaagtgaggccaaaacctcccacctcccctttctcctcagggactcagagtcaacagccctgggttcctctccagtaccctgagacctctgactctcctccctccaagacacccctaggcagaagcagatgcaggccatgactgaggccattttgaaaactcatctttctgtttcctccacaacagcctgtggggaccatgctgggagagaccagagcagcccaggcaggaaaaggaccttgagagagtggctaggatgagatgaccgtgtcccagtgtctcattgtgccctgtgctctattaccaggctctgccccaggaaaggacatggatcttgacctgtcagccatcatttatgagagttcaatttttacattttttaaaatataaaaactacaatctccaagatgctaggagcaatttcactgagtctcatcatggaattctgacctcccccagcatgtcccctgttcctacaatctcctgttcaagaccaactcaactccattacccagaccagctgctggatgatcaagacagggctgtgagagcctaagaatctttaaggtccacgatgagaacacgtcaagaaggatttatgttggaacttccttccccatggatattcacatcaacagagaagatatctgagttcttgcctacacctatgaatacctaagacatgaagtgtgtgtgtgcatatggtgtgggcagcacttcctcactcaacaccagagagtgtctgaggacactgggtacagacatggagacagggcatatttttatacactcaattaagccctcgtccttctctgctcaccaaggagccacccaacaaggccacagcaggaagagaagttgatttccatgaagagccttccctttctaagagtcctggaaacccactgtctagttgtggaatcagaggcagagctctggggcatctccaccatggcctggaccctcccctgctcaccctcccgactctctgcataggtgcttcctcccagggaataagccccatggaaccaggggtcagcctggccctgaccttgagctcagtgcagggagtgatgcagggtgtggggctatgggaatgagaccctaattctcagtctcacgtctcctgtctcctcttgcaggctgtgtggcctcctctgagctgactcagctgcctgcagtgtctgtggctttgggacgtacggccaggatcatctgccagggagatagcataggtgactctgatacaaactcgtaccagcagaagccaggtcaggtccctgtgctggtaatttatggtgacagcaaccagccctcagtgattcctgagcaattttctgactgcatatcagaggacatggccaccttgattattaatggggcacaggatggaaacaaggctattactgtcgctcggaacagcactgcttctcatctcacagtgacacagcatacagtgaagtgagatgcaaaccccttcccatctatgtcattctctcccttcaaccccaagaggactgtggtcacagccatcagcaggtctggcccagttcattcagatttgagacccccaggctgcccttccctccagtcctccaggcaggttcattagatggtaaatcaggggtggatacacaactattaaatatcatcatgttccaatttttcatgaagtagaggaatgattgaacatgttaagtagaagcacagaataaccaaaaaaggactaattgagcttgtgtacagctaataattgcaatgtctgtcaactttaaaaacatactggatgtgattaacaacagattagattatgtaaaacaaaagattagcaaacttgatcatgtagcactagaaaatattcaaaatgcagcacataaagaaaaaacaatgacaaaaatgaaaaagcattatcggatattcataaagaaaatgaaggtgagttataggacaacttcaaacagcctgaggttgactaggagtaatggttcacgcctataatcccagcactttgggaggtctaggagggaggatcttttaagactaggaattcaagaccagactaggcaacatagctctataatttaaaaaaaaaaaaaaaacttaaaaattaactgggcttcgtggcttgcacctgtagtcgtacctacttataaacctgaggcagtaagattggtagagcccagaaattcaagactgcagtgagtgagctatgatcatgccactggactgcagcctgggcaacagagcaagttcctgtctctaatatagggtctcaatctgtcattcaggctggagtgcagtggtgcaatcatggatcactgcagcactgacttcccaggcccaagtgatcctcccagctcagcctcccaagtagctgcgaatactggcgtgcaccaccatgcccagctaatttttgttttttctggagagactgggtctccttatgttacctaggcttgtctcgaactcctggactcaagcaatcctccagcctcagcctcccaaagtgttgagattacaggggtgagccgctgcacctggcctaaaaaaaaattttttttaatacaacaacctaagtatgtataattgacatccatggaatgtaaaaggtatgggtgggtagaaaagaatatttgaataaataatagtcaaatgtgctccacatttggtaaaaaccaaaaactggtatatccaagaagttcaacaaaactgaagcacaggaatcatgaagcaaatgactccaaatgacataatagtcaaattagtaaaatctggtgatgaagagccacttaaaagtatgattctaagagtacatttctcattagaagcaatgtaagcaagaagacagtggagcaataattttaaaatactgaaagaaaacagctgtcaaccttaaattctttatccaacaataataactttcaaaagtggaggataaatataatgttttcagacatataaaaacttacagaattgattactatcactcttgtcattagaaatgacaaaagacacccctagacagggggaaaatcataccaaattgaaatatgaattcacacaaatatcagataatgcaactccatttgaatatataatcacatttgaagacagattttaataagtgatatatgtatcacaaagcctaaagtaaacattaaacttttttataaaagaattatgactagtaagctgtattaggattctccacagaaacaacataaatcagatatgcatgtatgttatacgtgtgtgtatatatatacatatgtgtatagtatatatatgtgtgtatatatatacatgtgtatagtatacatatgtgtgtatatatacatgtgtatagtatacatatgtgtgtatatatacatatgtgtatagtatatatatgtgtgtatatatacatatgtgtatagtatatatatgtgtgtatatatacatatgtgtatagtatatatatgtgtgtatatatacatatgtgtatagtatatatatgtgtgtatatggtgagagaaaaagaacaagagagaaactaattttgaggaattggatcatatatttgtggtagctgacaaggatgaaatatgttggtcaggctgaaggctggaaattcaagtaagagttgatgttgcagtcctgcatccaaatttagcaaggcagcacttcaggaaacctccacatttgttctaaaaacattcagctcactaaagagtcccacccacattgtgaagagaaatctgcttatacaaagtttactaattaaaatgttcatcacatctgaaagttatcttcatgtcaactcctatactggtatttgataaaatcaatctggtgcatagcctacccaatctaacacttaaaattaactatcacttaacccagcaaggaaataaaaagataatttaaaaaatcaatcaaaaaaggagacagcaaaagggaaagaaaactaacgaacatatgggacaaatataaaataaagagcaagaagatccttccagctcagcctactgagtttctgggactacaggaaggtttgtagttctccttgaagaggtccttcacatcccttgtaagttagattcctaggtattttattctctttgaagcagttgtgaatgagagttcactcatgatttggctctttgtctgtctgttgttggtgtataagaatgcttgtgatttttgtacattgatgttgtatcctgagattttgctgaagttgcttatcagcttaaggagattttgggctgagacaatggggttttctagatatacaatcatgttgtctgcaaacagggacaatttgacttcctctttttctaactgaataccctttatttctttctcctgcctgattgccctggccagaacttccaacactatattgaataggagtggtgagagagggcatccctgtcttgtgtcagttttcaaagggaatgcttccagtttttgcccattcagtatgatattggctgtgggtttgtcgtagatagctcttattattttgagatacgtcccatcaatacctaatttattgagagtttttagcatgaagtgttgttgaattttgtcaaaggccttttctgcatctattgcgataatcatgtggtttttgtctttggttctgtttatatgctggccacttctcaaaagaagacatttatgcagccaaaaaacacatgaaaaaatgctcaccatcactggccatcagagaaatgcaaatcaaagccacaatgagataccatctcacaccagttagaatggcgatcattaaaaagtcaggaaacaacaggtgctggacaggatgtggagaaataggaacacttttacactgttggtgggactgtaaactagttcaaccattgtggaagtcagtgtggcgattcctcagggatctagaactaaaaataccatttgacccagccatcccattactgggtatatacccaaacgactataaatcatgctgctgtaaagacacatgcacatgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggcgagggatagcattgggagatatatctaatgctagatgacgagttagtgggtgcagcgcaccagcatggcacatgtatacatatgtaactaacctgcacattgtgcacatgtaccctaaaacttaaagtataataataataaattaaaaaaaaaaaagaaaagaaaatgtctctagacagcttggttcctgagctgggaatcaaccgtcttttctctccctttcaacccagagtgtggcaggcgcgccccctacaggcagctaaaagagctgactgagatgccgtctccatagggagggatttgggctgagaatttgggctgaggattttcccatgccctccctggcaggctggtcccaggacactcagaagacttactgttacaggtccagagcatttctcgtcttccttttctctctccttgccaagtgaccttggaattgttcctccccatctcagccccttcccttttgtgttaagtgcagtttgcagattttgtgttcctaggtcctgtatctgtagaattttagggaaagcagtgctggtcacccacatggaattcaagacagcgagcccaggaccagaaacacagacagcagtgggggtccccacagagcagcatggtgggcaccaggtggaggtaagaaaccaggaaccactcccctgagtgtcttcagccccaggtgaactagggaggggtcagtgggctgggctcaacccaccggggactctcctgtcactgccccagcagcaccatcctggaagcccctatatgtgctaagcagctgccaaagaacttgattaattacctgtaaatttcccttcaccacacctgaccacacatgactcctgcccccaaattactaatttattaaaatggcacaattagccgaaatggcctgaatccaggacccctttcaggtttgccgctgacctctcaggtcctcacacatgccagactctttccacaggggcctgactccactgtttccaacacaaatcccaggactcatttttctctgtcagtcctgacagcagttccagagacacttccccattaagatgtccccaggctcttataatacaacctgtctgttattttctgcctaaatctttttaattatccccatagcatttacaactgtaggaatctttgcctattgttaattttattaattgattggtgttaaatatttacttaattggtcatggatgcttttttaccacagaatcacacataaaaaacagacacaaacagctaagggtgtatttctcgctgcaataatacccaccactttcacgaagacaccagggtctttctcactttttgtcccaccatccctatgatattggctttattttcatccctgctgatgtgtgacctcagggtggctgctgcagctccagctatcactcccatattcaaggagaaaagggcctcatgaatctagtgctctttcacaagagcaaagctttcctaagaagaatttcacccactgatctcacaccccactgatcaggcctgagtcacatggtcaatcccagctgagcaggacctgggaatcacaggcaccagtcttttcggtgaatatagaagacagtgctcaggtggaaggtgacagggactgtctgctgggtctgcaaacccagttttcccgcacagccaaaccagcacgatgaacaactcacttcaagaaggctgtgtcttgttcctgctgaattcaccgcatggaacgtgtcccagaccacagtgggtctggattaacatttgatgggtggatgttcttctgtctctgactttggtgcaggagtcaccactgtacgctggtcctgcatccacagcggggaccagtaagagccagtccctgagtcctgtgatccccgccctgcatgccaagccctggtattacccccatgaccacccaccgcccagacacatgtgcaggcagcctcagatggaccttcctcctcctcttccaaatattcatgttcatattgtcatgagtaatctgcacccctcgcacctggtattgaggcaggcatgagtcacaaagagaagagaaaaatttcctccattggcaccagcagtctgcagaccagggaatcagggacctgaacagaagattttaattatacacccggacccaggaggcccttgagcctccagcagccagtatggagcagccaccaggggacagaacagagtcacctggcaaagtcacttggagatagggtagacctgggtgacaaggagatgctgacatgcagggagggtcagtgaccacaacctgagatctagaaaggtgtcgtttttctacagcatcatccttaacatcgagtacaaattctccaggctttgtgtttctcagctttgtctctggccaatgttgcatatttgacacaggtgcagacactttgcttccccctacacactggcccactcttctgtgctaaaacgctgtcattgccacaaacgccatcctcccctgtgggcacatgtgtttcatcaccctcctgtttgctctgagagccccctcattctgctacacagcaaagttttctttcagcatctaagctgtacctgaccatgaccacatactgggggtacataggcacagcacctgtgccctaccctaggagctcacagccaaggccaggaacttacagcatctcctgagtctttcaacactccgtgtgcacatgacaagggtgaagtttgattgtggaaagcaccactcagaagcaatggcaggtccctgcatgtgtgccagccttacggtgtcacctgtagagtggggtcatgagggtcactgcactgggttgaaaagtgccctccagagggggagctagaaccacacctaacttctggattttgccacaaaatatttagggacaggacacccctggagtcctcaattacccaagttattctgagccagtattcaacagaggaagtaccttagatctcagaataatccctcagtcgccattgtaagtcagtccctggccatctccacgcaggacaaggaatggccacatgggcaggacatcatactacctggaaaacgcacaaagaattcctctcagagttctgcatggccagatcagctcaggagtgaggccataacacaacctacagtgacgatgtcaacccagatgatgggaccagaaggagaatgagaattctgtgtgctgagggtgggtctttaggggccccctctctctctgtcccttggggctgagcccttctctggaaaccacacagctcctcctgcagcagcccctgactgctgatttgcatcacgggccgctctttccagcaaggggataagagaggcctggaagaacctgcccagcctgggcctcaggaagcagcatcggaggtgcctcagccatggcatggatccctctcttcctcggcgtccttgcttactgcacaggtgctgcccctagggtcctagccactggtccagtcccagggctctgggtccagcctggccctgactctgagctcagcagggcccccgcctgtggtgggcaggatgctcatgaccctgctgcaggtggatgggctcggcggggctgaaatccccccacacagtgctcatgtgctcacactgccttagggctctttcatccctggatctgtgtccaggccaggcacgtgggaagatttacttggagttcagctcctcagtttcaagccttttctctcccgttttctctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgcacacagtgacacaggcagatgcggaagtgagacagaaaccagccacctcggcctggctcacaagacccttccctctctcctgccctgtcacactgagcaggagggagccttccatgtggaatggaagtttccagtcctatccctgcccttatgttcctgagagacgggagcaagttcctgcccacctctaggctcagcttatcccagaataaactgagctagtcattttgatgatcaaatgccagctcccaaaagaccccagaaaccctgatatctaagtagcaccgactctattagtatcaagggagactagccctagggtggaatcattttagtgtctcagaaggcacagggcaatggaaagtgtttatgaggtttcaggatatgcacgtgagcagttaaaggcaggtcttacaaggaaggaacctactagaattggggcccatctgtgacatcatagcacagcctggtggacacagagaagggaaggtcctgaatcaagtcttgatcagtaaatatttattggataagtgagcaatttacataggtgagaactgtgtgctctcttgagcagaacacttacctggataattggttttcaggaattccctgaagcaatgagtgacattctttattgttttcaccctcatccacctgggaaagagtatcctggaaccagcagttaacattgacacagctggtctcggtcctcagcacaaacattcattgcaggctgaaaagtgacaacggaagagaaaggagtttattaaatccctagacacaaacaaatccataagcagagatgagagatgcgggctcagctggcccagtcccacaggggtcattcctcttgtgatggaaatgaccacatgagggtcccccaagcggtgttggggggcagtcatggggaactggcctcccagggctacctgctgcttgggctgggcagaggttagagggatggaagtctggtccagtccttcccagcagcatctccaggctcctcctccctctactggggcttcccctccactccccagaaccatcattgcttcctcatctcctgtctcctccctgccccaaggccctccctgtgctcaccctggctcctccccctgctccatgcccagcctctgcagagcagcccaggcccagagacttgggcagaagcttccgtcccaccagctgcagaaccttccctacagaaccaggccagtccctgtgtctcatatttgtagagatcccaatcaccctcagagatgacgggtgggaaaccagcccacagtgacctaggctgttgggcatatggccttcaagctggccttcaagcccacttggctgcatctccttggccaactccaacatccaggctgggagtctggaatcctagttcccctggcccattcactcccactagggttgcttctaaactccctgggcctcagcttcctagtctgcccactggaagcagcgacaggcattttccagggctgcggtaagggccctggaacaccctctctcaccctctctctccctttctctctctctctctctctctctctctctccccctccccctccccctccctctccctctctctctctgcctctgtttcctcctcagtagtgggaagaccccctgtcaggtgggccagtccatgacatctacagagggagcaggaacctctcctatttcctggaggagagctggggtggaggctgcaacccaggatcatcagaggagctggggtcttcaaggttcctagggaccccttaagcgggggtcagagtggcttcagcggtcttattgctcggtccagacagaagatgtttccagttgtgaaaaacgacttcagggacaacaaaaacagagattcgcctctccagacaccagtggttggtgtgcctggagtactcctcgtaccaggcaggggagagagtcctagacagaggaggttctaagtgtcacctagatttcaggcctcggggcctgtattgggtaggtgatgtcacagtgagttgatgctctgtagccccttccctaggaggtggcagagggaagagctggtggtcctctgaggtgtgagtgagtccaaccctgagggtcttcccaagctggaggtccctgggtgtagacggaagaggttctggtcaaagaggcctggtgttgaatcctggtccatttattcatttggtcaagaaatattcatggaggacccaatatgtgccaggtgccaagccaggtgactggggacacagtgttgagtgggacagttggctccttcactgctagaggtattatattctcaagccgagactcggctctacgattgtatgtcagatatatagcctctatgtgcatgtctccagagactggtttcctggagttccaagtgacagccatcactcacctcgaatgcaaaaattaaaggagcatccaaaaacctagtgacccagataaataatacttaatgcaatattttcaaaaatcaaaattaatgcccaacaaacccacaatgaacaaaatttcaggatctgactcactcacctcagtggttttgttcttggtcctacccacagtcccacaggtgagtgagtacccacagggatgcaaaaccagagtcaggcccctgcaccgccttctgcccggccaccagagccctcccctgggtcttggcctttctcttctgaagagctccagccagttcctcctcaggcttcctctactgctggtctcttctgccccctactggattctccccttacagctgcactccaggcagctggtggaggttaaagaacagaaacctcccaaaactccaccctccagttccaggctggctccacctcatgtccaaaaaggctggtcctccaggtctttgattgctattagtaagtcccaagacacagtctttacaccaagtcgctgtgtgccttgggcaagaaactctccctctctgagactgtgtttccacactggtagaagtagctagaagacctccctgccaggttggcaagtccactctgtgacatctacaaagggagcagggatctcttccatttcctggaggagagctggggtggaggctgcaacccaggatcaccagaggagctggggtctttggggttcctgaggactcctcagagggggatcaggagctgcagagccagcttctaactctggggactcagagatccagaacctttgtcatatccccagccaatactttgtcatcctgtgcctcagactcccccagatcccaagagtgagaagctcaagacgagacaagaaagaccagccagcttgaatttagggatggtggggagtggggagctggggacccctggacctgggggagaggagtctgcagtgcctgcaggtggagtttctgggacctgggggatggagactgggcaggggactgaccagcagaaggccaaggtgggggataccctcagacatggagcagggcagaagcaactggatggggtacatccctctgctttgggagagaagggccagggcgggacccagagagctctgcagaggcaccacagaccctcagcagggggtctgccaaacaggacagctggacttggctgcttctgcccaggcctggatccagcccttgcacatctcagggcaggggataggcctgggtggccagagctgcagctgcacctgctggggaggcctagtccagtcctccagggtccccagacagactcggatttccgactgcagccaccatggaaggatgtggtctgcggtgacgatgtctatccagaggccatggcaggtgcaagggtgggggtaggggcagcagctggggatgctacatttagggacagcccctttttatccccaagacctgggactgtccctgaaaggaaccacagcttctgggtcctgagcagtgggtgagtgtcatacccacagaggggctggaagggagcagcttcagcctagactcccagggcagaccctgccccagccccgaatatccaaggagcccaagatcagaggcaggaataggccaagctccccagtggagaagctgtgctggaccaggggtttcccagggccctcccttgtgccctgaatgatgtctgttagggcacctacaccctgttactgctcagtgccttgcctattttgaaggacagggatgtgtggtgattatttgtataatccagcccccagcacctggtcctcaaaagttacccaagcaatgtgtataaagatccagcctggagatctttgaaaaccgattcgatgagtcgaaccattaagtcatgatcaccatcctcaacttcatctctttcttcctcctcctcctcattatcatcaccttcaagaactgttaagagtctgagacttcatcctatttgcagactaaaaagtaagcctgccacagtgccatggatgctggcagaagatacaagactcctgggtcagagacaacgaataatctgtttttcacagcaatagcagttgccaaggtatcagcattgtcttgcaccagttccacaaggtgatgcaaagagggccaggtgacatctgcatgccagagctcagggatcccaaatatttcatacttgacagtaagcatatatctgtgttttgctccaaagagaggcattctctgtaccttccgaggttgttcactccacaaacactcttgaaaagataatccacaatcagtgcctttgcccgagagacatgcagaaatgcagagatccatagtagaccactgtctcccaacaaccatcaactttatcaatgaaatgaagtctcaggctatttgtctgttaccatagcccacaaaaatgtctggcttgattgtcaccaaatgtatcaaggaagttaaggagtatctgacacaaaatgtgaaccaagcaattctcaaaggagcctcccaggaaattcactttaggaagtcctaggaggctcctctgagagttgctaaaacaaaacattgagagtcctagagggctgcagatctgaacttgagcagatatttttaaagattttgtggcagaaaaagaaactggaaagcaagagggcagaccctcattgcagttctgtaatgtaagggggcagagcaggggcctttctcaccagagtatggggtcctgaagatctcctcaaacatttttatactaggctctcagggcaacagaaaagatgggagcgatgaatggggcgtaaaggagtgcaaatgacacaaggggtcacatgaagcaaaagaggtttattcaaccagatttagtccatgtttaattgagccactcctttgtgccaagctctgggttttcccatgcaccaagcagtgtgttaccacctagacccagagagccatgtcatcatcagcaaagcacgccctagtgtcatgcaaggaccaggcctcagattccgactccagacctactgcctcttggccctgtgacattaaaagagtagggaatcagcctgagcagcatttcctcatcttcaaatgtggaggacagtagatgatcttagctcccaggattagtgcttgtaaagcaataataatgtaatgcattattattgtattatgcatcatattcccatattatagtcaaaaaggaccccaacttaaagcacctgccagccctctcctcctccaccactgccgaatggagccaggcacgagtattccaggtggacagacgaatagaaatacaggggacgagccccttcctagatcctagcgcagcttgctccctacttaaggaatgatattggaccctgcattcatcttctctggatggtaattttctcacctgtaaaacagagacactggccccaaggacaccccacaagtagttgtgaatcccaaagtaagagaagaacaaaaaaagaaccagaatttattcaacacccactgagtgcttagcaaacacatggtttctttaactctcataagcttcatgctgcagaggaactctccccattttacagataaggaaactgaggcccagaggtaacctaggtctagatagactccacatttatgacttcaccactcttccttgcctgaaggatatagaatcactccctgcagggctcttgcctgactcaggaaagggccacaggatagccagccaggcttaaccaacccagccaagaaagggctggtcccaactggctggagtgcagtgtacaggcacccagcctggaagactgatcagaaaagaagccacagctccagccccagccccaaccccctgagctcaagcccttggggactcctgctgggcagctctctaggccctagggagatgctccacagacccaggctgccctttgggaagtggggaagacaagtgggtcaggtgtgcaccacccaggggcggggccaggcagccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtaaggggcaagagattccaggggatgtgggggtcctgcagcagagctgggaaagggtgaccaaggggagacaagccagaggagtgaggaggaaggttaacccctaagaggggcctgggctgacactggctttagtaatgggttgatattttgtccatcacagatttgtttgaattactgtttttaatatcatattacgatattatttttcttgatttctgagttttctggcgccacttaaattttcaccagggtcagtgcctcaatcacctagtcctagtcctctgggtagggaaggaacagaggcagggacaggacatccacagggggtggtggccactgtccccacagggtgcccaggcctgttcctccccctcctcctctctgcccatgtgcctcctgcccagtgagggcaggggccactccctggagaaggcagcaagggcttggtttggtctcccccaaggctgtctgttcaccaacttgcacataaatgcttactggggccaggctcaaggacacagggagggtgggatgaaccgaggggagctgtccagtcattggaacaggcccacggcccatgtttggagcaataaagggagaggggatctccctctgggatgatgcccaggctggtctcacagatcgaggggcactggctggtgatgggtgcccccaaaagacagagcagcgtcagaggagaggagagcacaggatgaggctgggagctcctgggtgactgggaaggggaggcaagaagaccatagggtccgtgcaccattcccagtccaggacgagtccttggatggatttaggtagattgattatcagagtcagatttgtgtttttggaaaaatcagcaccggattggaggctgatgcgacgcccgattagaggagggaggagagggggtgatggccaagtccagggtaggtggggatcctggaggaagccgtgccttggggatggggaggacactcagattcagagcacccaggggcccagtttcctatgaaatgggagcatgaagttgaagtgagggctgagcagaggggagcagacacgctcggggactgtctatgggcattaaaaatgtataaccattttagcaacaggcggcgagtcaaaaaacaaagtgtgtttatctaaactgggcaattccacttctaggaatttatcctaagggttggttgggggaataatcaaagctgtaaccaaatctttataacaagggtggttagctcagcattattagtgatgggagaaaactggaaaaaatccaaatatctaccagaaagggtgtgaaaaaacacaattgtatttgggggactgttgttgtttttgttttgaaacagtcttgatctgttgctcaggctggagtacagtggcgtggccacagctcactgcagcctcaacctccagggctcaaaagatcctccagcctcagcctcctgagtagctaggactacagatgcaggccactacacctggctaattttgattaggattattattagtttagagacagagcctcgctatattgctcaggcctgtctcaaattcctaagctcaagcaatctttctgcctcagtttcccacgtgctggaattacaggcgtgagccactgcacctgacccaactgtgtttttaaagtatatatgcattttcaaaaacctgtcagaaaatatagaaaaatgtcaatggtgtgtctggctggctgatgggatttcacctaattttaatgtggctttataattttctggttttgtgaagttgttcacaaaaagagacatttcttctaatataatttttaatacaacagtaatgtactcatgtgcattactctttttgtaatgagtatattacaaaatgtaatgacttttgtacattactcttttttcttgccaaaaaaaaaaaagattaagcagagaagtatataaagtaaaagcaagtgcttctgcttaccatctctcacctcttcccagagatagccactgtcaggttggtcaatatacttccagaacttttcctgtgtgtgtgtgtgtccctgaaaacacacacacacacacacacacacacacacacagttggtgctgggattttattttgcaaaagtaagagccatattctgcatattaccaacttttaatctattattgacactttctgtatcagtccatatggattaaccacattcattgcttataaactttgttttataagcaaagtttagatgagccagaatttatttccactaaaaaatctaaatgacaaatgatgctgcagtggaaatttgtgtgtgtgtgtgtgtgtgtgtgtgtgtgtgtgtgtgtgtgtgtgtatgtgtacaaagtgcacttatatatctccccaggatagatgcctaaaagtggaattgctggatcagagagaatgtacttttgaaatcttataggtagtgtttccaaaagtctgtgtccactcactccggtgaatggtagtgccttcgctcctacattcttaccaataatgcaaaattgttgatctttttatattctgcccatctgatgagcaaaaaattgaatgtgtttatggttttattgtgtattttattactggtgaaattattttttatatttttatttattggttttatttcgtctgtgaattaactggtcatcatgttgcccgcctttccattcagttgctttcatctttttatatatcaataacatattgggatatatttgggattttaaccacttgtttagtgtatgtattgtaaatatttttccctggtctgttttacgggtcttttgtttatggggtctcccaccataaaactgtggtaaatttttatgtgtcgaactggtttaatcttttctttatggtttctgtgacctccaccatgtgtaggaagttgtctttatttcaatattataaactcatttttctgttttattctggtacttttggtgtattggtgttttatttttttttctttacttcccctggagtttatttttgtggatgtaggaataagaccttattttccaaataggaaagccaatcatcacacatttgttgaatataaatgcaacttttctcaattactacattactgatttattacattctttctgtggttctcttggtttattgagctattcctgcgcccaccctgttttgattattttagctttatggtatgttcggtaactggtagggaaagaacccgtcattgttactttttctcaaaatagtcatgtctattatctgtcattcttagagttggactgcagaattggttctctaattttcaaaaatcattcttgtgttatgtggtaatatcacagaatatgggattaatttgagaactgctatctttataatgctcagtgtttttgttcagagacatgatgtactctccattcactcagataagtggtttaatattttattcatgcaaatcttgcacactttgttttttattcataaagggtttgtaaatataattttattgaagttataaattttttcacaattttatatcgtaaatgattactgtttctatagcaaggaaccctattaacttttctatgttgctcttgtatccagacactttaactcttgtattaattccagcagttcttcagctgattctccgtgtgtgtgtgtgtgtttgtgtgtttagttaactatcacaccatttgccaagaacaattttctctctttttctgtaatatttatacctccttctctcccccttttatgtcatttcattggctggaatctatacaatatgctgaataataaaagtgagactagacaaccttgccttgtttctgattctttaaatgttttgcctttaaatatgaaggttgctgtaaatttggggagatattcttcactgagttaagaaaattttcttcagtaacttaataaaaggctaaatgtttgctttctttatatgagaaacaagtgttgaatttatattactattatattaaattctgtttcaaaaatcttctgcacatgtcttaaatacaaatgtattaaatacaagctgctgctaagatgaaagttgctggccccatcacaatgggtatcttccaatgtgaataaattgccttggggaataaaatcagatttggaaaaacctgaggatggttgccatcataaactcttagagtgtgacctgggtgtttttctttttctctgtaggatgttaatagtatcttgtgtcatgctaggatgtctaggacagagggcaatacaatgaggggaaggcattctgcgatgtccccaggcctctggcttgaagagtaacttgctgaagtgaggactctgtggaggagcaagttatacagaaagaagtttagttgtgatctgttgagttggaggtgtctacagggcatccaagcagacataggttgaggaggcagaatatatgtgaatctggagccaagaagagaggtaagggctggaaatagggatctaagacccctggacagttgtgagtgtgcacaatgagggtcagatgcagagaaaattaggagactacagagagcagaacccagggtggggatctgggagtcagcagttgggcatgggcctggtagaaagggaagccaaggaggaggagagggggcagtctcagacaccaaggaggggagagtgactagaaagaaaaccttcttgcagagacataggggatggggaagaactgcagactgaactggggcaaaggactgttggccttaaccagagagatttgagggagagatgaggctgagagccaggggatcctgccatgtcccagcataaaaacagtacctgacacagatgggtgcttgggagctgttgtcggatgaatgagtggacagatgcatggatggacggatggatggaaggatgatagattgatggacaaacagatgaacagatgaatagctggatggacaactggatggatgggtagacagaatgatctcagagatcagaaaaagcttcatgcactaagtgggactgaaccgcgtctccatgggtagaaagcagaggaatctccacttgagtcaggaatgacccagtgctctcaatccagggagaaagccagcctggcttcactggggacacttgtgtgggggactcagaggccctttaaatgaggccagacgaggttggacaggtccaagccaactcagcactcctctgccacactgcacaggaggggatgtgtcactcagggagttgctgggacctatgggtcccagtgttgtcatcagcaccgacagcctcagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagcccagcccccagagagcagaccccaggtgctggccccgggggttttggtctgagcctcagtcactgtgttatgtcttcggaactgggaccaaggtcaccgtcctaggtaagtggctctcaacctttcccagcctgtctcaccctctgctgtccctggaaaatctgttttctctctctggggcttcctcccctctgtcctcccagccttaagcactgacccttacctttctccatggggcctggaggaggtgcattagtctccgggtaaccggcaggaagggcctccacagtgggagcagccggatgcagcctggtcccggggcctgagctgggattgggcagggtcagggctcctcctctcttccagggcagatgtctgagtgagggacagaggctggttctgatgaggggccctgcagtgtccttagggacattgcccagtgactcctggggtcaaggacagaggctgctggggtgggcctgggagctgctgagtctcatagtctaggggagcagccccaagaacagctgagggtctaggctgaggactggatgccaatccagcctgggagggccacacggcctggtgacacagaggtcaccccaaggggagaccaatggagggcacagagagggctctgggtctaggctgcagctctgtggcctgtgctgggtcatgaggacatggggacacagagggacgggtgagactgggtgaggtgccagaatccaaccctcccaggacagtcaccagaaaggagacagtctcttagggcagagatgtgtctgtccctggagccccgtcacctctggggcccagtgtctctctgttcacggatcggcctcctgccttcctcaaagggcatgttagactcaggaaatgaccagaggggagtgaatgaggggtgcagagaactccatggctaccaggtgaagtttggggtcatcacaggctgctggggtgggcctgggggctgctgagtctcatagtctgtgggagcagccccaggaacagctgaggtgaagggttctgtggtcgggcttgtggagacaggaaacatctcagagcctcagaggagccctgaggcttgtctaggtggagcccactccttgccaggagagccaagtgggctgggctggggcagagcccggtgcctgtgagggataggaagctccagttcaaagcaggcttgggtctccccacacactgcctgccaggacagtcctacaggatgagcaggggacccacagttcacggaggaggctctaggtcctggaagaataaagtgggtgatggaggggggtatagggatggaaatgagggatccaggggtcaaggccagattctaaactcagactccagagatcagagaagaaggaacacagcctgccctgggtatatggagaaattgaggctgtagaggagaggggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttccctgtccacacaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccagaaatcttgttttatctcattttttttctcacataaattgctagcctccccggggttctcagtgtggggtacagggaattctgcacccagtgtgaaaatcacccaagggaggaggctcacagcctccctgagtcatctccccagagggtccttcctctcccagtcaccccttctccaactctccactgtacccctgagctaccagtctggcatcagttcagaccagtcccacaccctcctaaattttacttctcaataaatacctgatcatgtaaaacgcagcatttctaatgtgcagtctctgtctggtcatgtgtctgggctgaagggtcactgctcagggacagggggcagttccaggtgagatcccatgtctccgtcatcccacaccccacccaacctgccagggaaccgggtgagctccctgtgccagtgggaactgcaatccaaggcacaaaattgtcctgcagtccttgcccacctgggaagggacaggggcccagtgagaggtttgctggcgccctgtggggagattcaggagaaatgaagggggtccccggagaccagatgagggctagaggcagaaataatggaaaaaggacacccttgactcaaggccacggtctcagcaggaacagaaggtgaaattccccattgcatacgaggaaccagtcaggagagtgtttactgggtgagggataaataactgtgctgccactgggaacttgtaaaaacattgggaaaggaaacatgcaagtgtctttctaagacttgtacaatggacattggctaagtaaacatactgacaagtcctgcactagggaaccagtttaatatgatgagccacagcatatccaaaagcatgttgatctccttcttcacctttagaagacccaaaacactctgaaagataccagcgtttcctggaactagtttgtggaatatggggtgaggttgatgcacatgatgttacgggtatatgatcacatggctgtgggttggggatcaggctcaaagttaacactagcgtggggctggatgtcaagcatgaagggtgtggaccactaagtcaggcccaggtagagttaatttctgattggtttgtggctggagcttgatgatggtcagtctgcaggagcaggaggatgtggggaaattgggaaaatgagaaaagtcacaaatccaagctcaaactctgcatctattgattgcctgggggaggctaatcagagttgaattcaggatgagcttcagggctgggtcagactgaataagagctgagtgaatgtgggctgatggctccaggcaagtcctggcctccactaggagtcagatcccacaaaccctcctgcccgcagagcaccctctccctccgtagctcatggtggcgcagcctccccaccccatcccatgtacacctgctgcctcatctcagagacactcattccagtgtctctgacagcagatgatgtcagcctcctgggtgtggagaccccagctgtcttggagagtcctcagtgcctgggtactctcagaccccctgtctctgcctccagcacatcagagacatagcagctgcctccaccagagctgctgggtgatcccaacaggccagggacagagcctgcaaagacaggaatctctgcagtcacaatgaggcaaagaaagagccccttagagcttgatcacagccacccctgatccaaatcccagcctctcattagaaggaggcttgagggttctgttgccacagcacctgtctgagcccatttcatggaggggaaaactgagatgaccaagggccagatccatagtcctgctgggcacaaggccatccccagcagctgcctaatctttgactgtgttataagtttccattatggaaaactttgaacacatacataaggagacagagaaataataatgcccccaagttcccatcacccagcccccccaataagcaattcacagacattactgacccacccatagcagaataacccctccattacacaataccagacatcacatcttttcagctgtaaatatcccatttctatgctggaaagatatgggcttaaaagtaactgcaatattattaccaaacctaaatagaaattatcactaattccctaatatcaagaaataatcatgggctcctcaaatccctcacaaatgccagaagcgtattgacttagttaagtgttggtgctgtggttattttggggttttgggtggtttatttcagaattcaatatggcatcaaatggtgatgggcgcatgtgctgtcaggccagttgtcactggtgaatatttcctcaattgctctagtgctgcctggcaaggcaggagctgcaggagttgagagctgtccggggaccttcccacggttggaatacagccacacctcccaaaacaagaacccagggctatcatctacttctttttttttccccctgcaaaatggttctagcatggagggacttaactggattcagactagacattgcaaaatagcttccaaggacagggagctgctaacagcgagatcacccatgtcagattctcactcttgtagtaatgttagctgcataggatggtcaatagctacatccctcagaagggaaggaaggcagagggatgaggcttcagttcacctccttctcatgagtgctgcagagcatctgtgaattcagaggtctgcagctgggctctgttcacccaggagtgtgcttcatgctctaggaaggagccactttgcacacagatgatccggggcccagccatccttccagggtgaataattaatgtcttctctcatggtgaactctaggattcaagccatctaatgtttttgaagccactgtcattatatttaattgatgatgacaggtggccaccaatgatgaatattttcccagggggagtctccctaagtggctttagacttcctcacatggccccaggggattaaatggctcctgattactcagaggataagaggttctgtcttatcatgttcctttcttatttgtcttatgtgtctttcctgccccaggcctgggatcccccactgatctcccttcccttagtgagaggtggtatttggagaccacattctggaggctcccttatgtcccccatttgaaaaagacaacggcagccaccaccccagctgtcccacccaacatgaggccagattcggggtgcagggatgctcccaaggttaccctaacagatgtgactggcacttcatattgggaccagccaggcctcactgaccaggcctatccaactagaactactccagaaggtggggctgaaacccaccaaggttcccagaacactgcactctagggcaatcagcctctgcatgggaggagaggggcaccctctgcaccaccccatggtgttaccaaaagttgaaccatgggttggttcaactttgcagagaagagaccacctaacccatctgtggaaattcactccttagcgatactgatgctccctaagaaattcaatcctgggcctgagtgatggttggtgcaaaaaacaaattcaagatcccagtgtcctccagaagcctggatttccagggatcctgctgtgagtcacaggacgtcaccggtccccttctctttgtgggttgagtgtgggggccatgtggactccctcatgagcagatgccaccagggccactggccccagcttcctccttcacagctgcagtgggggctggggctggggcatcccagggagggtttttgtatgagcctgtgtcacagtgtgtggtattcggcggagggaccaagctgaccgtcctaggtgagtctcttctcccctctccttccccgctcttgggacaatttctgctgtttttgtttgtttctgtatcttgtctcaacttgtggtcagcctttctccctgcatcccaggcctgagcaaggacctctgccctccctgttcagacccttgcttgcctcagcaggtcactacaaccacttcacctctgaccacaggggcaggggactagatagaatgacctactgagcctcgtctgtctgtctgtctgtctgtctctctgtttgtctctctgtctctctgtttgtctctctgactgtctgacaggcgcaggctgggtctctaagccttgttctgttctggcctcctcagtctgggttcttgtcggaacagctttgtccttgggttacctgggttccatctcctggggaattgggaacaaggggtctgagggaggcacctcctgggagactttagaaggacccagtgccctcggggctgatgctcgggaatcacagagctgggacccagagccaggatccagacccagaatgaggtaggaggtggaggggctgccctgggcgtctgggggctgccagggactgagccctgagccagcctgagactcaggaaaccccgtcaggagggagaagggagaagcagactctggacaccagaaagccaggggaagggtcacaaaaggagtggatgtgacggaagggcgggctcctgggtctcttcagaacatatcccctgtgcccagggggatcagaggggcagagtccactgcgtgaaagccccactgctatgaccaggtagccgggacgtggggtggatgccagaaaagactccacggaataagagagagcccaggacagcaggcaggctctccgatccccccaggcccttgccccatacacgggctccagaacacacatttggctggaacagcctgagggaccaaaaggccccagtatcccacagagctgaggagccaggccagaaaagtaaccccagagttcgctgtgcaggggagacacagagctctctttatctgtcaggatggcaggaggggacagggtcagggcgctgagggtcagatgtcggtgttgggggccaaggccccgagagatctcaggacaggtggtcaggtgtctaaggtaaaacagctccccgtgcagatcagggcatagtggaaaacaccctgacccctctgcctggcatagaccttcagacacagagcccctgaacaagggcaccccaacacctcatcatatactgaggtcaggggctccccaggtggacaccaggactctgaccccctgcccctcatccaccccgcaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaatcttgttttatctcattttttcttttctcacatataattcctagcctttcctgggttctcaatttgtggtggaaagaaccctgaacccagtgggaaagttgcctatgtgaaggggttctcagttccctgggcatctctgcaggtaaggccttcctcacccagacaccccttcctcagctctccactgtacccctgagccaccagcctcgcctggctgggaccaggggggtgtcacactctcctagattctgcctttcaacagaaacctaaccacgcatcacacggcacttctcgcatgccttctgtgtctgctccagtctctgggctaaagagttgctggtccgggacaggggataggtccgctcttggtcagatgccaggtccctgccatggcatccctgaccctatgcaacaagccagtgactctggtgagctctctgtgtcaggagaatccatgatccagagtttcatattgtcctgcaagcatctggtgggctgtagctcttgccaaactgggaaataccatggcccagcatcaggatgcaggacagtccggagagggaaatcaggagaagtgaaggggtctctggggagcccagatgtgggctagaggcagaagtaagggtgaagagcacctatgagtcaatgtcatggtctcagcaggaacacagttgaaaatccccattccacacaagaccgtttagcaggaaaggagtccatacttgtgctgccaccaggatgtcctgagaagccttggagaatgaaacatacaggtgcatttcctagacttgacaatgcacgttagccaagtaaaggcaatgaaaagttctctactagggaaataatttcctgtggtaaagcttagcttatgtaaagtcacatttatccatctggcacctctaaaagccccataatattctgcaagatactagtatgtcatggaagtagtttatgaaacataaagtgagatttaagaacaaagatgttacgggtgtatgataagatggctacaggctcagggtcaggctcgaggagtgaaggaggccgtgtcaaattcatgacaagagttggagctgggccaggctgggtcagggctgtgtgaatgcagacagagggctacaggcaaggtcaggcatccatgaacactcagctcccccagaccctcctgcccactgggaccttcgccctcccttggtcacagtggtggagccttcctacccaaacctctatggaggccctggatgactgtgcgttcttagtgcccacgcaaacttagactccctgtctctgcctccagcacatcaggaatgtggcagctgagttcaccagagctgctgggtggtcccgacaggccagggacagagcccgcaaagacaggaagctctgcagtcacaatgaggcagagaaatggccccttggtgcttgatcacagccacccctgatccaaatcccagcctctgaattagaagaaggctaaaaggttctagtggccacagtccctgtctaagcccatttcacaaatgagaaaactaagaccacccaaggagggccagttacgtaggcctgctgggtacaaggccaaggtctacttcacacccagcagctgtccaaagactgagctgtgtcataagtttatattatgaagaactctgaacatataaataaggagacagaaaaataacagtgtcccatgttctcatcacccagcactcaaaataagcaattcacagatgatgccgacccacccacagcaaaataaattctcccttacacaacatttagaaagaaatacaagacatcagatctgttcagctgtaagtactccattactgtcctggaatgacatggaccttaaaataactataatatcactaccaaacctaaatagaaattatcactaattccctaatatcgagaaataagcagggtctcctcaaatgcatcagaaacaccagaagtgctttggcttagttacatgttggtgctgttggtatttgggggtttaagtttatatgaggagcaatatgacatcaaatggtgatgggtgcatgtgccatcaggctggttgtcactggtgaatatttcctcaattgctctagagcctcccggcaaggcaggagctgcaggagctgagagctgtctggagaacttcccctggctgctatacagccacgcctcctggagcaggaacctagggcttccctcagcttttattttcctggaaaatgattctagcatgaaggggattaacttgattcagattggacattgcaaaatagcttgcaaggacagggagctgctaccagcagagtcacccatgtcagactgccactcttgtagtaatgttagctgcataggatggtcaatagctacatccctcagaagggaaggaaggcagagggttgaggcttcagttcacctccttctcatgagtgctgcagagtgtctgtgatgtcagaggtctgcagctgggctctgttcacccaggagtgtgcttcatgctctaggaaggagccactttgcacacagaagatccggggcccagccatccttccagggtgaacaattcatgtcttctctcatggtgaactctaggattcaagccatctaatgcttttgaagccactgtcattatatttaattgatgatgacaggtggccaccaatgatgaatattttcccagggggagtctccccaagtggcttcagacttcctcacatggccccaggggattaaatggctcctgattactcagaggataagaggttctgtcttatcatgttcctttcttatttgtcttatgtgtctttcctgccccaggcctgggatcccccactgatctcccttcccttagtgagaggtgatatttggagaccacattctggaggctccctcatgtcccccatttgaaaaagacaacggcagcctccaccctagctgtcccacccaacatgaggccagattcaggggtgcagggatgctcccaaggttaccctaacagatgtgactggcacttcatattgggaccagccaggcctcactgaccaggcctatccaactagaactactccagaaggtggggctgaaacccaccaaggttcccagaacactgcactctagggcaatcagcctctgcatgggaggagaggagcaccctctgcaccaccccatggtgttaccaaaagttgaaccatgggttggttcaactttgcagagaagagaccacctatcccatctgtggaaattcactccttagcgacactaatgccctctaataaattcaatcctgggcctgagtgatggttggtgcaaaaaacaaattcaagatcccagtgtcctccagaagcctggatttccagggatcctgctgtgggtcacaggatgtcaccggtcccctctctctgtgggttaagtgtgggggccatgtggactccctcatgagcagatgccaccaggaccactggccccagcttcctccttcacagctgcagtgggggctggggctaggggcatcccagggagggtttttgtatgagcctgtgtcacagtgttgggtgttcggcggagggaccaagctgaccgtcctaggtgagtctcttctcccctctccttccccgctcttgggacaatttctgctgtttttgtttgtttctgtatcttgtctcaacttgtggtcagcctttctccctgcatcccaggcctgagcaaggacctctgccctccctgttcagacccttgcttgcctcagcaggtcactacaaccacttcacctctgaccgcaggggcaggggactagatagaatgacctactgagcctcgtctgtctgtctgtctgtctgtctctctctctctgtttgtctctctgtctgtctgacaggcgcaggctgggtctctaagccttgttctgttctggcctcctcagtctgggttcttgtcggaacagctttgcccttgggttacctgggttccatctcctggggaattgggaacaaggggtctgagggaggcacctcctgggagactttagaaggacccagtgccctcggggctgatgctcgggaatcacagagctgggacccagagccaggatccagacccagaatgaggtaggaggtggaggggctgccctgggcgtctgggggctgccagggactgagccctgagccagcctgagactcaggaaaccccgtcaggagggagaagggagaagcagactctggacaccagaaagccaggggaagggtcacaaaaggagtggatgtgacggaagggcgggctcctgggtctcttcagaacatatcccctgtgcccagggggatcagaggggcagagtccactgcgtgaaagccccactgctatgaccaggtagccgggacgtggggtggatgccagaaaagactccacggaataagagagagcccaggacagcaggcaggctctccgatccccccaggcccttgccccatacacgggctccagaacacacatttggctggaacagcctgagggaccaaaaggccccagcatcccacagagctgaggagccaggccagaaaagtaaccccagagttcgctgtgcaggggagacacagagctctctttatctgtcaggatggcaggaggggacagggtcagggcgctgagggtcagatgtcggtgttgggggccaaggccccgagagatctcaggacaggtggtcaggtgtctaaggtaaaacagctccccgtgcagatcaggacatagtggaaaacaccctgacccctctgcctggcatagaccttcagacacagagcccctgaacaagggcaccccaacacctcatcatatactgaggtcaggggctccccaggtggacaccaggactctgaccccctgcccctcatccaccccgcaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaatcttgttttatctcattttttcttttctcacatataattcctagccttccctgggttctcaatttatggtggagggaattctgcacccagtgggaaagtcacccaagggaggaggcttacagcctccccgagtcatctctctggaaggtccttcctcttccagtcaccccttccccaactctccaccatacccctgagcctccagcctggcctcagctcagaccagtcccacaccctcctcaattttacttctcaataaagacctgatcatgtaaaacccagtttccaatgtgtcgtctgtgtctggtcatgtgcctgtgctgaagggtcactgctctgggacaggaggcagtttcaggtgagatcccatgtccccgtcaccccacaccccacccaacctgccaggaaaccgggtgagctccctgtgccagggggaaccatgttccagagcagaaagttgtccctgcagagtggtccctgaaatgcagttcttgcccacctgggaaggatgtggagcctagtgaggacagagtggtggccctgagcagggcatcggggagaaacgaggagtgttccaggaccccctgctttgggctagagacagaaaacccttgagcccaggccaagatcagagcagaaacagggttgaacttccctgtcccatccatgatacccagttaggagaccatttactaggtgccatcaccttacgttacattacaacattacgtgattgtgccatcacccgggagacatgaaaaaggctggaaaatggaacccttcagtgtagtttacactttcacaatgtacgttagctatgaaagatgctgacaagtcctgcagttggaaaacagttcatgttacataaccttgcaagtcaagaattctattcagtgtcccaacccacttagccctagagcgctcttcaagacactggtgttcatgtcactagtgctgggacatgggctgaggctgaggcacacagatgattcgttgtgatcaaatgggtcaggctcagggttaacactggccaggtcagaaagagagcatagggctgagatctcaaccatgaagagtctcgaattctaaagtcaggggacgcagtagagttagattatggttatggctggagccatgatggccagcctgtgtgagggtaggactcaggtggactgggtcaaatgagaaaggcaccatcccaagcatagaatcggcatccattggttgtctgatggaggctgtgtcaaaatcatactcgcccaagaatcagggccaggtcacactaggtcagggcagggtaagtgtgacttaagggctacaggcaggtcaagttttcatgggactcagctaccttagacccctccccaccagggcctactccctccctcaatcatgtggttcagcccctccatgtgcacctacaccctgatgtcagagacacaatcatcccagggtccctgacagcgagtgaggtggccttgggagatgcacttcccagccctcctcatcagtcttgggcactgtcaggccccttcttggtgcctccagcacatcagcggtgtggcaggtgccttcaccagagctgctgggtggccaggccaggcctgagacagagcctgcaagggcagagaactctagggccatagtggggcagagaaggggttcctcttggagcctaatcatagaacccctgcctcaagtcacaacctacaagttagaaggaaacttaagggtcctgattcccaccaccctgtctggccccatttcatagatgtgaacgctgagacccctatagcaaagaggaccgctttgatctccaccttctcaatggccctgctgggtaggatcccctctggatgtcccctggtgctgtcccaagactaatctctctaattactgccttgtaagatattacggaaactgacagcaagaaaataaaaaaacaggaggataatacagctcatgttgacccacccacaatcaagtaacctcttttacacagttgtttgaagcaaattgtagacatcatgtccattagtctaaatattccatttgtgtctctaaaaatatggacccccccaaaaaaactacattcttacaaacctaaatataaatatctaattctttcatatcaaaaaaagaatgtttcccatcaaatacttcacaaatatcctatgcttctttcactagacctgtgtttgtgttgttattctgtggttttccatttcatttctatgaggattcaatatggtttgaaattgtgactggtgactgtgtttttagacctgttctgtctgcaggtatcttcctcattgatttttaatttccttgcaaggcaggagctacaggagctgggggttggtcccaggaccttcccatggtcaggatacagcctgtggcctccccaagctggaaacaagcgctcctctctgcttctgcgtttcctgaaaattggttcttggccagaaaggtttaacaaggctcagtgtgacttttcagcaagaccgcttggctactgggctcccatgtggggtcatctatttgtgacgttagctgggcttcacactttgtatccagtgccattagatggtatatggatgcaaggtgactgcatttcagttcgaccaccttttccttctactgactgtctgtaaaaggtgtgccctcatatgttctttgctcctctgggagtgtgattcttatttcagtaagaaatagcatagacatgttgagtctttcctttcatttagcatcttaataatgatgaccatgttgcctgccatctcgtgaagatgaacaattatttcatggtgagctcaaagttatgttactgtatgtgactcacttgagtccaccatggttctattttattgatgatgacaacgacccaccgtggcccactcagtgcctcttctggtggccccaggatcctcctgaaggaacccaggagacctcgatggctttccactctctgttcacaatctatcctgggcacatctttctcctgccttgtgcctggaattgcccattaaccccaagtggactagtccccataactgggaggtgggatttagtgaccacacttggggtgcttctcacacagcccttttgagtcagacactccagacatacccagaaatgagacaagaccctgaaagggtaacaggggcttgcttccaacttctccctggaggttgaggctggcatttcatactaaaacctagtgagacccatcccaaactaagacaacacaaggaggacggaagtgagacgccctggagttgtggttgtggtcacgttggagcttcccatgactgctgactctggggcaagctgcccctcctctaaggcactcactggggacacctgaggacgcctcctgctcttaccctgtagtcacaccaagagatcagggttacaacaaccctatagagaatccctgtccccttccatgtcacttcactccttcgtgaagcaaatgccctcaaggagctcattcccattcctgggtcacagtcacctggaaaacctgatccagacaccaacctcctcaggcctcgccatttccagacgtcccgttactgcatacgcttggtcgactgtcccatctcagcttgagaagggcaggcaggtgtgtggactctgctgagcaaatgccttccaggggcagtggtctggcttcctgcaccatagcttcaggtgggggatggggagggggagttaggggccccagggaagagtttttgtatgaacctgtgtcaccgcattttgtatttggtggaggaacccagctgatcattttagatgagtctcttcttccctttctttccctgccaagttggtgacaattttattctgatttcgatctttgtctgtgacttgccacagcctgtggtcagggtttcctttgggacctcggtcctgggaggctgatctctctcctccctattcagacccctgtatgcctcagctggtcactgagacaccttcatctcctctgaccccagaggcagggagctccaagacaaggccacactggtgtgtctcatgagtgacttctacccgagagccatgacagtggcctggaagatagatggcatcaccatcacccagggtgtggagaccaccacaccctccaaacagagcaacaagtatgcggccagcagctacctaagactggcacccgacagtggaagtcccacaacctctacagctgccaggtcacgcatgaaaggaacactgtggagaagacagtggcccctgcagaatgttcttaggtccccgaccctcacctacacacgggggcctagagctgcaggatcagggcatgtgtctcccctcccactccaagtcatccagcccttctccctgcacccagtaaccctcaataaatatcctcattgtcaaccagaaatcctgctgtctgtcttcatttcttatctcatatttagtttgcaacctccttaaattctaagcaaggatgaggaaaatccaggtgcccagtttatcgggtgagaagtccatggtggtgccatcaccaggaacttgtggaaaggtctgggaatggaaactcacaggtgaatttcacagattttcacaatacagggtggctaagtaaagacacttacaagtcctgcaatagggaaacaggaagtccagaatcctgctcaccatcccagccaacttagtgagccctaggatgctctgcaagatactggtgttcacgtcgctagctctggaaagtggggtgaggctggggcacacgggtgatcagttatgatcagatgggcttagggtgaggttcaaagttaaccagcacgtggctgagatctcaaccatgaagttcccaattctaaagtcaggctctggggtggagtgagtatgtgcttggtgtgtggctgagcctgtgatggtcagctcgtgtgaggggaggactcctgtggactgagacaaatgagcaaagacaccatcccaggcacagaacgggcatcccatggttgtcggggagagtctgtgtcagagtctcattctggactagagtcaaggctgggtcacgcaaggtcagcacagggtgaacatgacctaggggctatctataggcaaagtcaggctttcacgggatctcaactgccccaaacacccccatcccaccaggccccactccctctgtcactcacgttgttccgtcccctcaccccctgcaccatggtgcaccggcagcctcactcagagacaccctcatcccggggtccctgacagtgggcaatttggtcccttgaaggccttgacaggctcggttaatccatagtgcccgggctgggacccccactgtttctggttcatcagggacatggcagcagctgctgggtggccagccaggacaggaacagagctgcaaggcctgggggctttttccacaatgatacacaaagagaggggcccctttggagctcagtcccagccacccctgccccaaatcacagccgtgagctgaattgaatttcaggtgcccagagtccctcagcctctgtttgacccatttcacagctatgaaaattcaagcccatgggagacactgtcccaagcttcaccctctctataagttgtacatttttatgatgaagatctctgaacacaaaaatagggagacagaagaatagtaatgactccaaggttcccatcagccagtccgcagcatcatccattttcagataatgcggacccacccacagcagaataactaaactactccttcaagcaagggtgtgaagcaaatgctagtcatcacacacacaactggagagaatatcaaggatttcttgacatcaaaaatagttaatgagagtcttatcaaatgtcttgtgaatatcattgtgtctatttttgtcgactttgtggtgctgttgcatatttgtgatttaatttcatttctatgtggattaaatacttgacgttatcattggtgaatgtgtttttagacccattccatctgcaggtgtctcccaaattgctctagctttccctggcaaggcaggagctgcaggagcagagagctggtcccgggacctcccacagtcgggatgcaggcgccacctccctgagcaggaacccagtgcttccctcaacctctcttttcctgaaaaatggttctagcatcaagaggctcaagggggttcaggctggacattggcaaactcgcttcccaggacacgtggctacttccagcaaagccacccatgttgtgttgtcattctttcagtgacattagctgcatttgatgatcaataacttcgcgcctcagatgagaaggaaggcagatggtcaagacttcggtccacctccttctcatgagggcttccagaagggagggcacagcagctgcaccgtgcgctcaggagtgtgcttcatgctttgggaagaagaaaaaatgtacattcttcccttttgttcaccactttgataactgatgatctggtgcccagccatcctccagggcgcacagcacaatgtagtaccggagtgagctctagcgtgtgaggacatctgacatgtgggctccactgcagatatactgaattgcaatgacaatgcggctacaaaacataaacatttacccactgggcgcctcctcaggtggcatctgattttctcccattgccccaggagcttccatggctcctgatttctcggaggatgagaggttctgtctcatcatgtccctttcctgccccaggcctgggatcccgcactgacctcacctcccttagcagaaggtgatatttggagaccacactcgggagctcctttatgtccctcacatttgaataaggcagtggcagccactaccccacctcacccaccaaaatgagaccaggttgaggggtgcaggagatccttccattttaccctggaggatagggctggcatttccagtggggaccagccaggcctcactggccaggcccatcccaactaggacaagcccagggaaggctgggctgaggctcctggagtcacagataggttcatgggaagcttcccaagacaccgcactctagggtaaccagcttcttcctggagggagagggcactctctgcatcaccccagggcgtcaccaagcagtcagtgtcgagtcagctccaccagggagaccatttatccctgaccatgggagttcactcctagtgacacagtgccctccaataaactcatccccatggctgcatgatggttggtgggaaaaccaaatccactgtcctccaggaaccaggatttctagggatcctgctggtcacaggatgtcacctgtccccttctctctgtgggggtgagtgtggcagccgtgtgaactccctcatgagcagatgccaccaggggctgtggcctcagcttcctccatcacagctgcagcgggggttgggggtagaggcgtccagagagggtttttgtatgagcctgtgtcacagcactgggtgtttggtgaggggacggagctgaccgtcctagatgagtcttttccccctccttccctggtctccccaaggtactgggaaattttctgctgcttttgttcttttctgtatcttgtgttgacctgtggtgatgctttctctctggagcctaggccctggtcaaggacctctcccctccctgtttagacccttacctcagtgggtcaccaagaccccttcacctctgacctcagatgtagggcactagactggatgacctactgagactcatctgtctgtctgtctgccagagccaggctgcttccctaaaacttgctcagttctgtcctcccccacctgggcttctgtctaacgaactttgtgcaagggaaactgaggccccatctcatgagggagagggaacaaggggctcgaaggagtgaccacctggtggactttagaaggacctgaaaccctcagagccaagataggggaatgaaaactcagagtctcagggcccagtcccctggactgtgggactctggatccaggctgggaacaaggtaggaggtgcaggggcctctccaggtttctgtgggctcccagggagagagccctgagctggtctgggacccatgaagccctgtcaggagggacgggaaggctctggacatgaaggagccaggtgaagtgtcacgaaaggccatggcattcagggaggtggctgatgggtctctgtgggaggcacccctagaagcaggaacccctgagttcaccgacaggcatatcccaaggcagaaaaactgtagattggccctaaacacagagagactctaacacagactccacagacaaagagcccaggacagacagacagtgggacttgggtgagcaaaggccctgactccactgcagaagatccaggagagacggatgtgggtacaaacagagttcttacgtgagagacccactctcccccaacccagagcagctgtgtcaggtgagaaaagtttccagagtgaatctaacaagaggctcacagagctcagagaacacagccagagccggatcacgtcaggatgacagggtgaggcagcgccaggcaattgaaggtccactgtctatacaaaagcccaagtccttggaagatttccaaacaggcgatgggcaggggccaagctcagaggttttctgactgacagagttcttttaggaacatgatgtcacacccttctgagacagtgtggaccacatctgagaggtcctgcactggtactggggggcctgaacactcctcatgcactgaggtcaggggctccccaggtggacaccaggactctgacctcctgcccctcatccattctgcaggtccgctcaaggccacccccttggtcactctgttcccgccctcctctgaggagctccaagccaacaaggccatgctggtgtgtctcataaatgacttctacccaggagccatagaaggaaaatggcaccctagtcaccaagggcatagagacaaccacaccctccacacagagcaacaacaactatgcggccagcagctacctgagcctgacgcccgagcagtggaagtcccacagaagctacagctgccaggtcacgcacaaagaaagtaccatggagaagacaatggcccatgcagaatgttcttaggcccccgaccctcaccccacccacaggggcctggagctgcaggatcccagggcagaggtgttccctcccaccccaagtcatccagtccttctgccgacacccaataaaccctcaataaatgtcctccttgtcaatcagaaaacatgctgtctgctcatttttgtttatccactttccatcctaaatttttttatctccaaagatcaacagaatcctttggacttgtgacaatgcagcctgggaccatcttcgtgtttctctgagccgtactttttccatcaccttatccccatagaatgttccagaacaaggaaatagtcttcagaaggaaccagacatcttcattcttacccacgtctctgttgtgcttcctgctgccctgtgagcacgtccacctctggctgcccggggacacaccctccttacatccctatggccccgggagaacatctcagctcccttctttgttgtcctcggccctcactgtccagatgccatccctctctcaaggtgtttgtccatccccctccaaggccatgtggtcaccccacctgtatttcccctcatcaaagcctagagcatctccccttctccatgggcacactctgttcccgtcatcccagggaccctgccctcagcccccacaggccctccctataataatcactgatgggatgcttaccccctggaccctggtcactcaccccacatccccctctgggtgcctctcatcccacatgtgtcaccggatgccccagctgtattcaacattcctaggggacaagggtcggctctgctcctcactgacaccattatgaatgcctaatgtcctgctgtgcacaagttgtcaattgactggtgagttcaaagtcagattctggggttatgccaggagcttgggtgacgctgattcttcttctgaagaactcagcatgggatctgagctataatacacacacacgtgtacacacacacaatgcacataaacacacatgtccatgctgggcatccttctgggaggatcaggaaggtagaaggggctgcagtcaggcccaggtcaggacatgagcaaagcaaagctgagacctgctgtctccaggctttgggactagggggtcgcccctggatatgggagggtggggcagggttttctgtccaggccaagagggagacaggagaagatgtggacgggattctgatcagggagcagcaggccacatctcagcagtcaggggaggcgcttgctgtggggaatactgttggggactgcatggtgccaggagtgtgtcccaggtgtgagctcttcaggtgatgggcccagaccaggatgcaggtccaggctgtgtgtgtccaggccccacactgcacatgcccatccactgtgggtgccccccgtgccggtgacactccagagcacaggctgtgtgggtcacccgtgcatgtaggggactgcagagcacacacatgtgggtgtgtgtgtaagccgggggagctgaagtggacagcagagatcccccacacgtagagctcctggaggaaaccacactgccagtgaggcctatgacctcccttgagaagctctcctctgggccattgcagctctaatccagcacacatggcctataggtaggaagctgtccccatgggttcaggaggcggacttgggcagtgatctgtgagctgctccttcaggacagctgggccaaggatgctggagctcagaccttgcagtggggtctgtgtccctgtggtcaacgtcattcttcccacaacccccaattcccattccaagcccatcccatcataacctccagtgctgaggatgtggggggcatcaaggaccctccccaccattcccaacttctcaaagaggtcccagctgcaccatgtcagtggcgtcacccagccgctcacctccccttcctccctggcattcctgacaccagctgatccaggccacccaactcctcagaaatgcaattacctgggagacaattccacacacagacctgtcaacccttcccatgactgaggtggatgaacccctaagcccccaaggaagtgatattcaggtcagtagaaggtgacccccttcaccccacctatggctcacccacccatgagaaaagggggctggaccctgggccttgtgagcagctgcagggggttggggggcggggtggcctgggtcgggtgtatcaggagggtttgtgtgcagggttatatcacagtgtaatgtgttcggcagtggcaccaaggtgaccgtcctcggtgagtccccttttctattcttttgggtctagggtgagatctggggagacttttctgtcctttctgttctctctagggtagaggtctcaatctctctggggtctgccaccattgccttttttcctggccccaatttcctccagcctgtcccttcttaggcacctggtggggcatgatgggaagatcccagtgacctcttaatgctccctgctcaggcctgaacctgccgctgtcactcagggggcattctcccctgggctctgggatgttctgctccctcgcacagagtctccagtccccaaagaccagcagagcaggggctcaggctggggcaccagggccatgggacaggggaaggatgctggaaaaagttcagcttcccagggttctgggtcccaactatggggctgctttaaacaccaagaagggaggcctttgactggggacttggggaaatgaagggggacaaggatggaggaagaatgtcctgtgaggtggcgccagggtgctgggtccctcctcctcccccgggacaggcaggctgccatagacagggtggttctcaggacactcagtccaaggttagagcctccccatcccacccaaaaagagagacccccaaagcagatgctgagggaggcactcctggtgggcgcaggtgacagggacctgtcaggacagacatttgtcctaggacagccagatctcccaacgacagggagaccccatagagcagacacagcgccaggctcagaacagaaaatatacctcacatgcaagccctccatctcctggactcccaggacccggctcccaggactgacatcccctccccaccaaggggcctctgtgggaaagtggggcagagactgcaatgatggtgctgggggatatgtgaggaagaaattcacttgtcaaaagggaggagaacctaaaaacaggacacagatgccctcgtgaacagacccagaggagggacctggcaggggatgttcagacagagacgtcccccaaggaaagacgagggcccagggctgaacccagccagcgtcggggagcataggtgaggtgagagctggctgataaggaggggagaatctggagaggaggctggagcagaagaggcctgattctcctcagtcctcagatgctgaggagtttcccatcaggaggtaagcgtccccgccaccgccaagttgacctcagtacagcaagggcccagcctgaggtccctatcctgggccttagtccttcacccacctgaaaactgaggccaggggctccccaggtggacaccaggactctgaccccctgcccctcatccaccccgcaggtcagcccaaggctgccccctcggtcactctgttcccgccctcctctgaggagcttcaagccaacaaggccacactggtgtgcctgatcagtgacttctacccgggagctgtgaaagtggcctggaaggcagatggcagccccgtcaacgcgggagtggagaccaccacaccctccaaacagagcaacaacaagtacgcggccagcagctagctacctgagcctgacgcctgagcagtggaagtcccacagaagctacagttgccaggtcacgcatgaagggagcaccgtggagaagacagtggcccctgcagaatgctcttaggcccccgaccctcaccccacccacaggggcctggagctgcaggttcccaggggagggggtctctctccccatcccaagtcatccagcccttcttcctacactcaataaaccctcaataaatatcctcagtccaccagaaaccctgggttttgtgttttgcttctgtttatacattttctaccctaaattggtccaacctgcaagatgaacaaaattcttttagccttgtgggaatgaagtctggattgtttttgaggggtagttccaccatcacctagaaaggcccagagaatattccagaacagagccttgggcagcaggccccaggactgcccctttcccatacgtgctgtgtttgtgtggacatgtccacctccagcggcctggggcgaccgctccttggttccccatggcccagaagaacgagtaccctccacggatcatcaggcctcacccctggacagcctccctctctcaaggggtccctccttctgaggcggaaggagcctctccagtccatgggcccttggtctcccctactccttaggggcccaccctgttcctgactcccaggaccctgccctctacccccacatctatctctgaagcaggcacagactggaccctgaccctctggacccaggtcactcaccccacaggccagctgggtacccctggtcccacatgtgtcaccagtgtcccagttatactcaagtcccctgggggataagggtcaactctactctctctcacccctaagtaaccagcccaaaactgaccacacctcaagtacctaatgtccagttatccacggatggtcagtggggctggggaggtcaaagtcaatcatgagattccagagtggtgccatagacgtgcctgtaaaccaattggtctttttaagagctgtatgtgggatctaagaaccgggttgatgattgtcccaggaggtagcacaggatggggggcctgggctatgagacaaacacacatacatacatgttcacaaacataaacacacatgaacacctcataggcacacaggtattcacaaacaaacatgcctgcatgcaaatacatacacacacactctcctgtgctatttagaatcattaccacatgggcatcccactaggggctgtgctgggcatccaggaccctcccagggaactcggatctccataggggaccagctccaccttccctgtggcataaacaggcttctcacttcttccatggtgacagtctccaaaggagctgagccgggacacatggcttcctccaggacagagagtagcaggggacccagatgtgatgtgcagacatgcctcctccctctcccctctccctctgggggtgaagggatccctgacttccagtaaagtgtgcatccatgcatggaggggccatccccctcaccctcctatcggccagacctgcttcatgacagggccactggacctgggcgcccaagctgctgcagcggggaacgggtcgggtgtgtcaggaggggtttgtgtgtggggctgtgtcactgtgtgctgtgttcggaggaggcacccagctgaccgccctcggtaagtctccccgcttctctcctctttgagatcccaagttaaacacggggagtttttccctttcctgtctgtcgaaggctaaggtctaagcctgtctggatgtctggaatctttgcccctccttgcctgggctcctgccctcttctgtgattctgtcctctgtgggtcccagttacggggctgcattaaacacagtgacaggaggcctttgactgaggacttggagagatgggggaggaaatggcaggaggacaaagatagaggaagaatattccgtgagaaggtggccccacagcgctgggtcacacgccatcccccaagacaggcaggacaccacagacagggtggtgggtctcagaaaactcaggccctaaacgtggatgcttaccaattcctccactggaggaagacctcagagcagatgcccaggacagggacttctggtagggacggtgactgggacgggtgcctgtttgtcagggaaaacccactggagagtcagatcccccagataacttctcacgacatggagactctttcgaacagacaaagctccacgttcagctcagggagtaaaaaaaaaatgcctcaaatggaggcctttgatctactggaatccagcccccaggactgacaccctgtctcaccaggcagcccagaggggtctctgcagggaggtggggtgggggctgcaatgatggcaccagggagatgtgtgggtaagaaacccactccctgtgagagagaagagcctgaacccaggaccaacagctgccctgcatgaagagatgagaacaaggggaactggtaggaggtgttcagacagacacccccaagatagacaaatacccagggtgagatgtggtcctggactccatcccatccagtgtggagccagcaccggtgggggtctataggtgatggaaaatatgaaaaagagacagatccaagagggggtctgtgacccccaagagtgggggcaactcccatctgacagcgagtgtctccactcaccgctgacctgacctcagtccagcaagggtccggcctgaggtccctgccctgggccttagtcccatacccacttcaagactgaggtcaggggctccccaggtggacaccaggactctgaccccctgcccctcatccaccccgcaggtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctcttaggcccccgaccctcaccccacccacaggggcctggagctgcaggttcccaggggaggggtctctgcccccatcccaagtcatccagcccttctcaataaatatcctcatcgtcaacgagaaatcctgctccctctcttcttttcttatctcacacataatttgaggcctcccctgggttctcagtgttgggtgggggaatcctggcacccagtgagaaagtggccctgagggagaggctcatagcctcccggggtgtctcctggtgaaagaggcccggataggagaagtctgatcactgaacaccagtccctctgccctttcattcctcccccttctcctcaaagcatagccccccacctccctgcctcctgcctggatggagttgtctctggctgggactccagttacaccctctatctctgccctaacagagacacccttcacccaccatctcttttcccagcctgaaaaccctgctccaagcctggagcctctttgcccctggcccttgcccccggaatgccctcctccctctgtgcccagctcagctcccacccaccctcaccccctccctgtcatccctgagagccagactgtccaggacactccagcaccactgacttctcaagctgttcaatgagggacccacctcgattcctcacctgacagcaggttcagacacttaagaggaatgggaggaagccaggaaggagactcacacgaaaggcctacaggaggctcgggacacttggaaaagataggctctgagctccctaggaaccagtgcaaggagggtaataagcacttcaccacttctgtaaatttaaacaaaccctttgctgaagggaaggtggtgttctcaatgctggggccagtcatctcgtcacaactaaaagtgggaacatgttctatccaaggcctcagtagtaatgggatgtgaaccttgacacacgcacaggtaactatctggcagcccttagacatggtgattctctcaagtgcgtgaacagaaagtcactggccgtctttgggaacatcatttttgggaacacttctccattggatcccgggccttcactggaaaaccaggtccctcatcaggactttctctgtgaggttccctgagtctggggctccaactgctctctgagaggaaggggtgggggaagagaacacgacccagccccacccagcccctcctgcatggcccctcctctgtagagtgggggcacctgcaggggtcaggcctgggttactgtgggtggggcctgggaggggcccttgtggcatcctggggagtctctcccacggctccttgtttgactttcctgtggctgctggctgttatcacaaatgacccctaatttagtgccttaaaacatcacacactgattctctcccaggtctggaggtcagaagtccaaaatgagtccttgggggctaaaatcagggtcccagcagggccggctccttctggggactctggggagaattcgtttccaggacttttccagcttctagaggacaacctcagctcctggccccttcctccaacttcagagcctgagctcagcatcttcaaatctctctcttgctcttctctccctccctaccttcttctctccctctcttccttctctctctctccgtctccctccatccccacatcttgtcctctcactctgaccctcctgcctccctctttcttctataaagaccccagcttggacccacctggataacccaggagcatttcccacctcaggctcctaattgacatgacatctgcaaagtccctgtggccacacatgacacatagacaggtccaggattgggacacgactgtccccgcggggcctaatttagccgaccacagcccctttcccgagttcctctccctttctccatgccctgcccagtccaggctgagccactcctggggggccgtcccagcccagcccaagccctccctatccctggtctcttgtggccccttctcctcctggggttccaggaaggcactgggagtttagccacagctctagggcactgtcttccagcaggccccctgagactaaatgccctccaggccaaatcacccttggaggaagatcctattgtgatcctcactctaggatggtgacatcacagcccagagagcctgagtgacctgccacaggtcacagtagggactcaaacctggtccacccaactgcagatctcagctctggaccccaggtgcctggctgccctcagcccacctggccacgcccacccacttcatccagcttcctccctggagagctcaaagcccactggacccaggcccccatcccgggacccgggattcaagtgacagaattattggaccaacaagggatggaaggggacggggcctcaggttggagtagccagattcctcatgccccttctccttcctccgggtcaaatatcagggtcagggcactcggagggagggaccatgagagtccccttttcctagagaccccatctcagtcctggttctggatccagggcttacggtgtcccccacctccaggagagtcagtccctggcaggtggctccccaagcccaatcccctccattcctggtcccagttgctccctcaacatccaaaaattcctgacatcttcagtcagggactgctctcccaagggaagagcacatggggctctgggtctggggctgtgggaaagaggaaccccggtcctctcggggcccagcaccgagcgcagtaggtgttcgaggggggctgagtggtgacatgtgagactctttgtagaaccccagattcaggttcgtgtacctgatatgcagcggaggtcaaaaactgacacaagtgcttggagatagaaaaagatttatttcatttggctaaagtaagaagacaagaaagcaaattcctccactccatgttaacaaaaggatgaagcagggagtttttatgtggctaaggagtgagggaggtggcatttcaggggaaaagtctgtgtttattcagtctcaggtaacatcttaagcaactagacttgcgggcgacagcggctggtctctacgtccctaaaggcattcactcctgcaaaatacttttgtgactctgaagttatctcctccttcttgacaaagaaacaggacatctgcagcttatgatcacattgtgtgaacaagggatgctgggcaaaaagcaagcagttaacttgtacaagcaggcaagggccaaatcagaattttctttacttcagtcacaaaaatgctgggtactgaaatctcaactcacctggtgtcactcccagggcacaggctaggacaacacgcacccgtccctggagaactctgggctggttcccccttctccccctgctgaccccctcttagtctacctccgctcctcccttcccccaccggagaacctcccagggtttccatttcctcccggataacataacacgtgctgccctgtgaggaggtgctaaagtcaagagcaaggtggcagggggctttcgagcaagaggcgacctgacttcagagaccctcagtccccaagacagacgcatgccctttgagagagcggccgccccaggcacacgcaggctctgggctgtcaggatgggagcacgtggtcctcttccacccacctcccgaatctcccctgctccccgcacccatttccctgtggcccccatttccctgtggtcactgtaatcggaccccactccagtccccttccccactgactctgggagctggggttgatgctggggctggagcagtgaccagcccatggtgaccccggccccatccaggtactaggccactggccaccaatcaactatggtttcccaagcacccatatgtgcccagcctgggcttgggacccaggcctagtcctgcctggcccactgcagcagtaatggtgggctcttcctggagagaacctggaccacagtctctctgcctcaacatctcagtatgaagggccagagaccctcctgatggtcaccttaggagcacaaatgtggtcctgccaggaagaagtaataaaatgtgaatgctgccttcctctggctgcccctccctctctcctgccttttacaagtggtaatcaagggctcctggcctccacggtcccctcccttcctgcctcaagcccagcagtctcaccaccaccccatcacagccccagtggcctgcacgtggctcaatccaatggtcccctcactgtcctccttctgttgacctcaggatgggcttggcaactcacatcattctcgtcatcttgaagcccctcacccacccacccccacccccccgcccccccgccaaggtcctctcttctatggtcccctcccactttgttctgctgctgccccatcagggccaccggcagctagcacccttggtgactctttctttcactgtgtgattcatgaactaccggaatgtaaaagggttccttgctccttccccggccccagccctcagcccagtggtgcctcaggcttgatggctgcccagggctgctgaccacgctctcctggtgccgccctgcccagcaccgatctgggacaccacgggagcctggaagcaggggctgcacccctcacgtcctccgatgttcagccaggtgctgggctgggtatcactgagcccctcgatggccactgctcgacagtggaactgctcccggctctgctgaagatgctacctcacctgccacctggcccagggccacttccagggaaaccctgcactggcgtctgtcctctctatgtcatgggatcccaaaccaccccaggaggcacgtgtccatgtcccgcacaccttacagatgaggagacggagattcggagaccagcagcctgcccgagtcccacagctgcccagggctgcacagatggtgggcactgggactctgatccaaggtcaacccagagccagccccttccctaaggcgtgcagaggaggctgagcctgcccaggtcctgcaggtgttcagggcagcacagtggttgcccaggcccctgacctaggccacccttccatcctgaggccgtgcctgggcaaggccaagagatggtgctgagtgcatgaacccccttgtggctctgtgggatgggcagacctgggctcctcattctctgttgactcagtgggtgaaagaggcaggcaggagggcagccatgggggtgccctctgagtctacaaagcagagccaggacaggtgttcatgtgcccatttcacagatgagaggactgaggctccgatgggaggggtgatgacccacctagggtcacacagtaggttaccggctgacccatgcccgcctcttttcatgactcctcggccctaagggcttttcattcattcattcatccattcatttgttcagactcactcattcattcattcaacaaactctcagctgtgggccaggggctggtgtatgcagcccaggaccacctgccctagaggagctcacaagcttggagaacgacatggagacaccactgcccccaccctgtcaagtctccaaggttggcactctgcccagggagtgtctggggcagcaggagcatctccccacactcaggaaaagatttaactgaaagaaccatctgagagagccccagctgtgatccttgggccacagtgggaacatcacagtccctcactgaccctcacagtgaccctgaggcctaaagctgccattgcccacctcacagaggggacgtgaaccatgatggatgcaccagcgctgcccaggctccacccagttcaggagtagccgagttgggccttagcccacgcctgtcttcacatgccactgtgtctagctcagaccggggccagcccctcacgagtgatggcctcatgacaccgaaggagggttggtctgtgctgggggaacccctcaaggtatagggaagagtgtcacagtgggggatggggtgagaggaactcgtcctggccctggccctgcttagctgcagcctgggctgagggaggtgttctgagtcagatcagggaggggccctgtggcttcctctacagcaaagccagagcccagaatagcctgggagggggtgcaggggccctgctggaggagaggggggtggctgctcagggccctgcgggaggaaaagactgggagctactatgaactgagtgggtgactctcccatcaggcccagcctcctgtggggcctgcaaagccaccaagagagtgtccccagccaggcctggacaaaggcaccattacccttcaacccccatattcactgaatccaggggcaagaagggggacatcgacactcacctgggaacaagcaaaccagctcagatgccccataacgaggccaccagatcccaggcaagcccccattcctcaacacaaaggtccaaaatcaagtttccagccaactagaacatgcgaattttggggacatagaggaaataatcaccatccactcgcaatgcccactgctaatgacacagcacaatgctgaggatgttgctcctccctcccgacatgtcatcctcttctccagagtctctgtcacaccagggccaggttctggattccccacccaccccgcctgcaggacacgagtccttgatgttgaccccacaccctgggctccatccctgacctaaggaccagcttctacggccctgaaagagtcgtgtgtcatgacttgacactggtcctcttccctgtgctgaatgagacgtgaaggaaaaatgaacccaaatctgcccaggatcccctgcgccacacgtgagatgctccagttccctcggggattcagaagcatccctagctggcatcaacggaggccgggaagactaggtcttttcccaaaatgcttagttatgcaaacacctcaaaaggcacccgtacctcttgtaacaacccaagcgtgaggactccctctttctggggtgatctggggaaactgctctcctacatggtcatcttgaggattgcagatgggccacggaaatgtcaacacagtgacatcagcaggggcagtagggtcaggatcagggtcagtctttgtcacttggtcacttgggaccacatcaaacctgaccctgtttggccagtaatttcacaagggtggtctccccaggaaacacgtgggctgggcaaggtctgaggggagggggatgacctgcatcctgcattttccaggacattcccagtttgtgccactgactctggaagctgaggtggatgctagagcagtgtccagcccctggtgaccctagccccatccaggtccccagaccactggccaccaatcagctgcagtttcccaggtgcctatgtgtacccagcctcagctcgggacccaggcctggccgtgcctggcccattgtagcagtaatggtgggctctgcccagagacccaggcctgggctgcctccaggacccccacccacatctatcagagagactcgtgaagttattaatagtgccccttccactcccaggaacatcccagtttaaacaacaaactttggttgcccaagctcagagtaaccgtttgctaaatgactgaatgacgttcttcataatggctaataatgagggggaggaagccaagcccagccacctagcactatggtaagcagtgctggacattacaatgggggccaggggccaggagagcctcactaggggccacatccaggcagtcaccatgacattcctggtcccctgcctggagcccctagaaatgagctcactcaggcccagctcacaacacaaccaggggtggccctaataccatctcccactcagcaacagcacaccacgtccagagaccggcaagggacagctcctctgggcagccctagttcctggggagaccacaggcagcagggagaatgcctcctggctttgggacaggagccagggaggggctgggtgacttctgtggctggcaacacagagcccccgtgtcagctccaggaaagagtagcccacagccaggacgacccaccagggcacccgcagtgtgcctctttccatacaggccatccttcatggtgactctctcttcctatagcaacaccaacacccttgatctggccacgggtccctcctgcttctcacatcaggtctgatgtccactgagcatccaatgtgccagttgccgtgccaggcaccaaagcctggacccctcacaggtgtcactaggatgggccctccctgcccacccagttcccagcctgtgcagggacatgttgggactttctgactatggaaatgatagaggagaaaggggcctcatcttcacagtttcaggccaaaggggagcctcccactcagacccctagacacatcctctcctgacctgtctggggaggaggatgggaagtggtggtcagacttggcctgggctcccacaggggacagaaagtttgcaaaggtctgggcagcagagagcagctcccagaaggaaggggtgctggtccccaggggctgctgggcagagtagctgaagaaggtgagaccccagaccggccaggtaagtaagcccccttctcaggggctgcccagagcgaagtcacatgttcagctctcttctgaggacctgctgctcctggaaacccagcagggttaaggcaggcacagccaggttcagacagctcatgtttgcgggagagggaaatcaagtcaacagacaaggaacaatgtcatgtaggaggcgggatttgtgctggggagaaatagggcagaggatggggggtagggagcacctggctggggtctcacggggggcgacgtcccaggggctggaggcagccagcgactgaggagccctgactagcgccaggcccctgtggctggagttagtggctcgagctcagcctcagtttcccctctgtgcagctgggttgataataatggaaactgactctctgggtggggggagggacaatcagatggaaaatagatgttttgtttgtctctgccgttggttgttttcatccttgggctgttccagccccagacagcctcaggccagccccctgcccatgctgggctccccaccggccctggaaccctcaccccagtgcagctggcctggtgaaaccaagagtgcctgaggcccgaaatagctgggaaaccccaccaagcctcagccctggcagcaggtgcctccttctccccagggtgggaggcaggggggcgattcagtttccaaagcttccaccagcccagctggagaatggtcctgtgtccccgcaccaagacacccaagccccgtgcccaggcttgagttagacagggtctggagatcatggtcaatcaatgatcagaagtagcaccttctgctccagaagcttctattcatgcaggccctaccccctcctcacagctccccaggaaccgttctaaatgccaggttcagagctgtgcccaattggggggcacagccagacacttggagctcagaggggcctggggtgggcagggctggccagagctggacatgggaccctgctgatcacactccacctgccgcccccaggtcttggacccttcaagggagctgggccaagtaaggggatgggaagggaaacaagaacccttccaagagcttccctgggagcccagagcctgaggcagtaacgaagctcctggaagcacagctgccaagaggacttccggggtccctacccagtgggcaggacctcagactggtcagtcacttatttgtgtgtctgtccatccatatatctgaacatgcacacacacacacacgcacacacacacacacactcatccttccacaagccccgaggcctggcctgtgcagggctcttgacacatggtgtcccaggcaaggcaggactgccccagcccacccccaggtgagacctggagtgtgccttctcatgggaggagggggctgtggccttggggtgccccattccctgtccagtcttccccatgctgggtctagatgctgaggtcaaagagaggttgacaggtgtgaggaacaggccactgtggtgaggcttaatgccccctgtccgatgaccagatcctacccactgcccccgttacagacctccctgtctttctccatgtggaggaaacgttcccaggatattccagggctccaggttctgatgagagtatgggaggagaccaagtacccagcctcagggcctgggttcacccctgcagacggcaaatcccatccacctgtgggacttcaccagctcattcttagaggacaccagcctggagctcccttggcccaggaaagccaggagccaggcccgccacacgtagccattgcacatgtcacctgacacataagatgcgaactgtagggtgggcaggccagggatgagtgcccccacctctgccttcctccccacaggcccacccacgaggctgaacagggtggccctagacccagcaccatcttcaatcagctcatccactggcatcccccaccaccgtcccctcaacatgcacaggatgccagccacccaggccagttcctgaagtaaagcaagcaagggggggtacttgtccccgcccagcccagagctcagattgcagatgagacccccttgcttgaagaagacaaggggcaggagatactggggattccatgtggtcatcaaaggtagcctggtggcagcagcaacctcaaacaggcctaggagctggatcaaggactgaagggcagagagaggacgggtgtgttagggggtgagtgtgagcaaaggtataggagtgaccacagcatcccttcttcccacagggccacagtagtgcacaagggccctcatggaagcaccctgaaagctcacctcaaaggccccatactctgtcccccacgtcacctggcctgccaccctacttaatacccaggaagtccttggagtctgtgccacatggatgggctccaagatggaccaggcttccaggggggcagggaacaagggagaaaagaggtctgggccctgcataggacacaggtagtgaccacccggtggaggagagggaatgagcagaggatgctgggagccaggcccaaggcagggccctgcagggtgcacagttctctgggttggacggtggaccaaggccatgaacattcatgctggtccaggccagtggaccagagtgccccaagccccagagctctgcagaggggcaggggcagggcccagagagagcaaggccgagagtagaggccctaaacctcaggtctgaccagatctgcaactctacaggtagctgcatcctgtgttgagacgctattgagtggccttattgtcccgtaccatttataaaacacgtggacacatgttatccacctgagccactcagggattctgtgaggccacagccagaatcatggtcccatttcacaggtaggaaaactgaggcccagagcagttagatcccaaaaagccagagccagctctgtggtgtcctgacttccagcccagggcctcccatctgacaaatggagaaacagaccaggagagaaagggatctgcccgagctcacataggcgcccctgtgtggaggggcccatgtagaggggcccatgtggaggggacctgtatggagggtggcatgtggaggggcccacgtgtggaggggcccatgtgtggaggggcccgtgtggagggatcgtgtgtggaggggcccgtgtggagggatcatgtgtggaggggcccatgtggaggggcctgtgtggagaaatcatgtgtggaggggcccatgtggaggggcctgcgtggaggggcccgcgtggaggggcccgcgtggaggggcccgcgtggagggatcatgtgtgaaggggcccgcatggaggggcctgtcggtagggtgccaggtagaggggcccatgtggaggggatctgttggagggtgtctgtgtggagggggcctgtgtggaggggcccgtgaggagggcgctgtgtggtgggacccgtgtggaggagcctgcatggagaagacctgtatggagggtggctgtgtggaccactgccctctgccagagaccagattgttcacttcctccaccattccacagctccagccccatttcaggggtgcagaaaagaggcctgaaagcagcatggatgagagttagggctacaggccctgatggccattccttccctgtgccttgggagatgcaaggaaggagggtggctgcaaaggcctgtgggagcccagagcactgttcttcccaaaggggcatctgccctgggagcccagacctcagtgtcagacagagaaggggtccccccaccatgctcagccctcatcaacccttgaccttgagcaatctgcttctcttctgtagccctcagtttcctcatctgcccaagggggtgataagagtccctccccacaaggtaggtttgcggattgagatgatgcctaagctgtgcctggcctatggggaccctcacctaccctcagtcattgctcttgcctgggcctgcgggtgacactgtgtgaacctgggcaaatgcctttgccttcctgggcccagccttccctctggtcaaggaggaactgggtcagggaccccgagtgccagccattcaggaaaccagcagattcctgggtgaaggggttggccagggaggcctgagatgggagtagggtgggggccaggccaagggatggggttgggggatgcgctttcccagctctggtggccctgcctgcagctggccacccctggaaatccccaggctaaatttaaccccaagttggctgaaaccagaactcagagtgacaaaaggagaaaaataagaggaagagaaactgagctcatggccacccgggcatgggatgagtgacaaacaggcccaggtgtggcccaggaggagcatggggcagtttcagggctgctgctggatgtttgtgcagctcacaggtgggggcagtagagcctgcgccccaccccaccccctcctagtccagcccctgggcctgatgctgccccctggctgcctccccacaccctgagctccatcctgggtcccagggtccaccagaaggcatctcagaaccagccagcagtggccctgattgtcagcaggaccccagggaggggggtggccaggacagggctctgaagcccccaccccaggaccttccctgggcagaacgagttggtgagggagtgatgagcaaccacaggcctcctaacttcccaagctggcgattctgagaggcctcaaggctgagacacggttcagccttttaggccctcctgaacgtgtcccctgtctccacagcctgggaatgcactctcttttgacccagaaatcctgctcataagaatttatcatggagatgccagagggccagtgcatgtggatgttagccagggagctaagagcaaaacgtgacagaaaagagcccgagagcagatgccagcctcacatccacatccccagatggccttggagaagggtcatagacagatgttcacaacagggcaagaagaagtgaggaaagaagttcccatctttgtgataaccccatgatttcatgcagaaaaagatctggaaggcgccataccaacgcgctaacagggcctcttgggcagtgcaggatcagagacttgctttgtattcttatttaatttttcctgttttcagattttataatcggagaacaaaacattaaaccaatttaagatgtaagatcctataaaaatgctgtattcgatgatgcgaatggcatctgaaaagccttgaacatattatcccaaagaggccaccagataagacgtgacctgtgtgtgcatgaatccctgcatttttatccatacctagatgcacatccgtatccacatctattccccggggctaccggttgcgggggtaaactgtaggtaatattggttttcattttgtacatctaacttttttcattttttgacaatcattatacatttattattatgaaaaatagaaggttttgtcacttaaatcaacatgtttattccaattcacttaacattcagcaaatatttcttgtgtgtctgctacacccacaacagtcagggtgcagggtttgagattacactgatgagaagacagagtgttctctcttgaggagtagtacaatgggggattatatggaagaggtcactacgatcctaacatggattcgcatcctgtatgtcttaggtgctgcccaaagcccgaaattgtctcacagctccagccagctcagaggcaggaagcccagggaaagttgccgagtcataaaaatggaaagagagggcattccaggggggatgagtacctagcagccgacatttagcaaagaggattggaaaatgaacccccccttaaaatacagttaaacacagaggagggagcaactgcaaacaaaaagtttaagcgatttctgcaaagagcaataaaagccatagagcagcttgggacaaggtcaggtcaggatgagcagaagttgggaaggaaagaaggaagccaggatggacttggagagtttttaccagttcctcaggcaggaagaattgtatggtaggtcagagcatatttctaggaagacctcggttgacaaatttctctgccactgagagatgacaatttaccttggtaactaatctctctcctcatgttcccatctatttgatattgatttaatatgagtagctacctcccatgtgtataataggaaatgtatgggagaatgcatattaattcctgaatagaatatctggttccatgaatgatggaagttggttagaatttattattggaaactcaccctgcactacctatagttggtttattttaattatacttatattcattatatagtaactcatatatatttgtcatttcttttcttatattcaaaaagtctctacataaataaactctgcacctatggtcattgctgggtatctgttctatacacagcaaggagccagacgccctatcttacttgttcactttccagcttctccttagaaaaaaaaatacaagtttttaacccaattctatgagtctagtactgtgacccaaaacccaaagggcaggaactcaacagccacctctccatcctgcctgcctcccaacccacattccccttccagaaccctcactgatgagggaaaagatgatgtctccaagaggagcagcccgttcacacatcttcaagcttcatctccccagcagccatccaagtgcctgaccttcaaggctctcaataaacagtctgaatgaggaaagaaagggagggagggaaagaaggagggagggagaaaggggtaggtggatggatgtatagatgggtgagtgattgatgggtggattggtaggtgaatggatgagtggatagttgggtgggtgagtggatggctggatagatgaatgcgtggactggtgggtacatgtgtgggtgggtagttggatgggtgaatagttggataagtaggtaaattctaaccatgagaagcacagattggtatctggcaactctgtgtagagattagattccaattcctgctctgatcctgactcgggtgtgatcttgggccctttccttaatgtcttgaagccttttcccttcatctgccctgcccatctcacaaactgctgggaagaaccctggaaggacatatgtgcacgaagatgctttagaaaccctagcaagcttctcaggtgtgaccttagcattggagggaacttgaaggtcattgggctgactctcccgatggttggatcacagttcatggtaagagcctaagcttagagtccagacagacctgggtttgtgtcctggctccaccacttgtccgagtgtgactgtcctgcctgtgtactcctctgtgatgtggaggtgatgatggtggcagcttcccctcagggctatgtgaggattcagtgggatcatcgtggaaagccctgggcacatcacccagcaggggtgccacgacgaaacccaaggtctgccctccggggtcccaaaaaagaggcccagtcttgcctttccagagcagggtaccctagaggccatgggattgaaggagagctctaggatgtccagctcacgggttcacaaaaccctgaaaagtgtctgtataaatgctcattgcagggaaagatctgtggctttatacagaaagaggccatgacacataaagggttaaccacagtccatctaatccaggactctcacttaggaaactgagacctatgtcctgtccaagggcactctgtgggtcaggggacagcaaagcacagacattcaacccagcatggaggcccctccccacccaggagcaggagcctgccttggaatgccagacctgagataggattactgccacctgggaacagcatacactggtgagaggcaggggcagggagaacaccaccacaggggcagggagaacaccaggatggggaaagggaaccacagggcctactcttttaattaagcagtagaattgtaagaaaattgcaactttcttttaaaacctgtctttcaaggttgttaaaatggggttttaataacaaaactgtgggagaaagaggtggctgatgtcaaaaacatctcaacccactcccctgggggacctgcagttctctagttcgtgagtttctgctaacaaaaagcacactaaaagaggggccaaaacaaatggaaatcaagcttatcaaacacagatgacatggagttgaccaaagcatctagagctgagattccaggaagcagatctctctcctttctctgggaccatcctaggagaggttccagggccccctggcacagaggtgccaccagcgacctcaaacttcaggcgcaggtgggggcaacaggcgtagttgaggctacagggacacaggtgtcagcacagcatacgagagggccaccttgtttgttttctgacttcctcttaaaatacagtttatcgcccttgatctttagtttcaaatagtaactattcacagtaaacaatgtgacacagtaaacaacgtgtacagaaaaacaaacaggagaaaacaatttgccccttgtacttcacccagaagagccactgctaatattttgatgtatttccttctattttagttgcaaactgtaacaaccattaaataaataaatacgatgaatttgtaaagtttacagagtaataataggagtgatgattgcacaacatcgtgaatgtactaaatgccactcaattgtacactttaaaatggtgaattccacatgatgtgagtttcacatctattagcctcctgggctaggaatactgcctagacctcaggaaccacggaattcatcatctctttccttttccttaaagtttgacctcctgtgtgtgcccttcaacaaacggtttttcagcttgtcctgcttttgaacttcatacggattgaagaagaccatgtgtatttttcatggtttgcttctttctcaacactgtctctttgatattgatgttgatgaattactcatttcactgctgactagaagcccactgtgtggaggtcccatcactcagctgtccactctgctgccactgacacatgggcagttttgcccaggagcagggcatcagaaacacccaattggagtccagtgtgacagtttgtccagggcctgtcattgtacaacacatcatttcactttgtttttcaaacatagtgaattctttcctaattaaagaagaaaagagtataaagagaaagtttccagtgcagcctggagatctgtactggttgtatctggaattccagactcagccttgcatttcacatagcagatagatgatgatgatggagaaggagaagaagaaggaggaggaggaggaaagaaggaagaagaagaagaagaggaggaggaagaagaagacgaagggaagaagaagaaggatgaggaggaggaggaatagacagactgacaaagattctctactgttgtcacttaacaacatatccatgcaggtgtggataaacctgggtgcgcatcacactgggaacaagcagctccaacaacactgaggcagcctcttcccaagtcagctggacaattaggctgctttgctcaggtcgttcactgttctgagcaggacacagccaaagcccctcgcccccacctctgtgcaaggatccagtgactgacttggggttgaccctctctgcaaagatcaaaggtcatgcctgtctaaggccttggacgcatgtcccagactgacttccagaaaagagagcctgaactgccctgctgagtgcccaaagaggcccccctgcatccacgaaaggtacccatgagggtgtggaaggagaggcatccacaggaactgggctcccacctgccccacctgaccccagctctacactgagaataggggagatagaggggcccccagggcctcctccaaactccccagagcatccactgtgaggtgacctgaaccaggccccaagctccctcctcagggaggcctcagactcctccacctccgcagcctccaccgtggctgctctgtgtctctctctggcagcaccaaccacccccactgctactgacaccaccattggagaaggctcagggctatgagttcagcctctggctgctctggagatctagggaggcaggagggctgcaagtgggggctgggagagctattccaggtcaggggtctgtgggctggagtctgtgaggtgtgcacatgtggggctgagggatggctggagaggccctgttggtggccactgtctccaccttcagagcccaggaaggagatttggcccctcctgcatcagataatccctagctccttagttcccaagtcttcagtccccagcctggctctcctggggtggctgcccttgctgtgggaggctggggggatcttcagcccagcacctccagcagcagggcctggtgcccccagctctgcactggcccaggtctcagatcctgggctgtcagcccctcatgggtcccaggtgcccagcccagctgccccaggaggcaggggggtctgggggacaccaaaagagtcttagagaatggacctcaccactcagccacacagaaaaactgaggcccagaggggacaaaggacttgtcatgggtccagctgtgagcctggctgccagtcttaaggcccagtgctcccccacaggatgctgtcacacacacttggccctgatgaggtcccctcttagctgggatccagccccatgaccagcaccccgaggctgcaaagggtgctgggctccagcaccccaagactccacattgaccccaagactccacattgaccactctgagcagaggagcccttgggtctttggggaggttagagagctggcacccccaccccagtctacccggccccggggttcctctctggatagggggccccagtgcagttcacacaggccctgcacgtgttccttcctcagggcatgcgtggctgaagcttgctcaacactaaacatcccagcccagtttattgaatgtgagggatacgcagggtctgagcagagcagccatcccctcctgcctcccctccttccagcgctagagccagagtgactccactgtcctgtgcccacccccagaccaaggagcctcaggaccactcttggggcagggagctcgaggctataggaagattgccccagagcaggatggctgagtgttcaggagtccagccatgtggtaaccgtgcactgcagtgtcacctgaacagggatgtcaccacgtgaaggcatcccagctgcatccttggctgacatatcctaactgtgcctgtacaaggggctccacacacacacacatccacacacacacacacacacacagtcacacttacatacccattcatgctcacacatttatccacacacattcatactcattcacacacacacacgcattcacacactcacacccactcacatgcactggccagagccagagtcgatagcgccctctagtggccactgttgtcccttctctagaaggtctctgtcttatcagtcacaacccccaggagtcttcatccggaaatcccaggatgcacaagtctggcaagatcattatctcctttcacagagagggatgtgacctggccaaggtccctcatcaggaaagtggtacagccctcccctccacccaccaccaatggtccgggtactcagattccgaataactccagctcctgaggccctgtcagagcccagaggctgggccctctcccaagggaggggctggagcagaggatctgggggcccttgtacacccacctgtcacatacacagggtgcacggtcccccgggagggaagaagacaccttgggggagaggaatttccaggccagagagtcccagaaacggctctcctctgtgccaggtgggacggggtataggaggggagggcctgcctgggctttaggaaaacacagaaatgccaagaacattgacacacagcagtaacaaatgctagcctgctgtcaactatcacaggcttttactgagaggaaaatacaactgatcaggttagattcccctccgtttccctcccccttttccctgagagaaacccagtgctgctcactccacatgcagccattcaacagctctggatgtggctttatgcccaggggacccagtggtggcctcgggggccaagccctggaaccaagtgccattgggtgacataggcctggaacaaacaccacgtgatgctgtcatttgtgatgtgatgagttctttacgaaaaagacagggtcaaacgggagactgtgacaactgctggtttagctggatggtcaggaagggacacccctgagtcaatgaggggaccggccagttgtggaggtgcctggggaggagcgctcctggcggcagaaacagcaagtgcgaaggccttggggtgagactctgctgacgaattgcagaaacagcaaggaggccatgtggccagatccaagaagagaggaggggtgagggagggaaggggtagagggagctgggttgcaggcgggggtgggggttccttggggccttacagaccatgctgagcagtttgcatttgttctcagttttcaaatgcacctgaacaacatcatgtggaacctgtcacgctccttctaacttgctacatgtatatctctagtactaggagatgcaactagataaataagacagagctccatggttcaacatacaaatagacgctggtcccggcccatccccagtggatggacatctgggctgtctgggttattcattcacaaacacaggccagtgagcccctgcatgtccccgtgcatacatcatgcctcccaaggacacacactcaccctgtaactagagggacacacgtctatatttgggtttactatgaactgagttctccccagagcagccagactaatgcacagcccagcagggccaccatctcatgccccacaaccacaccctgccttggaactgtggacgattgggatgttcctatccccagagagcacagacatctggcaccaaatgagaaccaggtaaagcccaagggcgaggcccagcccgccgggcgtcactcgaaggtcaccagaccctgccaccctgatgcccattctgctcctgcctcgttgaccttggcctccctgagcctcagtttccccatggttttattcagaggttgcagtcctggtccctactcttttgagtctgcacagactggggcccttcccagcactgctagcatgggggcagagacccttggtggccgaggagggtgaagtgggccaccggagccgggatgggattgcaggacaagagggggccaccgggttgggtagtgcgacccccggaaagcacagggagctgtgcccctccacaggattcccgccctcagagcccctcccctctgtgccccagagcagaagctgagcctgggctgtgtccatggtagaggaaatgctccctccattgggaacagcgtggccggcttctgggcttggggaaggagagggagaattctgggcgggcgatagaggggcccaggttccctctggtcatgaccttgaagttgcccaggtgaccaggaaggaggagggtgctcctctctgtcaagaagatctgagcttctcttccctagaatcagctactcttctatccccctaaaaatgtacaggaattttgcacgttgaatgaatggatagtttactaaccagtttgggaagaattgacacctttcaatccatgaatatcctctgtctttcccattagtatactttaataattctcaagaaagttgtacaattttccccataaacagcttggacatctctgtagatgaacccctagtttactgatatacatttgttgtgagtttttgcagggagcgggtcgggggaggtgtttgtttcggttttgtttagagacagggtctggctctgtcacccaggctggagtgcagcggcacagttttggctcactgctgcctcaaattcctgagatcaagtgatcctcccacctcagcctcctgagtagctgggactacaggcatgcaccaccatgcctggctaatttttaatttgaaattgttttggtagagacagaatcttgctatgttttccaggctggtctcaaactcctgggctcaaacaatccacccgcctcagcctgccaaagtgctgggattacaggtgtgagccactgtgcccagtccaactgatatttttaatgtgattgtaaattgtatccctctttaatattattttccattcatctgctgatgtacaaaaatatattaaataataggcttatatatttgaaatcagatctggtaaatttgctacactttctcatagttctaaaagtgtatctgtgcagtctgtaggatttgctgcacatttaaacatgtcatctgtgaatggtgacaattttgttgccatcttctcaattcctacacctttcatttttttctttcaccttactctccctgctggtattcagtacaatgcggcatccttgtcttgtcacaaaggatgtttatatacagttcactattaaacacgatgcctgctgtaggttccttgcaggagtctctcaccagattaaggaagttattttacatttctcgtatggtaagtagtttctgaaaatcattcttcagattttattcaatgttttttctgcatcttttattgtgatttttttctcctttaatattgcaatttgtcattcttctaatgtcaaaccgattttgcatccttggaatgcatggaccagacttgtccattatgtactagccagcactatatgtggcactactgtgattaaggcatcgtttattcttcagaattgttttattctctggaggatcttgtgtaaggttggaatttcctaccagtgaatctctctgagccagttttggggttgtttttgtttgttttgagacagagtctcgctctttggcccaggctggagtgcagtagcgccatctcagctcactgcaacctccacctcctgggctcaagtgattctcctgcctcagcctctggagtagctgggattacaggctcgtgcaaccacactcagccaatttttgtatttttagtagagaagaggtttcattgtattggccaggctggtcacaaacccctgacctcaagtaatccacccacctcagcctcccaaagtgctggaattacaggcatgagccaccgcaccctgcctaacccagttttgtttgtgggaatatttgtcactatgtattcaatacccttagaagaactgagattttctacttcttcttgagtcaaatatatgtgtttgattagatttttctaagaatactctcatttcatctcaaagtactggcataatgttgttaaaattgactctattacccattttaggtattccacatctataaaacaaccccccgcccccagccctgtttacactcgatatgggtgatttgtgccttctttcttctgtttttattttgttttgttttgttttgatatagagtctcgctctgtcacgtaggctgaagtgcagtggtgcagtggtgcaatcttggctcactgcaacctctgcctccctggttcaagtgattctcctgcctcagcctcccgagtagctgggattacaggcgagtgccaccacacctggcttattttttgtatttttagtagagacagggtttcgccatgttggtcacgctggtcttgaactcctgacctcaagtgatccgcccacctcagcctcccaaagtgctggaattacagacatgagccgccgcacccacccagtcctttcttctgttcttgataaattcaccgaatcagtttcaatttctgtaatattgtaaaggaactaactgccactttcttgctgcatcatcccactgaatatatgatctacttctttaatacttgttcttccctttcttatttccttcaacttttcaagattattttactgcatttttctgagatctatgcatagctcattctttttcagcttattttctataaaatttctatacatattttaaggtaatcaatttccctctatgtactacattagctgtatctcacaaggttttcatgtaatgatttcattattgcttagttcaaaatgtgacctaatttccaatttgagaatctctctaaatcactgggaacatatttcctcatttccaagcatatgaggatgttctagttatatttttgtgactgatttctagtattttgcttacagaacatatgtggaatgttttggtcctttgaaatttgtttaggcttgttttacaggcccacgtatggtccatgtcttagtccatttgggctgttataacaaaatcccataaaatgggtggctcataaacaacagaaatttatttttcatagttctggaggctgagaagtctcagatcaaggcaccagcaggttcagtgtctggtgaggacctgtttcttagttcacagagggtgccttcttgctgtgtccttataagatggaagggaccaggcagctctctgaggcttcttttataagggcactaatcccattcataaggcccctggcctcatgacctagttgcctcccaatggccccacttccctaacaccatcacattaggtttcaacatatgaattctgggaacacaagaattcagaccacagtagtcaatttctgcccgtggtccttttctttttttttcttttcttgtttttttgagacggagtctcactctgttgcccaggctagaatgcagtggcactatctcagctcactgcaagctccgcctcccaggttcaagcgattctcctgcctcagcctcctgagtagctaagattacaggcatgtgccaccatgcctggctgattttttttgtatttttagtagagatagggtttctccatgttggtcaggctggtctcgaactcccaacctcaggtgatccatctgcctcggcctccaaaagtgctgagattgcaggcatgagtcaccgcgcctggccagtccttttctgcttgaagagaatatacatcccataactctggatgcgatgttccatagataagtccattagctcaagtcgattaagtcttctaatcttctgatatcttcttcaagttatttcaggtaatgcttcttggccataaagttttaaaatttgatgtcaacataactataccaatcttccttggagtggaaatttcatggtatctttttagccattctctatcttagcccaccattctggaaataggagctcttctctaaaaggctttcttcatgcatcatttctgaaacgtgcccttatattatgcaagagttgtgtctgttctccttgcatttccaacagtttagtcacatctctgtgatgggatttcttggccttttctgcacagtatctgaggcaggggcagcacagccgggcgcccctcccccatgcttccagagcacacatgtaacatctgttatagaccatgtcagagagccatcctgcaggtcccagaaacatgactcaaatggcctcagacaaagagggagttattgccttgcataactggaaatccagacgtggggcactcagagccgcctgaacccggatgcccagccctgtttctctgggattctctccaccctgtcttcatctccgcattggctggcttccctcatggaggcaaacagctccggcagagcagggcctcaccccatacatgaagccatccaaaggaggaggaggtcgagaccagaatcccaggagatgcagagaggcctattcctgatgaccaagaccagggctgaggcctactggccttcctcagggcaaccaggggcagggtggtgcaggcctcgggcctaggacaggcagatgatcacccccacccccatcctgccaggccagggacaatggagattcctgagcaagcacagctcaagaaccaaccaaaaattccagcaagaagaacacacttggcagaactctggggagatgcagcaggaaccaggtccaaggcctctggtgtaagggtctccccacctgagcatggggtgaggagtccatgctggggacagcacagcatcaggaagttggggctgtgggcagacctgtcctggctctgtctgtttcttggttcacagagggtgccttcttgctgtgtccttataagatggaagggaccaggcagctctctgaggcttcttttataagggcactaatcccattcataaggcccctggcctgacagccaggtccctgctctgtctcctgcctggagtcctgaggacttcccttgtgtccactctcagcctgattttcccacctccttgccaagcatgggcatcccctctgcccctgccctggccctgctgcagctgttacagagggaggagaccatgggatttgggtcataccttggtccaatttcaggtccaatcatttccaccagggatatttggaaagatatgtaacacctttcggggtaatggctacttcaagttcatatgtaccatgttttgttgatttgaggattaaatgaacatgtaggtgaatggcctgtcatgttactgggtacaggatatgggctcagcactggtcaccccttcccttccttttggttcagagacagagcctgtcccctagtccttaagcactgggggctgacctcacatacactgcagatcacccagagatacacaggccagcatccacattaggctgagcccagagggatggagtcacaatcacacaggggaaaaggctgaagaaaagggagggttgggccagatgtgggtggggtggctcacacctgtaatcccaccactttgggaggatgaggagcgagaattacttgaggccaggagtttcagaccagccctggcaacaaagtgagacccacttctctattaaaacaatttttttttaaaaaaatcagccatgcacttgtagtctcagctgcttgggaggctaaggcaggaggatcagctgaacccaagagttcaaagctgcagtgagctatgatcacacccaatgcactccagcctgggcaagagaaaagagagaaaaaagaaaacaagaaagagagcgagagaggaaaggagggagggagggaggaaggtaaagatagagagaaagatagagagagagaaagagagagagagagccagatagattgagagagagagagagttggctttggggcctgaagaaggcaggatacccattacaggacccaatcagagttcctccaccaaagtcacatgattgagcctttttaacaaccagaactcacgggacaatcactatggccacagatgtgcagcctgtgaaagatgagtggctgcaagtcacaccaccagccatgaacacaaagcctggtgggcctttatggctggaggcaagatgtgcctcagtggagtgggccacgtggacgcatctcccaagtcacacacaaggtggccagtgctgaatgggaacagacaatgagaagtctctgcagcaagcctaagctccagtgcaggtgtctcttccacttggaccttataatctggcacattcagtgaaatccagtatctgtggagagactgggggtgccacacggagcatctggcaagcagcagaagaatcaccgtgcagacctctaggacgtgggagcaagtctgcaccctcttctgcaggtgactctgcttcctctgagaaacagcttccgctcaccactgggccttggtggaaactaaatgcctacccataggacaccaggcaagcacccagcctgagcttcccaccatgacctgggtgccctgacccatgcagccaaagcagcaatcaatcaccagaggaaactgcctataagagcccaggctcagtcaggcccagaagggacaagcaagtgtcatgagcaggtggctcagatccctcaacacctgctcctcagactccatccagcctaaggcttcctgggctgttcctcaggaccaactgactgaggaagaaaacacatgagcttgattacagctgggtatgcacaatgtgctgctgatccctgaaggtgaccagctgcagcactactgcaccactcgagctgccctgaatgacacagggaaggttggcttgcccaggggctggagactgatgggggtatttcgctggcaacttggtctggattgagagatggcaaataacacagatgatggtgactcatgaggagttgctagaggtttggctggttggtcagggactcagaaggatcaatgatcagatttgaaaattaatgacaaggaagggtgggaagaggcatagggatgggcccctcattatggacactatgagcagacaccagcattgcatatgaatgctgaccacatggcacatgaacactctctgcagaagaggcctcgataatcaggtggacaaaatgacacattccatagatgtcagtcaacctcattccccagccatcccagtatttgcccagtgggcttgtggacagaggggacagtcatggtggcacacgtagaggctgtgcattacctcatgagcatggctgctatggcttggatgtggtttttcccctccaaaatgcatgttgaaatttagtccccgttgtggcaacgttgggaggtgggacttcatgggagatatttgggtcatgggagcagatccattgtgaatagattaatgcctttcctgggagtgagttattggtctcacaggaatggcttacttccctcgagagcaagttgttaaataagagagtctggcttccttagtttctctctcttgcttcctctccctccatatggtcactttgcctgctccccttccatcttctgccatcagctgaaaaagcctgaggtcctgaccagatgtagctgcccaaccttggaccttccagccaccagaatcataagccaaataaatggcttttatttataaattacccagccttggttattttgttataataacactaaatggcctaaggcagaaaatctccctcttcctaaggttgacctggctaccactgacaaaagtggccaatctgtcaagggcagagaccaacaccaagacccttatatatcattaatgtcgggggccagccagcctcctgctggcagattaattccattgatctcttctaccatggaaggggcacaaattctggatatggatttgccatccctgcttgtaatgcttcttccagcatcaccaaccctggactcctgagatccctggccaccatcgtgtcattccccacagtgctgtgtctaatcagggaactgattccactgcaaaggaaatgcagcatggaattaactgctcttactacatacccatgcccaggcacggccagactaaaagtggagtgacttactgaagactcagttgtggcacgacttgagagatggcaccctgaaatatggaggtcctatcttaagggtacagtctatgctttgactcaagaccatcaagtgacagtgttttaacggtgcctgggatatttttaaatcaggtatggtaagacatgcagacaaggaaatgactggtataaagaaaagatttgttatactcacagatctcaagaaaagggaacaaaccacgccacacagggccacacagagaagcagcagcattggtcaggaggcagaggggagggggagaaaacaggcaagaacctctgttgtggtttccactgggaaggaacaggggaggcaaggtaagcaggtttaggattggctagtttgaataattttggtgggctctggagcacaggaacaactagatacctacttgtctggtacctggtcttggagtgatgagggcaggtggatagcagcccagcctgtgagagcccaggaaagaaagtgcttcagggccgggcgcggtggctcacacctgtaatcccagcactttgggaggccaaggcgggtggatcacaaggtcaggagatcgagaccaccctgactaacatggtgaaaccctgtctctactaaaaatacaaaaaattagctgggcatgatggcgggtgcctgtagtcccagctactcaggaggctgagacaggagaatggcatgaacccaggaggcagagcttgcagtgagccaaggtcgtgccactgcactctagcctgggtgacagagcgagactctgtctcaaaaaaaaaaaaaaaaaagtgcttcagggtatgggttctggattggttggtttgcacaagaaaggctcactgtttgccatctctaagaattagctaaccctgcaaggggcagtgccccagggtcagcaaggccccagatgtcagatcatcagaaaacagaaaataaaagagcatggttaatacacacagtctccccaggagccacagtacatgggtctgagaatagatggatagaagtgagagtggcttcttccacaaataatcctcctaatacgctcaaataaggtttgcttgctatccgaacatttgagctctgctgctttgaagatcttagttcccaagaatataatgcctctcccaggggacaccacaatggctccattgagttggaactaacagtcagaaacgggggcaactttactggaaggactgattggtgctaacgaggggaaattgggctgctgtgtcacatagtgggggcaagaaggacttcacctagaaccccgagtactcatcatcttagtacttctgcctactcagacccttcaagaatgaaggtttagatcttcccaccagataaagatctgtaaccagctgaggttctagctgtggaacagggaaatatcaaatgggtagtggacaaaagaagtcacagatagcatctgtggctcataactagggtttaccaggtttagtaaacgaaaatacagacgtccagtgagatagtaacttcagataaacaacaaatagtattactaaaagtactatttgtatgtcctatgcaatattggggacatatttatgcttaaaaatgcattcactgtttggacatcctatattttatctggtaattctattcatgaccaagtaaaaaagcacatttttttactttgcttgtcatgtgtggtatatgtatgtatttggagttattaaccatttatcttttcttattatgagttgttagcagagtattcagtgaaattgtgactaaagatgaagataaactaatatagttagctgtggatgcagtggctcttgggagcctgcatctcgcttggaggagagggtgagaatttcgttcatataaaggataactgcttcttattagacggaaacagagttgttttttggttcctcagaagttcaaatgtgtgtagaaagataaatacggaagctaagtaggaaagcgggtgaactctgccagttatcagcggaatgttctagctgcaaattgcccctttctcgcaagctctaggaagccggctggtaaacagcgccctcctttgcccgccgctgcaatgttaggctttgccaaaagagagcacctgggggaagctgcgaggccaccgcggcgagaaggtgctttcctgtttccctgctgtcctttctttttattccgcacagaagccatatatatatatatatatatatatatatatatatatatatagtgtacatttatatattaggcttttaggccatatatatatgtgtgtgtatatatgtatatgtatcgctacatatatatactatatatacatatatactatatatactttctacacactataaatagatagtgtggcacatctatatattacacatttaggctctttatagatatgtaccaccacatatatagtgatacatttatatatatatatatatatcgactaaacagcatttaggctgtttccagctttttgctaccacaagtaatgcaggaattagcaaataagatcttccagataatacccagaggcaggactgctggatcaggaggaatgcacattttcagttttactgccctctaatgtggctgatgaatttacaccctactagcaatgtgtgggttctgtttctctaactctttaccacacttgatatcagcagacttttccatttgcaccacgcagctcttactacaaccctcctttacagctctcaactaacccaggcaggcagcatgcgtgggccagacaccagggcagtcctccactgcagttagatattgagtctccctcctgtgactgggcagacgaaaaggacttgttcactcttgttttctctaacacagcgcttcacacacagagttcttttccagttatgtgactaattcaataaactgcctgagccttagtttcccaatccttgtcattaaatggtcactgtgcccactggtgtgctgggaaaagtttaacaactaacagagtagcaagggcggtgggagtcctaatttgtagcatttgcccatttccatggtataaataatcccaccatggctgatttcaagctaccaaggtgccccactgaacacagagttgggaagagatgctcttaaatcatcagctctcctgagctggtgcaagccagttgcgggacaccactgggctttttgcaaccctgtttcttaattctcagttctgggcaggctgtagtcgcctccccgtgcttctgtacaagtagacagcgacatctggtggcaaagtcaagcaaatcccagaccatgtagagaagggcctagagtatgggaaaacaagaaacacccctcttctcccaccagcacccccacgaaaggttcctgtcctcttcctcaaccaaccctgggacccatcaactccagcaaaaactcaatgcctggggagttcctacatgggcagcctgcaggtctcccttcctgtggcagctggggtagagtggcatggctcctggtgttggaataagcagtgacctcgtacagcagtcattcccactgcctgcctgcagaccccttgccttacccctggttgagaattatcagaagcgtccctcaacccaaagcagtcaccacagcactcctagaacaagagttactcagctagtgtgaccagagcactggttcaccatgagcgcttcctcctggaatttggacaaccatctcagggcctttctttggtcaatttccttctgattctgtgtgtaagacttgtgtgcagaatctcagtggcctaaatatctcagcctatggtaggataggcggggaagtgagggtggcccctgcaatagcaaagccattacacttagcctttggccactaaaaccccctatggcagcaacaggctgctgaccaccgaacgttcacctccttttccatagtgtattccttttcttgagacagggtctccctgtatcacccaggctagagagcagcagtgcatccatagctccctgcaatctcagactcctgggctcaagtgatcctcctgcctcagcctcctgagtagccgggactacatgcacacaccaccacacttagctaatttttgtattttttgtagagatggggaatctcattatttgcctaagctggtctcgaactcctggcctcaaggaatcctcccaccttggcctcccaaagtgctgggattacaggcatgagccaccacatccagcttccatagtgaactgttaaagaaggcatctgtttagcccaggactctactttccatatccctaaaagggcaatgtgtgaaaagattatctgtgcaaatataaagtccctggctgctgcttctacagacaagctcctactgcatcctcaggcaatcacctttccaccctggggctgatcctccagacctgcaccagcccacccacatacccctgggcaatgataggcccttccatggaccagcttctgctcacactctctggcaagcgtcttggcctctggcaggctacagctcacagcaaaaccatgctctcctggaaaagtctgaatctcagccttgcctggggtcccattctcaagctcttagttccttcactcactccgcgtgagtcggtagctgctttctgaatctgctactcatgaacgttgtacagtcctgctttatccttttcatgagctcaccactctttatagtttaacaactctgaaaaaatccctgttcaaattactggtgtggtttgcctcctgagtctaccctggttgacacaatatctcagcatcaaaagatggcatggaaatgaaggtcatctccgaactgctactatgatagaccttcaatcaaatgaagtcaaatgaagccttcaggcattcatcttgcagaatgcaaacagtcagctgccacagggaactgcagaaggcaagcgttgtgaccaaaccataaatgctggtcagccccatctaaatcaggttaaaatggggatagatatcagccagtgagaacacaggcagctttctttggaatggccacttcgggggtggtgggtgagcaaagaatggatgcagatgctctctcctctccaaggagcaatgtggacttcaaagcccacaaagattcgtgagatttattcctagaataagtaccctagagaagcccgcccagcagagtataaaagaaatcaagaatttccggtggacccagaacgtgtcacagcttggggccaaataaattacactcctgcaaatgcctcgggcctagctccagtaaaaagtgacaggacagccatgtgtccaaaagctagtgcattgcacagcaaggaggaaaccaatttcctttagcctttgctcccctagagacgtcatatgaccagagtgaggttggacactcagctctctatcttttcaaataattccccatctccaagttcatggaaagagagaaaaccatcatgtcaccatagcgatgactcctctaatgatggttcagagtggaaaacttctgacttcaaggatggcctcatacaggatggacgtgaatgctggtcctcaaaaccccaatgtcacatttttaaaaatctgaccatccctcagtcagtgtcaggggttttcatgtgggaaacctcaaagaaggtgagaaggcaggggaggtgtaacccacagtaattattaataaaaccaacattccaggacaaactactgctaaggaggttgaattttttttctaaatgatccttcacaagtaaaataaggaactggagtccttggactgatcgctatattatgctaaatggatgacagaatacagctcaggagtcaaagatcataagcttccaagtggccacagggacaataagcctttcagcccttgggtaataaagtcagacaatctggtccagcagccagaagatggctgagctggaggaacatcgatgatgggacagtcccagcgtccgccctctctgctggaaggacattagctgctgagaataactggatccaaattgttaacgtgaccccccactgctcatggggatgaagaaaaagatctggggtgattggaaccttacaaagcagggacacagatgctttatgtctttcgaaggtctagttgtaaaaacaagacccgaaagcagcctctcggtcttttcactgctggccagcaaaactgggagaggactatgttgtgatgtccccaggatatccttcatgattgccaccaagatctgctgggataggtgcccaagacctggaaggaacactaaactagagacccagggatgcacacaccttgcatgttctcacaatgaggctaaaccagactcatcaccgaagaaatgccagccaacagcctgtggacatggatgcagattgactattccagcccctcagtgaacaagctccaagtgtgtttccttgtaaagcagttatacaggtcaaaaatcacttcatcacaaatgaaatacggtcaaactaccacaaaacacagggctaaaatatctcatcaccggagggtgccagagaccaccaaatataatccagattcaaggcagtccatgtgaaaattgcccaccaggtggcggaaatgcagggagacggccagcatgtacagataatttgtttcccgggtccacacattatctgatgagagtgaatctgaccctagaagagaactacacaactacttggttgcattagggttcaacaagactgtgcacgctccaaaaattctcaaaaaggtcaaatccaagtaacaagggttttagcctatgaaccaaggtgtggctagagaaaagattgtttgaatttgaaaagaagctaggaggttgactcactggggcatctatccttgagtcttcctgcagtgggaggcagagtgagcggtcagctgggcatccacatctagagtgttgaaaacctcctgggggtggagacgggggacttccacttccagaatgggcaattgtgtgtgtgtataaaatatttaagatatatgtatttatttaaagtctctagaaatggccttagggcatacagcaaataaaaaaacatttaattcaagaacatctattaaaacctggcaagaaatgggagggtctgtggcatttcaaccacgacctgctccattcctcccactgccagcaaaatgtgacagaaactccactccaggtgggtacagccaaggacacagcactgtctccacccagctcccagtcaagggctatggtattttcccaagaaggaaaatccatcagcatttttcttcccaccccagctacctgttgcagagactaaattccaggtgattgtagtaatcggttgaggctctcttcttttgctcagcccctacttgtgggacaaaagccctgccttgggtgcaacacactgagaatactggcaccatcaaccagctcatttgtaaagtagaggttccatgctatgagaagcaagctgggaatacaatagactctccaataagcacccacctcctaaagcaggggtgtcactcagaaagtagctacctaccactgtccccacccagccccagagccatagccaaaagctcctgaaacatttccccaagaggaaaggcaggacatagagagctctaaagcccttcccgaatgaactgactttatttgcaaatgagtacaaagttcaacattaaggggactttcaaaacaatgaagcttgggcaaaaagcaattgagaggaaactggtaagttcattagtgacataaactagaccataggccagctagtttatcagagagaaccaggaaaagacatggctaaaaacagacctcttggggtcaaagcaaacctcaaacactgacctcaaaaactatccctgcaaatgagcctcagtttaattggataagtcatctcaataaaggtgttttttaaagaaaaaaaacagcaataacaattatacattctggtcaacatggagtaacaggagctggatttatttttaggcctggaataattttaaaaacaacacaaaatatttaagtcactggacatcaggcaatgaaagatagtggtttataagagatgagaaatgaataagatgagccccacgattgccccagattactgcatggagagtttccagtctgaggctcaaggaggagagaacgtaaccacagcccactggcctccccgagttgaagaaacagagctgcttgggatcccaggccgctggagttcatagggcagagtaccaaagaggagggagcttaacagaaagagaactctgcaaatacgagagtgtaagtattatactgagtagtgatcagtgtatgcatatgaggaatgtacctgaggccaagaaaaagactacccaaaagcattgaacagaacaatccccagagaaaattcagggctgaaaataatgcctgacctcatcaacaagtacagaaaatctcataattcattaagcatcaggtagagtactcagaggagtcttcctgatctgtggacaaaattaaccatagacttaatgctgttgtggtctcatgtaaaaatgttaaaagaaagctggggatagattaaactgtttcaaaataatttaactgtgtaccagaacacaacttaagaatacaaaaatatctagcacctgcaaagataaaatgcacaatgtctagcattcaactacaaattaacatgcaggcaaagaagtggaagaatatgatccatagttaggaaaatatcagccagtcaaagctgatccaaaattgacataggtaataaatagataaggtcattaaagcagttattataatactattccatatgtataaggaactagaggaaggattaaacatttttggcgaatgcacagaaggttttttctaaaaccaaattaaacttatagaaaacaatgtgatgaaaaatacactagatggaattaatgacagattagaaactgcagaagaaaagattagtgaacttgaaggcagagcagtagaaattatacaaaattatcagagggttaaaggactaaaaaaataaagagaacatcagtgacctgtgagataaatgccagtggtaaaatatatatgtggttaaagtctctgaaaaagaagaggggatttgaaaaaataatgacagaaaattttcttaatgtgatgaaaactgtatacctacggattaaaaaagttcaaccaaccgtaatcacaaaaacatgaagaaaaccataccaagtcacactatgatcatcaaatttcttaaaccaactcatctaagagaaaattttaagtggccagaagaaaaaaaatacattatatgcagaagaacaaagaaaaggatgacagcagatttctcagaaaaacaatgcaagtggccaggtacagtggctcatgccagtaatcccaccactttgggaggccgagatgagaggataacttgaggccaggagttcaagaccaacctgggcaacatagcgagaccctgtctctacaaaaaaaaaatttttttaattagctggtgtgatggtgcatcactgtagtcctagctactcaggaagctaaggcaggaggatcacttgagcccaggagttagaggctgcactgagctataatcacatcactgcactccagccttagcaacagagtgagaccctgtctcaacaaaataaaaaataaaagacacaatgcaagttagaagagagtggaacaatatctttaaagaatttaaaggaaaaaagttcatcctagaattatttacctagcacaaatatctttcgaaaaagaaggctgagattttttagacgtacaaaagctgaatgtatcattgaattttcactataagaatttttaaagaaagtcttcaagcaaaaagaaaatgacatcgcatggaaatctgggtctacacaaaggagtaacgaagggtgccaaaaatggaaactatatggataaatatacagacttgttcctaattatttaaatctctttaaagaatattaaactatttaaaggagaaataatgacattcataaattaaaatttaacatttataacaaatgtaaagtaaaacatacaacaatatcacagaggctagagaggagaaatgaagtacagatactgggagatcagttccaagaccacccaaggataccaaaatctaaggatgctctagtgccttatataaaataatgtagtatttgcatataacttaagcacattctcccatatactttaaatcatctctagattacttataatacctaatacatgtaaattatctgtaaatagttgttatactgcattgcttttattattgtattatttttagcaataaaatattttttaatttttaattttaatttgggtgggtacctaggcaggtatatgtatttatgggatacatgagatgttttcacacaggcttgcaatgtgtaataatcacatcttgtaaaattgggtatccatccccctgaagaatttattctttgtgtcacaaacaattcaattacactcttttagttatttttaaatgtataattaaattattactgactatagtcactctgttgtgctgtcaaatttattcatatccattctttttaactacttttttgtacccattaaccatccccacctccctctccccttcccacccccatctcatcctctggtaaccatccttctactctctatcttcatgtgttcaattgcttcgatttttagatcccataaataagtgagaacatgtgtttgcctttctgtgcctggcttatttcacttagcacaatgacctccagttccatccatgttgttgcaaatgacaggatctcattaattcttatggctgaatagtactccattgtgtatatgtaccacattttctttatccgttcatctgctgatgaacacttaggttgcttccagattttggctattgtgagcagtgctgcagcaaacatgggagtgcagatatctcttcaatatactgatttccttacttttgggtatatatccagcagtgggattgcgggatcatatggtagctctatttttagttttttgaggaaactccaaactgttctccatggtggttgtactaatttacattcccaccaacagtgtacaagggttcccttttctccgtatcctctccagcatttgttattgcctgtcttttggatataagccattttaactgggatgagatgatatctcattggagttttgatctgcatttctctgatgatcaatgatgttgagcaccttttcatatgcctgtttgctatttgtatgtcttcttttgagaaatgtcaattcaaatattttgcccatttttggattgcattattagatattttcctatagtcgtttgagctccttgtacattctggttatgaatctcttgtcagatgggtagtttgcaaacattttctcccattctgtgggttatccttcactttgctcattgtttcctttgttgtatagatttttaacttactctggttccatttgtccatttttgctttggttgtctgtacttgcagggtattactcaataaatttttgcccagaccagtgttctggagagtttcttcaatgttttcttatagtagtttcatagtttgagatcttagatttaagtctttaatccattttgattttgtttttgtatatagtgatagatatgggtctagttttattcttctgcatatggatatccaattttcccaacaccatttattgaagagattatcttttccccagtgtatgttctcagcacctttgctgaaaataatttcactgtaggtgtgtggatttgcttctgggttacccattctgcttcattggtctatctgtctgtttttatgccagaaccatgctgttttgttttatatagctctatagtataacttaaagccaggtaatgagattcctaaattttgttctttttgcttaggatagttttgacgatttagagccttttgtggttccatatacatttttaaattgttttttctacttctatgaagaatgtcattggtattttgataggaattgcattgactctgtagattgctttaggtaatatgaatatcttaacaatattgattcttccaacctatgaaaattgaatatttttccattttttggtgttctcttcaattcctttcatcagtgttttatagttttcactgtagagatcgttgacttctttgattaattcctaggtattgtatttgtggctattgtaaataggattacttttttatttcttttcagattgctcactgttgacatacagaaatgctactgatttttgtacattgattttgcattctgcaactttactgaatttatcagttctaatagttttttgtggagtctttaggttcttctgaatataagatcatctataaacaaggataattggactccttcctttcctatttgaatgcctgttatttctttctcttgcctaattactctagctaggacttccagtaatgtatcaaataacagtggtgaaagtaggcatctttgtcatattccaaatcttagaggaaaggttttcagtttttccctattcagtttgacgctgaccatgggtctgtcacatatggctttcattatgttgaaatgtgtttcttctatacctagtttttcaagggtttttatcatgaaggcatgctgaactttatcaaatgctttctcagtatcagttaaaatgattgtattttttttccttcattctgttgacaagatctatcacactgattaatttgcacatgctgaactatctttgcatgccaggaataaattcctcttggtcgtgatgaatgatcttttgttgaattttggttgctactattttgttgagaatttttgcatcaatttcatcaaagatattggtctgtagttttgttttgtttttttcaatgtatctttgtctgacttcatcagggtaatgccagcctcgcagaatgaatttgaaagtattccctcctctatattttagagtagtttgagtagaattgatattagttcttctttaaacatctggtagaattcatcagtgaagtcatcgggtcttgggcttttctttactgggagaatttttattatggcttcaatctcattacttgttattggtctgttcaagttttaaatttcttcatggttcaatcttggtaggttgcatgtgtctaggaatttgtccatttcttctagatttttccaatttattggcatatgattgttcatagtagccactagtgatccttttaatttctgccgtatcagtagtaatgtctccttttttatctctaattttattttttcttaatgtgactaaagttttgtcaattttgcttaattttttttaaaaacaactttttgtttcattgatcttttgtattgttttcttcatttcaattacatttatctctcctttaatctttattatttctttccctctactaatatggggtttcattttctcttgcttttccaattctttaagctgcatcttaaagatttatttgaatatttatttgaatattttttctttttttgacataggcacttacagctataaactgccctcttagtagtacttttgccatatctcatagaatttggtatgttgtgtttatcatttgtctcaagaaattttttaattcccttcttaatttctttattgacccattggtcattcaggagcatattggtaatttacacatatttatattgtttccaaaattgctattattgatttctagtttcattccattgtgataagagaaaatattatatcttaatattattccaatttttttaatgatttaagacttgttttctgacctaacatatggtctattttgataatgatccatgtgcttaggaaaagaatgtatattctgcagctgttggatgaaatgttcagtaaatgtctattaggtccatttggactatagtgcagattaagtccaatgtttgttgctttttgtctggaatatctgtccagtgctgaaagtggggtgttgaagtctccagctattattttattggaacctatttctctctttagctctaataatatttgctatatatatctaggtgctccagtgttgggtatatatgtatattatatcctcttgctgaattgaccctttatcattatatagtgacctttgtgtctcttagagttattgttttaaaatccgttttgtctgatataagtgtagctattcctgatttttggtttgtttgtttccattggcatggaatattttttccatccctttattttcagtctacttataggttgagtatgtttcttgtaggcaacagattattgcatcctttttaatccattcagccactctattttgtttggagagtttagtccatttacatttgatgttattattgataagaacttactcctgccattttgttatttgttttctggttgtttcatgatctcttccttcttaccttcttgttttcgttttagtgaaggtgattttctctggtgacacaatttaggttcttgctttctattttttgtgtatccattgtggttctttggtttaaggttactatgaggcttgaaaatactatcttcttacccatttttttaggctgataacaagttaacactgcataaacaaacaaacaaaaagaaaactaatgaagactgtacaccttaactttgtccccctgcttttttacttttgttgtttctatgtatatcttattgtactgtctatgccttgaaaagttgcagttattttttgtttgttcattgtttagtctttctacttaagataagagttgtacaccacagttagagtgttgtaatatgcttaattttctgtgtactttctgtaatagtgagttttgtaccttcagatgatttcttattgttcattgatgtcattttctttctgattaaagtactccctttagcatttattatagaacagttctggtgtattagactgttcttgcactgctaataaagacatacccaagatggagtaatttataaagaaaagaggtttaattgactcactgttccacatggctggggaggcctcacaatcatggcagaaggcaaagaagagcaaagccacatctttctcacatggtggcaggccaagagagaatgagagtcaagtgaaaggggaaacttctttaaaaaccatcagatcttatgagacttattcactataatgagaacagcatgggaaatatccgtccccatgattcaattacctcccaccaggtccctcacatgatgcataggaattgtgggaactacaattcaagatgagatttggatggggacacagccaaatcatatcattctgcccctagcacctcccaaatctcatgtcctcacatttcaaaaccaatcatgccttcccaacggcctcccaaagtcttaactcatttcagcattaactcaaaagtccacagtccaaagcctcatctgagacaaggcaaacccttctgcctatgagcatgtaaaatcaaaattaacttagttaattcttagatacaatgggagtataggtattgggaaaatacagccactccaaatgggagaaattgaccaacacaaaggagctgcaggccccaagcaagtccaaaatccagtgggccagtcaaatcttaaagctccaaaatgatctttgactgcatgtctcacatccaggtcatgctgatgcaagaggtgggttcccacagtcatgggaggctccaaccctgtggctttgctcctccctcctggctgctttcctgggctggcattgagtgtctgtggcttctccaggtgcatggtgcaagctgttggcagagaatgccacaaagatatcctcgggaagagcaaccccaagacacataattgtcagattcaccaaggttaaaatgaaggaaaaatggtaagggaagccagagagaaaggtcgggttacccacagggaagctcatcagactaatagtggatctctcagaagaaaccctatgagccagaagagagtgggggccaatattcaacattcttaaagaaaagaattttcaacccagactctcatatccagccaaactaagcttcataagtgaagaagaaataaaatcctttacagacaagcaaatgctgagagattttgtcaccaccaggcctgccttacaagagttcctggaagaagcattaaacatggaaaggaacaaccagtaccagccactgcaaaaacatgccaactggtaaagaccatcaacggtatgaagaaactgcatcaattaacaggcaaaataaccagctagcaacataatgacaagatcaaattcaaacataacaatattaaccttaaatgtaaatgggccaaatgccccaattaaaagacacagactggcaaactggataaagagtcaagacccattggtgtgctgtattcaggagacccaactcatgtgcaaagatgcacataggttcaaaataaagggatagaggaagatctaccaagcaaaggaaaaattttaaaaatgaaaagagcaagggttgcaatactagtctctgataaaacagactttaaaccaacaaagatcaaaagagacaaagaaagccactacataatggtaaagggatcaattcaacagaagagctaactaccctaaatatatatgcacccaatacacgatcacccagattcataaagcaagtccttagagacctacaaagagatttagactcccacacaataataatgggagactttaacacccaactcttggtattagacagatcaatgagacagaaggttaacaaggatatccaggacttgaactcagctctggaccaagcagacctaatagacatctacagaactctacaccccaaatcaatagaacatacattcttctcagcaccacatctcacttattctaaaattgaccacataattggaagtaaaacactcctcagcaaatgtaaaagaacagaaatcacaaaaaaactgtctcagaccacagtgcaatcaaattagaactcaagattaataaactcacccaaaactgcacaaatacatggaaactgaacaatctgctcctgaatgactgctgggtaaataacaaaatgaaggcagaaataaagatgttcttggaaaccaatgagaacaaagacacaatgtaccagaatctctgggacacatttaaagcagtgtgtagagggaaatttatagcactaaatgcccacaagagaaagcaggaaagatctaaaatcaacaccctaacatcacaattaaaagaactagagaagcaagagcaaacaaattcaaaagctagcagaaggcaagaaataactaagagcagaactgaaggagatagagacacaaaaacccttcaaaaaatcaatgagtccaggagctggttttttgaaaagatcaacaaaatagaccactagcaagactgataaagaagaaaagagagaaggatcagatagatgtaataaaaaagataaaggggatatgaccaccgatcccacagtaatacaaactaacatcagagaatacataaacacctgtaggcaaataaactagaaaatctagatgaagtggataaattcctagacatatacaccctcccaagagtaaaccaggaagaagttgaatctctgaatagaccaataacaggctctgaaattgaggcagtaattaatagcctaccaaccaaaaaaagtccaggaccagatggattcacagccaacttctaccaaaggtacaaagaagagctggtaccattccttctgaaactatttcaatcaatagaaaaagagggaatcctccctaactcattttatgaggccagcatcatcctgataccaaagcctggcagagacacaacaaaaaaacagaattttaggctaatatccctgatgaacattgatgcaaaaatcctcaataaaatactggcaaactgaatccagcagcacatcaaaatcttctccaccacgatcaaattggcttcctcactgggatgcaagcctggttcaacgtatgcaaatcaataaacataatccatcacataaacagagccaacgacaaaaatcacatgattatctcaatagatgcagaaaaggccttcgacaaaactcaacagcgcttcatgctaaaaactctcaacaaactaggtactgatgggacgtatctcaaaataataagagctatttatgacaaacccacagccaataccatactgaatggccaaaaactggaagcattccctttgaaaactggcacaaaacaaggatgccctctctcaccctcatattcaacttagtgttggaagttctggctagggcaatcaggcaagagaaagaaataaagggtattcaattaggaaaagaggaagtcaaattgtctctgcagatgacatgattgtatatttagaaaaccccatcatctcagcctaaaatctccttaagctgataagcaacttcagcaaagtttcaggatacaaaatcaatgtgcaaaaatcacaagcattcctatacaccaataatagagagccaaatcatgagtgaacgcccattcacaattactacaaagagaataaaatacctaggaatccaacccacaagggatatgcaggacctcttcaaggagaactacaaaccactgctcaatgaaataaaagaggacacaaaaaaatagaaaaacattccatgctcatggataggaagaatcaatatcgtgaaaatggccatactgcccaaggtaatttatagattcagtgctatccccatcaagctaccactgactttcttcacagaattagaaaaaactattttaaagttcatatggaaccaaaacagagcctgcatatccaagacaatcctaagcaaaaagaacaaagctggaggcatcacactacctgacttcaaactatataaggctacggtaaccaaaacagcatggtactggtaccaaaacagatacatagacctatagaacagaacagaggcctcagaaataataccacacatctacaaccatctgattttgataaacctgacaaaaacaagaaagggggaaaggattccctattttttaaaatggtgctgggaaaactggctagccatacgtagaaagctgaaactggatcccttccttctaccatatacaaatattaactcaagatggattaaagacttaaatgtaagacctaacaccataaaaaccctagaaggaaacctaggcaatgccattcaggacataggcacgggcaaggacttcatgactaaaacaccaaaagcaattgcaacaaaagccaaaatagacaaatgggatctaattaaactaaagagcttctgcacagcagatgaaactatcatcagagtgaacaggcaacctacagaatgggagaaaatttttgcaatctatccatctgacaaagggctaatatccagaatctacaaagaacttaaacaaatttacaagaaaaaaacaaacaacccatcaaacagtgggcaaaggatatgaacagacacttttcaaaagaagacatttatgcagccaatagacatgcaaaaatgctcatcatcactggtcatcagagaagtgcaaatcaaaaccaaaatgagataccatctcacaccagttagaatggcaatcattaaaaagtcagaaaacaacagatgctggagaagatgtggagaaataggaacacttttacactgttggtgggagtgtaaattagttcaaccattgtgggtcttaagaaagtgtggctatttctcaaggatctagaactagaaataccatttgacccagtgatcccattactgggtatacacccaaaggattataaatcatgctacaataaagacacatgcacacgtatgtttattgcggcactattgacaatagcaaagacttggaaccaacccaccaatgatagaccggattaagaaaatgtggcacatatacatcatggaatactatgcagccataaaaaaggataagttcatgtcttttgcagggacatggatgaagctggaaaccatcattccaagaaaactatcacaatgacagaaaaccaaaaccaaacaccacatattctcactcataggtgggagttgaacaatgagaacacatggacacagggtgggaaacatcacacaccagggcctgttggggatggggtgctgggggagggatagcattaggagaaatacctaaggtaaatgacgagttaatgggtgcagcaaaacaacatgacacatgtatacctatgtaacaaacctgcacgctgtgcacatgtaccctagaacttaaagtataataaaaacattttaaaaatcatccatataaccaaaaaccacttatacccctaaagctattgaaatctggaaaaaaaaaaaaaaaaagatgtcccttaaccacactatccagggccagatacagcctatgttccactggaaggtcaagtgagtatgaaagtttaggttgctgtcacttatgtcccctaagctgagctattaaccattagaggcctctgcctggcctgcatcaccaagcaggagtggctggtgacaatgccaccaaaacaatgccactaattgctaaccaatggtggagtttttattttgggtggcccctactcagctgaagactgcatgcccatgtgaccttactttggggtgtttattgggtcacggcttcttacagtgggacatgtggccctttgaagtacaatctttgggcaatctcgagggcttatgcatcactgcgcttctagtgggcagctgcagcaatggagctgtggactcctttcttttaagagacttttgtatcagaagagaaaatacaggccctttattccaaatgtaaagggactcctttatatctgagatttttatccagatcattcacataatttttaaaaattgtcctcagttattagaagcatcattctgggtggcctgggcaggggctctgaagattgagcacctgtttggggatctttcccttagtgctgttattgaattaggaagcccacacaaaactttgtcttggtcacactttgggtctatgtctggccaaaggcaaaggatgaatgagccatctggtcacttccagaggacacttgctgctccttcctttctggaagtcataaaacatgcatgcagatccagaaagctctgattcctttccttttttagattatctttcccctggttctttttaagaatcatacattgtttaaaaaaaaaaagaatcatatattgttaactacaaaagttttgcatgctcattgtaagaactgaaaaatgcataaaaccttaaagaataagttactattcttcccccatccattcctatctttctgaagtaaccagaagctgtgtatctttcctccccttccttttgtcttgtctttctctctcttctttttttttttacagagtcttttctctcttgcccaggctggagtgtagtgtgcaataacatgatttcggctcactgcagccttgaattcctgggctcaggtgatcctcccatgtcagctcccccaagtagttgggactactggtgcatgtcataacgtctggctaatacttgtttaattttttgtagaaacaggtattaccacgttacccagtttagtctcaaactcctggactcaagtgattttcctgccttagctcccctaaaattctggattacaggcatgagcttcctcccctttctcagtgcttatgcaaacatacgaacgcatatgtagaatttttgcattgtcttcacaaaaagtaggattatatcaaacacattactctgcagcttgatttttaacttaatatattagagtcctaaggtacaatagatacaatacaatagatacagacctagctcatgttttaatcagctacatagttgtcatacaaacgtgtactattcagctcttccctattaattgacacttagattgttgccaggtttgtttgtttactgtgttggtgcttttcatttgtgtggtgtggattcccaaaattgaacttgcagagtcagaaggacatgtttacattttaatagctatcgctaaatggcaatccccaaaggttgttgacatctgcatttcacactggcagcatatgagcatgcccttttccccaagctctccccagccttgacagctgcttgtttaatttgtgcatgtgccaatctgatgggaaagcagtgatgtctcgtagctttcatttgctcttcccaaatgctattgatacaggagttaagaagaaatcacttacccagatagtaagggtatggaactccttggtaaggcttttctcattaataaaaagcagccccaaattattttcttacaaagaacagcctgtaaattcaagctgcagccacagataagcaagataggagcttgcacaggtgaatactggcaggaactagggactagacatgttcaagacgacagctccatattcccttcactttgtcagccacgtgaacagtaaagagcagacaagatggcaccgggcaactggtaagctcagttgcataagattacttattatgcaatgctatgtaaacatcatacctgattgaaccaatctgtgagccttatgtaaatcagacaccaccttctccagcgtacttataaaatctgctgcggtccactatctcccgcttttcagacatctctctctcacaaggagcttctcttctctctcctttctcctattaaactctccactccttaacctacccacatgtgtccatgtcctcgattctttcttggtgtgagacaacaaaacccagggtatacaccccagaaaatgtagccatttcagttgggggttctcatctgggattgggatcagaacagaaggtagaatcattggagtggtaagtatggagtgaacctcaaaatctgtcctttcattctgaggctctcagcctgcattttaaaatcaaattaaatcaataacatgtatacatcagccatttaaaaatatgattatcatggctacccttcttaaagactcggatgtcaggcttactggggagaatatggaaaatcccccaatactcacaggtcattgggttcattggccatgctttgaacaagcttcctttcatggagaacctaactatcatgtgaggccagaagtcctggagcaactaaaagtttccaaccagggcacaccctggtgttattcaaaggtttctggactaacccagcttctgacagcccatctgggtgttagtaaaggatccgcagctatcttgttgcagaattttcctccttttcctatctatagtcgctatgtctctatcctctctgtgtgctcagtgtgtggaaagttttacagttcagggaagtaatcatgtttgacaagatcagggaatgtcgtactaaccagggatatagctcaagggaaggcaactctgtgattttctatgaacagagggtccccccacacacagtgagcatctctctctgcccttggtctggagagcacatggcatttccaggtctctctctgcccttggtctggagagcacatggcatgtcaaagtcactctgcccttggtctggacagtatatggcctttcaaggtccactgtgccacctagtggaatagggatcctctccacgaggcactttgtccgtccttcaccgaaacagcctcactttccaattctctcccctttttatgcctctctactagaaaccaggcttcatgctacttctgtaaatgggaaaaatctgctgtcaacaattaggagtaaaatatcctccaaaaccgaattttagtctcggtactgtcccatcagcagcaaaaatggccatttggtccttatgttctcttaaggcacctattctatctccaattagtatggcttccagtctcacttatctgcggccacctccaaccatgccaccagctcttccacctccaccatctccaaaatttcccactcccccaccttcactcttacccctacaggaaatgcccaatggaggtgatgccactagggttcaagttcccttctcattgcaggaccttagacaggtaaagggagacttaggccaattttctaatgaccctgataggtatatagaagctttccaaaatttaactcaggtacttgacttctcacggagggatgttatgctgctgctaaggcaaaccctaactgtggctgaaaaacaggtaactctgcaggtggcagagaattttggagatgagcaatatgtctcctataacaggcaaaaatgaaaaagagaaaatagggaaagtgaagaaatagggaaaacaccattgtcaataggaaggaaagcaatacttcttgacaagtctaattggaaccccagaattttctgtggtatttgaccttctttcacagtttaaaatggcttctatcttcttttataatgttcttccaacctgggaaaagtcaattttccaaaccttaaaatgattggcttagagttgagctaaggggaagagaacccagaagcctgacatgctagcagagtaaaaatttcttaccagtcagacttttggctcctctctccctgtgcaaaccagtaaaagggataataaggatcattgtttatattctctgtaaagttttaactaatgaaaaaggatttgtgagtttggtcttaagctgtagccaatctggtgtgctttgtgtgtttttctgtatggttctgtcaaaagaaagggtactttaggttaggttacagacacaggaaaccaaaagcctgctgttcaagcaagccaaacaaaataatcagtaacaaacttggttacaggccaccatcttgtttcatgtccttgggaacatgacctgtaaccacatggcagtactttgttttagtctctgccattttacaatggtggctgtcttcttgtgctaagtcaattcctgggtgagggccacaaaatcagataagccagtttgtcaatctgggtagtgccagctgatccatctagggtaatgtttataaaatatcttaagcactgatcttgagagcagttaaggaagggtcaaaaatcttgtagcttccagctgtatgactcctgagccatggtttccagtcttgtggctagttttttggtctggtccccaaacaagagggaagtatatcttaggaaaggactgttatcatctttgttttggactacaaacagtgaaccaggcccctcccaaagttggttcagcctacacccagggatgggcaaggacagcttgggggctggaaacaaaatgaagttggttgggtcagatctcttctactgtctcagtaacaattttttaaacacagtttcaaaagcgcttatcacccccttaaaaatactttgtacactcgcggttaagtcataacctaattaaggcttgttggcttcaactgtgaggttaatttttgtaaagttcaaaaaccaaaaattttaactccttggcatggctaaagttgagtaacaaaagaattaaaagaattttcttaaagaacactcagtttaattaaaagtggatattcaagttataggtatatttaaaagacctttatatttttctcttcttaaatttttctgggaaaagggtttttttctccatcaactgaattatttttctccattctttgtcttgacacttttaacacatgcacaagaggccctaagataacttctggtaacatgggattccttgggaaaaacagagaccacagactccattttgggggggaaaaccctctgttttcctcataaaaccccaggaattaaaagcagatagttccctctcaaaatcaaaggctctgtactattttgcattgtgttatctgacagttttaagtttgaggggcatcaaattactgcacattacagagacctttggtgtctaataaccaggtaaggaaaacactttaagggatggctaatagtagttataaatcagagaagcatgttattggccacctgaaagatatggaaatatccccaccccccactgagagatgaggctcctgtgggaaatgggctgattacaaaataagccaattgtctttgggttgccttgcaatgaaatgcatagtagaggcactgcacactgtcttctcccatagaatctccctccttttggggatccaagatccagaataaaatggcacccttaattttgaggatctgcctttgccttcagctgtgcttgcttattttgccctagaaatgcatgccttcctggcactgttcctccaagggctccaccctgaagcaagtaatccaattaagaaattggcaaatacaaaaatcgtacaagtgttgaatcttctgtttgtggtcgctataaatgtgttgtgtgtaatgtctataaaaagagctctaattgattggcttaaagaaaaataggcacttaagtcaaatattttttagttcatatgactttaatctttaagaaacaaaaatagtcttaagggttattggtaaaatgcaagtgtcatcaaaattcaaataggtggtctaaatcatacaacttagatactaggtttgctaaatgttccaaggttgtattactggttgctttacagataggtaaggccttggacacgtagagttagatactagaaagagtcaaaccttatctgtacttctatctgggtcctaggttccacacctggtaaataattacaatcacttactaaccaggtttttcaccaatgtaaaaattgctaagagttaacagcgcaacatgtatttgagatgactaaacagttttatctgcaaagtgtataaaaacagtaaagtatgtcttttagtaaaagattacaagaaagcatagaaatgtaaattttgcctagggataagggattatcttaaatttgatatgataaaggtaaaggtttaagtaagttgtggaagattgtaaaaattaatcttgcaaaaaatgtgtaaacattaactaaattcaaaatggtatcttatagtcttttcacagattgaacattgaaataaaagcacagcaaagctgtcttaagacaatcatcttccctttagcaaaaggggttataaaaggtttctatagatttcacctcatggttacattggttaagattagatggaattgtctatgaggtttcattagaaattggggtttaacattaataaactaatgcaagggaagattttggctttgaacaggatttccatgcagtagtaaaggctaatgaaaggtttttgctttttgagtcatcattttggcaaaataagtaatttacggtaatgtggaattctattttgtaacatcaagtgttttaaacctctaacacttaacaggcattccaaaatcaaacttcaagtttcaaaattgtctttcctgatgcctggcattctggatggttcagagggcccctgaaacattcagaaaagaggtgtacaggattgtttgacctgtttagtcacatgaaattgccaaatgatgtccaattctctttaagttatattttggtgaatactaatatatgttccaaaattgtatgggatttctaaaattctaccttctgagtatatgctatcaatcataattaatggtaaagttattgtaaaccatggagataactgaacttcatcagtcatgtttttaactgtaactaccctggaaattttgtcattcacggacaattgttgtcttgctttgttccttctcaaaagatggtttataatcaagctatattaaggactttaacacatgttctcgaatgcaggtttttaatagctttgaagattgtaacattggaatagagaaagaacatacaaggctcatgaaaaactgaaatgtttacaaatgtcaagcaaaacaagagttaactaaatggcctgccctcagaaagttaaagcaatgtttttgacttttgcttggaatattcctgatccttgttttgtttttcagagtcaaggaagcttgttttgaactatttgtggcctttattaattgagtaaggtatgctgctgtgaacaaaatttggaagatgtttgtttctgtctagttcctctagaatgtggaaactatctgtgagtattcttaacatatggcaatatagttgtttagatcaatgcaatacaaatccattttttttttgcaacaggacacaattggaaaaactggctattttatcaaggctttgactggacaggtatgcttccctttaaggagtcaatcttgacctgcagagccaataaaagccccttggggaagactggcctcataccttgtctacacagtccatgtacagggtttctgacctgtggtcagtaaagaatgtcactttctaacaggtccaggagctcacaggtatttgaggagatgaacccatggctgggctcagctctaagggatcctatttaagattccttgtggaatagagttccatcaaagtcaatccaaaaggcccatgtagagataagcattgttgctgcactttatgcaaatgatcaggccaaatataagactgaagtttattctacaaacaacacagtcctataaccatttgtgaagtgagaactggagagaaaaagattacgctccaaagcttaccaacatttgtcattaaatcctagtcttacagccgggcatggtggcgggcgcctgtagtcccaggtactcaggaagctgaggcaggagaatagcgtgaacccaggaggcagagcttgcagtgagacaagatcgcgccactgcactccagcctgggtgacagagtgagaccctgtctcaaaaaaaaaaaaaaaaaaaaaaaaaaaaaaaaaaaaaaaaaaacaagaaatgatcttgtatggtaaatacttgtctcaaagagaatgcttggttgtttaaaacatggatgttaaggacaagtcactagcttcaagcatgttgtagatggatcatggaagtaatgaaaggattaaaaggatgataaatacttgtccttaaatgaagagttggttgtttaaaaagaagggtctttaggacaagtcagaaagtttaagcatgtcttagatggtctgtggaagtcatgaggggattaataattgcaggaaagatttagccaaagttaacactgaagttactgtagccacccaaattcaatgccacttattctaaaaaagaacgttacttttatattaatgtttcagcagcatctggtggaaggaaaccagtatcacaacccattggaatgactgacagcaatcaaactccaaatggtgctgcagatcaagccacacatggacacatctttcttccaaggacccttagatcaacccaggaggagtcctagctgctgttacccacatgatggcccctttcagcaggaagtagccagaaagagtcatcatccaatttccccaacagcaattagggttaacactccagagcggggagtgatacaggaggtaagaagaaatcactaaggcagatagagcagacagtatgacactgatcaaccagaaaacctatttgcataataagatcagggtgagacaaccaggcttccctgcatgctatgtgaatgtcatacctgactgaaccattctgtgagccctatgtaaatcagacaccaccttctccagcctgcctataaaacctgctgtggttggccacctccccctttttggatgtctctctcttgcaaggagctgctctcctctctcttttattaaactttccgctccttaacccactcagacatgttcatatcctgaattctttctcagtgagagacaacaaaccccagggtatataacccaaacaatgtagccatttcactatgaggttgagcatcttctcatgagtttctctgttgtttctcgtcttctgtgaatagccagtttatttggccatttttgaattgggttgtttgactttacttttgtcaacctgtcatttcactaatgatttttccaaagtaccagttgtctagaccagtgttcctcaatctcagcactactgacatttggggccaaataattccttgttgtgaggcatctgtcctcacaagcatgcttagaagtatccctggcccctactcagttgtgacaaccaaacatgttccggagattgccatatgtcccctcaggggatggtggaaaatcaccattggtctagactctgctgttggtggctttttcttatttgaatttttgttcacttttaaatgtcagcattctcttttcctgtctaccttctagatttcctagcttgcttaggaatgtttttctctcttcaagactatacaaatattattctaaatgttctaacatttttatgttttttaatgtttgcatttctagaatatctagaattcacctttttgtatgatgagataggaaaagtctagctttattttattccagttattgagcaaatcagtcttttcccactgaattgaaatgtccacatttgcacagatgaaaactcctttctgaaagcatgtgtaagcttctgcctgctgggccccccacaggaaaccgagaagccttgatctttgttgctggtgccctggctcttacaggagattaaggtaggggaaacatacactttttgtttgtttctctttatcaattttggcccagagatctttgagaaagtattaaatatatcttccgctccccaacccaagtctggctattgtgactgttgtattattccagaaagggaacagggaggaagaaagaatcagagacatgtggttaaagtcatcttctttctggaatctcttcgtctggcttgttttttgttgttttgttttttagtgaaaagagggtgactttcttcatctgagaacattttataaatttctttcaaagttctaatacccttctacctacctaccattgataccttctataagaaaggtcaactatacacatagtaggccctcaaatacttactgaatgaatgaagtaagattaacttaatgtgattcaggtgttctggtttaagcctctctgatgtgaagaaactgcctgtaaaatgcagatactgctggtggcagtaataagttcacttgttgcatggaaagtatttctaccaacaagttgtcatccttaggtcatgctaggcccaggtaattagggaaatctctaatattgccttttggcctacctggtctggggatcagggctggggaccctgagtagagagcacttgggttaattagaaggacactatagcaacagcaatgtgactgtccttttggaagcagcaaggcatctattaagctttgccagtcctgattgatgcatacattcactaaaccacttctctccctgaccctgctggaaaccatggtactgcttaactatttgggtacgggggggagaggcaatcttattttcacatgaggagaaatgatttagtcttgcagtttcatagctggaagggactgtagtctccacgggccctcctctaacttagggggtagcaggttccattcctaaaaagaagggaggaatggacttgggaacaactgaaggtcgtcgatttgagagatctgtgtctttggagcagtctggtatcttgtattccactgtgactttttggttttgtttttaggctgtaatgatgagcaatcatggaaccataggaaacttcttcctggctggccaaaatctatcatggttgccagtgagcaggccttgcatccactttggaaggtatgtgtaagcttgtctgttactttgatttagacgtctaatccccaaaataatgtgaagttgctaaatcaagaatgttatttaattagtagtttccttaactttcaagtagtttacctaaatgtgtgcattcaactccagtttagttcagtaattatataataggtgcccagtgtggacaaggctgtgttgtaggttccacaacatagataggaaatagccctgtcttctgtaagcacacaacccagaatgagaattagacacatatttaactaattacagtaattacatcgctggacaatatgtctaataggaggtgcgtgggccagggatgggtgaaaaggaaccaagggcttgctgggtggagggagtacgtattgcaagataggcaggatcttactgaagtggggttatttgagcaggatgtggagatgaaatcagtgtttgccaggtagattaagtgagagggcattcagggcagagagaacagcatatgccaaagaacggaggtgtggaacagcatgaggcaggctgagagggctagaaacattttttgttgtgtgtttaacttattgattatgcaaagttattctgtccaagaatgactcaaaaaccccatggcagtggaggcagctgcccgcactgtatctatgatgtgggtggtggtgggggtgccctagggaggaggaggatgtgaggacccatgccaagtttgagccaggactgctttataacttactatgtaaaaatatgtatgcatttcccacataggagtgtaaggaatatttagagaattgtgtgagaaccaggcctttgttgaataatttattgaatgtcctcagtttctcacattggggtaacacttgatagagagaagtcttgcctcaggaggagaaaagtaccttattccaaggcaagaaataagtgcaatcattaactctgctgaatcaaacaacctaaaagaaatagccttgccttggttatcttggagactgggggaaatcttttttcctggtgttaactctctgaatgatgttttggttttcttcctttgtaacctcaacttagagagattgacacggcaaaaagatgtttgtaatgggcctcctaccttcatttcttttttggcagaggagtctagcgatgcatttctattcctaggctgtgaggctccccagtcttttgtctgagccactctttggccttaaagttgtattttctgtatccagaaaagaggaaatctgctacctgtgtgaccttgtataactgcgacagctgtaaggattttcagaagtcctgaacatgctttaacctcccaatgtttatatacattatgatttattaatttctgtactatgactttttttcattattacattaattgctttacgaacaaaacatattatggtgttattaaaggaaattaaaaccaaagaataattttactactctttctgcacttgtatatttcttcaatcagcacacatctgatgagtgtcaatagctctggtcagggaccccagcgaccagcacactgcttatttttgcattcaattctgagcccccatcttgcctggcttagctgtgatgtctgaaaccctcagactccaccctccctacatggtcacctggctcccaggccatcgccctctccttcccctgcttcaccagcccctgctcaactccctgccttgttctttcccatctccccagcttcttcatactggaggtccccagggctttgaccctgacctctcttctccaattgcactcctcacttggcaatctcatcccacctcctagctttaaatgctaattggagggtaacaacccccaaatttacatccataggccagatctctccttgaactccagacttatgttgtctggctgcttgtttgacacctgccctggaaaggcctctcagggctctccccctgaacatgctacaaagggaactctgggttttcctctgtaaatcctcttctcccgtagtctccccatctcattcacagcagcctcctcctgcttgctcaggttggcaaactttgcatcagcgtaggctcttctttttctctcatacccaacatgcaatccatcagaaaatcctgtgctcgatctagaagatacttggaacctgaccaattctcaccaactctacccccagggccatgctgccgtcatctctcatctcagttaaaacagcctctttgggttccctgctcccaccctagcttctctgcatgaagactccacaaagcagctaaaggagcctattctaactcaaggcacacaatggcactttccagctcagagccctccagcgcctctccatcaccaagagtgaaagcccagttgcttacaatggcctacatcaggctgcaggggatctgcacctccttccctctcaggccttgcctcttaggatgcctgtccccagctctagtcagcatccttcaatgtttctgccatgcttccacttcagggcctgtgcctggatgctctctctggatatccccacgggtccctcccctcacctcttctggtctcccttggctctctcctatgcagtcagccccggccgccctgttactcagggttcctggccacttccccacctttctttgctatatagtgcttattgctgtctgttatgctataaaatcatcctctaatttattgtgttgtttctcttctttccaaaagcatgttggcctcatgagggcagggatgggatttttgtctatttcactcactaatgtgtccttaacacctacaatgggccaggggcagtggctcacgcctgtaatcccagcactttggaaggccgaggcaggtggatcaccggaggtcgggagtttgagacgagcctgatcaacatggagaaaccccgtctctactaaaaatacaaaattagctgggcgtggtggtgcatgcctgtaatcccagctactcaggaggctgaggcaggagaatcacttgaacccaggaggcggaggttgcagtgagccgagatcgcaccattgcactccagcctgtgcaacaagagcaaaactccatctcaaaaagaaacaaaaaacaaaaaacacctacaacggtacctcacctatagttggcaatggaccctaatgcatatgaaattaataatgactttttttttaagatggagtcttgctgtgtcacacaggctggagtgcaatggtgcaatcacagctcactataacccccatctcccgggattacacgtgccctctaccatgcccagctaatttttgtatttttagtagagatggggttttaccatgttggccaggctggtctcaaactcctgacctcaaatgatccactcgcctcagcctcccaaagtactgggattacaggcatgagccaccgcacccaaccatgaatgactttttactctaccttttcatttaataatgtaataagaatatatttctaagtctatataaacacagatagagatactttatatgcagttgcgtggtactatatcatatagatatttcattatttattcactgcattactgggcaatttagactataaataagttttcactattctgatacagtcaacattaacagtaaaaataaccattactcaagcacttatgtgcctcttctagatttttttgctttatatttgtcactgctaagatgtttaggaagtagattggtggcggtggtggctttggcagctcaggaccgagtgcaagtaacatagaatcagcatgactcttcagaggctcttcaggttctcctctgtcattctgtcagcagtctcagtccatttgtggaggaacatcagtgttacagcagtggcatttaataaggaacttgatcctatacagaaactcttgtggacaagattagagaatacaaatcgaagtgacagacatctggaggacctgttgatactggtccagagtatcagcaagagcttgagagggagctttttaagttcaagcaaatgtttggtaaaacagacatgaatacatttcccaacttcaaatttgaagatcccaaatctgaagtcatcgaaaaaccccaggtctgaagaaataaagtgaaattaatctggtaatttatcatgggtcaattgtacaactagttagaagtttcagaataaacatacatttcataacggtcaaaaaaaaaaagatgtttaaagcatgtatgttcccaactgtcttattagtacattttaccttttatatttattttgaaaaactgttttctttaatgcttttgggtttttttttttccaagatctctctgctgcccaggctagcatgcagtggcacaaccatggctcaccacagccttgacaactgcttcaattgatcctcccacctcagcctcccaagtagctgagactacaggtgcatgccaccatgctcagctaatttttgtatttttttgaagagacagggtctcactatgttgccctggccggtcacaaacttctgggctcaagcaacccacacacctcagcctcccaaactgccaggactataggcgtgagccaccacaccttgcctgctttgattgtgaatgctactttatttcatattagtatcatcgatgctgttttatttttgttttcatttacctaaaagactttgttgttttcagcctctcttgataatttgggtttaaatgtgtctcatgtcagcagcataatagtgaggttttggtttctattgcagtggttacctccactccattcaaaagttattattggtttaggaggtattttattcattgtaaatgcttctaggagtttttattttgaaagtaacaggtgttgattagttaaaaaaaaaaaaaaaagttacagcccaagcatagaatttgaaatttcctccctactccatctctataaccaataattccagcccccagaaatattgttatatccactggtagaattactcccaggcaaatataaacatacgtgcacaagtgcaatagacatagataaaattttaatgagattatatttattgtttaccttatttttatgacttaataaagctaccctattatttttgtatgctatgttatatttcatcatattcatgtacaacagtattctaaccagtctcttaatcctagatgtctgttagattgttaaatttttaaattacagtatttcaaacaaattacactcctacaaatatttctgcattagggaattgcaagtagaagtttagtatccattctccaaagtgcttgagaccagaagtgcttcacattttagattttctcagattttgggatatttgtattataatactagttgtgatataggacaggcaagccccaaacaggggcctggcccatgaaggctcttggctttgcccaggaaagaatccaagggcaagccagaggtagaagaaaacagttttattgaagaggcagtgttacagctccatactgctcttgcaaagcagggataccccataggcagagaggagcagttgagggcagttttgcagtcacatttatacccacttttaataacatgcagattaaaggacagtttatgtagaaagttctagggaagggttagtaactcttgggttttcaggtcattgccatagaaaggggcggtaactccccggtgttgccatggcggtggtaaattgacatggcacactggtgggtgtgtctgattggaaagctgcttccaccctggccctgttttagctagtcctcaatctggtccagtgtctgagcccagcctctggagtccagtcccacctcctacctcagttgagcatcccaaattaaaaaacccaaaatccaaaaacgttctaatgagtatttcctcatgttagtgctcaaaaagtttcagattttggagcatttcagatttcagattttcagatataggacgcccaacctgtatatcagtggagcacgtgaagagcagcagcagcaggacagttattctactcttttcacttccttccttgttgcctggcttctaattcatcatcagagattatatggaagaaacattaatgggaattctgcccagggaataattccttttgagaaaatgtgaaattcagtgagaatgtgcatttgtgagcattaattcttggagttagactaaaagttctgatatgtagtcctcttttgattttcagataggtatatctcttttggccttcaatattggcagtagccatattatggacctggctgggatagacgcatcttcaggaattgctattggggctggtaagtggaatgtaagtaatattatttgcagcaacaaacctccatctttatcattatccaaataaaactatataaacataaaaatttgctttcaactttgagtaaatataaaagaattcttgtgaagtcatagaggaaagaagccaagtctttgacttgtcaaagggattctgctgattttcattctacttagtaaattaatggagagagaatgtttacattccaaggaaataggaatgcagtgaagaaagaactgttagtagataggttaagaaaagatcatatttagccgggcatggtggcgcctgcctgtaatcccagctacttgggaggctgaggaaggagaatcgcttgaacccgggaggcagaggttgcagtgagccgagaatgcaccactgcactccagcctgggcaacaagagcgaaactctgtaagaagagaaagagaaagagaaggagaaagagaggagaaggagaaggaggagaaagagaaaaaaggagaaggagagagagagaaagagaaacaaagaaagaaagaaagagagggagagagggagagagggagagagggagagagggagagagggagagagggagagagggagagagggagagagggagagagggagaggggaaggaaggaaggaaccatattaacattaaacacatatgcagatatatatgtatatgtgtgtatatgtgtgtgtgtgtgtatacagagacacacacacacacatatatatacacatatatatctgtatgtatatattctgccctttgcagtacatactgagaatgggctcagccaatgtccttgagatattcaactaggaactacaaatcttctgattaatctcccaggagtaccaggttttaaccttataaatatttgattatttatttaatttgtggcatatcttcataaaaaaggatgagttcatgtcctttgcagggacatggatgaagctggaaaccatcattctgagcaaactatcataaggacagaaaaacaccgcatgttctcactcataggtgggaactgaagaatgagaacacttggacacaggttggggaacatcacacaccggggcctgtcatggggtgggaggctgggggatggatagcattaggagaaatgcctaatgtaaatgatgagttaataggtgcagcaaaccaacacggcacatgtatacatacgtaacaaacctgcacgttgtgcacatgtaccctcgaacttaaaatgtaatttaaaaaaaattgtggcatatctttgttataggaaatagaatttattctcctaaattataaatgattttataattctttggtaattaacctatctctgtataaaccatttgacattttagaaataaatcagaaagctccatcctttctgagtctcaccttttttctcagactataaaaaaataaagaatacttctgcagtcaaaacctagtaagaagccctggccttcaccgccatttacccgtcagaattttctggggtttgtttgtttgttttggtacctggtagtcatcttagtaagattgtgttatactttccatagtttccatacacattgtttcaacataatcaacagaccaaatgcagagaagctggtggaagcccaaggctgtggaggctgctggaagacagcctcccaagctttagagatgcaggcctgaccagaagcaggtgcaaattttccttcttgattatgaggtggggaaatcaagtccaaacattattcctatgtaatcccttttgtaagtcaaatttgttttctccatgagccacttggttttaagtttcccaagtcatttagtggtcttgctgcagtcgttgagatctacctgtggccccttcctggaattgggcagtgttttgaaccccatctgcctcttctagaaaggttcccacccaattcagcagtcccagtgaggtccaagaatgccatcgtcattctttcctaacttgtatgctgtggatcaggcacagagacagtactggttcctgctttagaagctgagcttggccaggtttggtgggagccacagaaaaccattcggttcattcaaaatggtttcacaagccatctttacatctttggagttatctacacattttaccatatctcatcccaaatcctcagttcctggtgagggggtgacaagatgtaagaatgtacctccctcaatacagagcaacagggccattttctctcataaccagaccagtctgctctgatggcaccagaatgacaaatgtggctcagttctgagggcctgggtggcaggctctgaaggtgggtggaacagctgcaggatgccgctccttccaagaaagcctgtgggctgaagatctgctaaaagtctacatgtgggcagcaaggaagaacagccccaagcctggggccaggtaaaaccccacatcaagcctctaaattggatttcctgggtcacgtcctcatgtgactaggaagcaaccttagacttggacgccacactccaacgttgggaggggcaccttgctggctataaatctccaggtgacaaactccagcacagggagtcagatcacctacatggtaggcctggagcttgaagaggtgtctctgcgaagagcactctgggcacttcgagatcttcccacagctagaagctaagctaggagtgaggattcccaggagaaggtaagaaggaagttaatagatggagggcacaagacctcattgggtacatcaggaaataaccacttaagcacaagtgttctgatgagtccaaaggtactctggttcctcttgacccagtgggaggcaagctttacagagaaaatctctgaactccaggggctggaggaacctggggcttcggtgatcatcacagggttctgtgagaaccagctgcctggtctctcagaattttcaagtatcttctttcttcacatatttaactcatcttattccttctttgtaaagaaaatcagagccaaacttatttaatttcaatggtatggaatgttagtatagtttatttccctcttccctgaatggttatttttctttctttttttaaactatcttttaaatttaattataaaccacctttattcccatctgacaaataaattaaaaataaatgccttgaaaatcagctcaaataaccatcccgaattaagaatgtatccttttacaagtaaagatcatgttcctgcaaattaagtttctgtgctggaaaatgtatccaagcacctttattggtaaggtccccagtaatgacacattcattaggcagaagacaaataggaaataagcttccttttcaagcttggcctagatgagatcctgatttaattgctctttttcttcttggtttcaggctgtacttctgctctatggcattggttggatatttgtttctgtttataataaggctcaggtaagtggccattatcactctattatttacaatatgtttccttataaatataatgtgtgtactaaaaacatcctagaggagaagttaaactttctcagtcttttgatccttgtgctgacttccccaaatcctgagatggctgaaataccatcagtctgtttggggcaaacagacacctgtaactctccactatttaactctggaccttattcaagagtttacctcttaaagattttatagtaaaccttttaaagctctatgaaaaaataagacctaaataaatgaagagaaaagctatgttaatgaatgaagactcaatatcccaaaactcttggttattcccaaattgatctatattgaatgtaattccaaatttatccaaacagtcttttgaggaatttgacaggctgattctaaaatatatgcagaagagtaaaagtaaaagaatagcaaagatactcttatcaaataaaaagacttgccctactaaatattaagacttactataaagttgtaataattatactgtgtgattttgacacagggataaacactgataattggaagaggggaaaagcccagaaacaccacatatatggacacttgactgatgacattgatgcactgcaggtaactgaagaaaggagggccaactgactatcatatggataaaaaaaattagattcctactgtatacaaaaatacttttagattgatttaaaacctgaacataaaaggcaaacatttttaacttttataagtatagagtatctttatgtcctcgagatagagaaggatttaaaataagacataaaaatctcaaacccctggctgacaactaagcacatatgcatgcatgagaccccagggataccagttagaaaaaagcagaaactagaatgagatctattctggaaagacataactgcacctggtaagatttgtgagttaatcgtgctttcaactgagtacattcttcaactcacacaatgtaggcagtagaaatcggaagttttactggtttcaggggtcaaaggacaaaactaaggactagtaaagcaactggaaatgtatgtgggagctccaaaaacaaaggaaccaaagagagagtgagcccccaaatcggagtataaattttgttcagatttttggctgactgccaaattacacaggtacaggggaaacctccagaaagccagactgaattagcagcagctggaagctgattaagaaaaaaaaaaaaaaacaagcaaaaacatcagctgctgcacattacagagtgggtatgggggatggcataaaacattttgcagttttgagtccagtaaagttaactgcctactaaaacaagaaacagcaagccccagaaaaacaaaacagactgctacattgtattacatatgatagccagttttctgccaagaagtactagacatacaaagaaatggggaaataaatgtaacccacactccaggagagaaaagtcaataaacagaaactgactctaggctcagatgttaatttaatgaacaaagacttcaaaactgctattataaatatgtcccaaaagtaaaggaaaatgtgatattaatgaatgaacaaataggtcctgttaacagataacttaaaactatagacaagaaccaaatggaaaatttagagttgaaaagctagtaactaaaatggaaaatttacagaatttcaacagcagatttaaggtgacagaagagaaaactagtgaatttaaatatcataagaattacccaagaacaaggaaaaaatcaaagaaaaagaagcaaagcctcagagatatgcgatagaatatcaagcagtccaacatacatgtcattggagtcacagaaaaagaatagaaggataagaaaaaatttttttgagaaaatgactgaaaacttaccaagtgtggcagaatatgttactttacagatctgagaagcttacaaaacaccaagtagaataaacacaaagaaaaccacacctaggtacatcatagtgaagctgctgaaagcaaaaaaaaaaaaaaaaaaagttttgaaagcagtaagagaaaaataatgtacatacaagggaataatgacacacttaatcgttgacacctcatcagaaactggaggtcaaaaaacattagaatgacatatgcaaatgcaaaaggaaagaaaacactgtaaatcaataattctacattcagtaaaaatgttttttaaaatcaaggcgattgaataagtaatggttttttagataggcacaaaccatagaaaaagaaattgatattttggacttcatcaaaacttaaacttttactacgtgatattattaagaaaataaaaagtcacctggggcctgccaccactaccaccagtgcctgcacactccactccactgtgggacctgagaactaaggaccaacttgcccagggctcccctgccaccatcatcaccaccaacacagactgcacaggggcccaagtgccagtccatcactgccaccacccaggtgagccatcaggaagcctgtcacttaggagcctgaggacaagcatcctcattttcagcaaagcctcaccacagtcttcaaaaacaacataagccacttgagggacttgaagacaccactaatgttgcttatagctgaataaatcataaggagtttacactatggcacccacccaaaaccaaagccaaaggatcctacccaaccaacactatagatacaggtataagaaaagtctttccctatgaaagctacttcacaaaactggaagaagcaaccattgcaccagatgcacacatttcaacataggacccaagaaacaaaaaaccaaggaatcatgacacctccaaaggaacacagtaactcttcggtaacataccccaagaaaaagaaatctatgaagtgcctgaaaatggattcaagctaatgttcttaaggaaactgagtgagatataagagaacacaagcaatatgaagaaatcaggaaaacaatttataatctgaatgataaattcaataaacagatagatatttttaaaagaactaagcagaaattctgaaactgaagaattcaatgaatgaaataaaaaatataactgagacctttaacaataaactagaccaagcagaagaatttctaaacttgaggagaagtcatttgaaataacccaaagaaaaaagatttataaaagcctacatgacacatggaacaccattaagtgaaagaatactcaaattttgggagttccagaaagagaagaagtgggaaagtcatagaaaacctatttaataaaataatgcctgaaaacttcctaagttttagaagagatataaacagccagatagagacagctcaaaaaattcccaaatagattcaactcagaaaggtactctccaaggtacattataatcaaactgtcaaaagtcaaagacaaagagaattctaaaaacaacaaaagtgtcaagtcacatataagggactactcatcagactaaaagcagatttctcagaagaaatcttccaggccaggaaagaatggaatgatatattcaaactgtggaaaggaacaaaattgctagccaagaatacaacacccagcaaagctatccttcagaaatgaaggagaaataaagtcttccccagacaagcaaaaactaaggaaattcatcaccagtagactagttctacaagaagtaagaagtttctacctctggaagcaaaaggacaatatttaccatcatgaaaacactcaaaactaaaaaactgactcagagcagatagacaaatgagaaaaaggaatcaaattttaccactatataaaaccactagatctcaaagataaacaataagagaggaagaaagaaacaaaggatatacaaaacaatcagaaattaattaataaaatgacaggagtaagttctcacctaacagtaataaacttgaatgtaaatagtttaaatacccccattaaaagatatagactggttgaatagctatgctgatgtaagacaaagtagacttcaagtaaaagagcatagatacaaaaaaagtcactatataatgacaaagagattaactcagcaaaaggatataatgattataaatacacatgtacccaatactagtgaacccagatataaaaagcaaatattactagagctgaagaggagagatagagcccatacaataattgctgtggactttcacaccccaattttggtgctggacagatcatctagaaagaaaatcaacagaaaaattgcacttaatctggtctacagaccaaatgggcctcacagacatttacagaaaattttatccaacagctaaagaatatcatttgtctcatcaggacatggaacattctccaggatgtatcatatgttaagccacaaaacaaatctcaccaaggattttaaaattgaaattatattacctatcttctcagaccaaaatggaattaaactagcaatcaataatgagaggaactgtggagactgtacaaatacatgaaaattaaataacatgctccagaacaaccattaggtcacggaagaaattagaagcaaatcaaaaaaattcttgaaacaagtgaaaataaaacacaacataccaaaatctatgagacagagcaaaagcagtgttacaagggaagcttatagcaatctttctgcacctatatcaaaaacatagaaatattttaaataaacaacctaaagatccacctcaaggaactagaaagcaagaccaaaccaaacccagaattagaagaaggaaagaaagaataaagatcacagtagaactaactgaaatcaagacaaaaaaatacaaaagggccaggcacggtggctcctgcctgtaatctcagcactttgggaagccgaggcaggcagatcacttgaggtcaggagttcaagaccagcctgtccaaaatggtgaacgctgtctctactaaaaatataaaaattagctggatgtggtggtgggcacctgtaatcccaactactcaggaggctgaggcaggagaatcacttgaacccagcaggtggagtttgcagtgagaagacattacaccactgcacaccagcctgggcattggagtgagacctagtctcaaaaaaaaaaaaaaaaaagatcaacaaaaggaaaagttggttttctgaaaagacaaaatttacaaaccattagctagactgaaaatacagaagactcaaacagataaaatcagaaacaaaaaggagatattaccattctatggtaattttctgataccacaaaaatacaaagggtctttagaggttattatgaacaactatatgccaacaaattagaaaacctagaggaaatggataaattcctggacacatataacctaccaagattgaaccaggaagaaagaaaacctgaacagagcaacagtgagtaatgagattgcatcagtgcattagtctgttctcacattgctataaaaaactactggagactgggtactttataaagaaatttatttgactcacagtttcaaggatgtacaggaagcatagctggggaggcttcaggaaacttaaaattatggaagaaggcaacgggaagcaggcatgtcttacatggccagagaaggaagagagagtaaaggaggacgtgctacatacttttaaacaaccagatctcacaaaaactcactattacaagaacaacaagaggaagtccacctccatgatccaatcaactcccactggtccctcctccaacattggggattacaattcaacatgacatttgattgaggacacaaagccaaaccatatcattttgccccctcccctcccaaacctcatgtccttctcacattgcaaaatacaatcatgcctttgcaacagtctcccaaagtcttaagtcattccagcattaactcaaaagtccacagtcctaagtctcatctgagacaaggcaattcccttcttcctatgagcttgtaaaatcaaaattagttcgttacttccaagatacaatgagggtacaggcagtggctaaatactcccattccaaaagagagaaattaggcaaaacaaaggctacaagccccatgccagtccaaaacccagcagggcagtcattaaatcctaaagctccaaaataatctcttatgactctaacatacaggccatgctcacacaaggggtgggatcccaaggccttgagcagctccacccctgtgtctctgtggggtacagccccacagctgctttccaggctggcattaagtgcctgtggcttttccaggtgcacagtacaagctgttggtagatctaccattctggggtctgatggactatgacccaattttcacagctccactaggcagtgccccagtggggactctgtgtgggggggtccaaccccagatttcccttcagcgttgtcctaatagagtttctccatgagggttctactcctgcagcagacttctgcctggacatccaggcatttccatacatcctctaagatctaggtggaggctcccaagcctcaactcttgccctctgcacacttacaggtttaacaccatgtggaagccaccaaggatgatggtttgcaccctcaggagtagtgacccaagatgtgtctggtgctcttttagccatggctggagctggagcatctgggatgcagggagcagtgcctcaaggctgcacaaaacaacaggtccctgggcctggcccacaaaaccattcttcccttctaggcctccaggcatgtgatgggacagctgccacaaaggtctctaaaatgccttccaggtattttcccaattatcttggttatcaacatttggttcctctttacatatgcaaatttctgcagccagtttgaattcctcccagaaaatgggtttttcttttctaccacatggccaggatgcaaattttccaaactattacactctgcttcccttttgaatataagttccagtttcagatcatctctttactcacacataacaaaagtggccttggctccatttctcaataagttcctcatctccacctgagacctcctcaacccagactttattatccatatcaccatcagcatttcggtcacaacaatttaacaagtctctaggaagttccaaacttgccctcacctttctgtcttcctttgagccccccacactctgcccattacccaattccaaagtcacttccacattttcaggtatttttataggaatcccccacttctctggtaccagttttctctattagtccatccttgcactgctataaagaaaactacccaataatgggtgatttataaataaaagaggtttacttgactcacagttccacagactgtacaaaaagcatgactgggaaggccactggaaacttaggcagaaggtgaagaggaagcaagtatgtcttacatggccagagaaggaggaagagagactgaagggggaggcactacacacttttaaacaaccagatcttgtgaaaattcactcactatcatgagaacaacaagggggaaatccacccccatgatccaatcacctctcaccaggtccctcctccaacactggggattacaatttgatatgagatttgagcagggacacaaacccaaaccatatcaatcagtaataaaaattctaccatcaaatctgaggactgggtgtctgcactgctgaattctaccaaaattcccaagaaggactaacaccagttctcctcaaactattccaaaacattgaagaggaaggaattcttcccaactcattatgtgaggccagcatactctggccagagtgtcagtactctgtctggtaccaaaaccagacagagacacaatttaaaaaaaaaaaacaaaaacaactgcaggccaatatccctcatgagatacaagaatccacaataaaataatagcaagctgaatccaacaacacatcaaaaaatacaccataatagagcaggatttatctcaggaatgcaagggttgttcaacatgcacaaatcaataaatgtgatacatcccatcaacagaatgaaggacaaaatctatatgatcatctcaatagatgcagaaaaagtatttgataaatttcaacatccctccataataaaaacttacatgacaaacccacaaaaactttatactgtatgaggaaaagctaaaagcctttcctctaagatctggaagaaaaggaagcctactttcactgatcttattcaacatagtactagaagtcctagccagagtaattaggcaagagaaaggaatataggacatccaattcggaaaagaggaaggcaaattgtccctttttgcagacaacatgatcatgttcatatgtatatgtacatatatacacatatatatatacctaaagattccaccaaaaatctcttagggtacaggtagttaggcatgagtgggagaggagagggctctccccccacacccactagaaatgctgggaatgctgggtgatggttcagcaattgtcacattgcttctctaaaaatgataattcagcagcgccagggagaggccatttcctgatgatccacacctgttaatatcaaaatgttaactgaatgcagaccccagggtaagcaactttctgggcatgcatgttaagagtaaaaatggtgaagtatgatcttccaggggcacactacaacagaagagggaagaaagcctcagatgggcatgtgtataaccccctaaacatactgtgcaagctcaatcccaaagggtaaggaaagcactgggtacacagaaagcccactttaagggaagaatcatgggaaagaggtgaacttataaaagtcctaggatcacagttaaacagagcacttgaccttctccctttaacctttaagggccctcttccaagcgcactttcctttatttcctgttctaaggcctttttgaataaacctccatttacacactggaatttgccttggtctctttttctgctttatgcccctcagtggaattctttcttctgaggtggcaagaattgaagttgctatggacccttatggataggctgctggtaactcagggtaactcggacctctgccactggtaacattggaactgataaattcagtgatgttcaggatataaaattaacatacaaaaatcagtagcatttctatacaccaacaatgaactagctgaaaaagaaatcaagaaattaattccacatagaatagctaccaaaaacataaaataccaaagatgacatttaatcaaggagataaactatatctacaatgaaaactacaaaatgctaatgaaagaaattgaagaggacaccaaaaaatgtaaagatatcccatgatcatggattttaatgaatattgttaaaataaccatactactcaaagcaatctacagattaaaagtaagtcctatcagaataccaacattctttacagaaatagaaaaaaaatgataaaatttgcatcgaaccaaagactttgtgtaactaaagaaatactgagaacaaaggacaaaattggaggcatcactctacctgactttaaaatatactaaaaagctatagtaacccaaacagcatcatattagtataaaaatagacacacacaccaatggaacagaatagagaacccagaaatacattcacatatttacagcctactgatctttaacaaaggcatcaacaacatacattagagagacaacaccctcttcaattagtggtgctggaaaaactggatatccatatgcagaagaataaaactagatccttatctctcaccatatatgaaaagcaactcaaaatgtattaaagatttaaatgtaagacctgaaactataaaactagaagaaaatataggagaactgcttcaggacattggtctagaccaagattttatgagtaacttcaccactatgcaatctatacatgtaacaaagttacacttgtacctcataaatttatacaaataaacaattttataggtaagatttaataggtaaaactttattttatgggtaaagcacaggcaacaaaaacaaaaatggacaaatgggactatgtcaaacctaaaagcttctgcacagaaaaggaaacaatcagcagagtaaagagacagccagttaaatgggtgaaaatatttgcaaactattcatccaacaaaggactaatatccagaatacacaaggaactcaaacaactcaacagcaaaaaccccaaataatccaattttaagattagcaaagtatctgagtacacatttctcaaaagaggccatttaaatggtcaaaagtatactaaaaatcttcaacatcactaacactcagggaaatgcaaatcgaaaccacatctcaccccagttagaatggcaattatcaaaaagacactagcaaatgctagtgaagaaatggagaaaatggaactcttatacactattggtaggaatgtaaatcagtacagccatcacagaaaacagtatggaagtttctcaaaaaactaaaaatagaaatatcacataatccagcagttttgctactgggtatttatccaaacagaaggaaagcagtatgttgaagacatacgtacatctgcacacccattttactgcagtgctgttcacaatagccaagataatgaatcagcctaaatgtctatcaaaaaatgaatggattttttaaatgtggtatatttacacactggaatactatccagccaaaaaaaaaaaagaataaagtcttgtcattcccagcaacatggatgatcctggaggaaattatactaagagaaataagtcagaaacagaaaaatacatatcacatgttctcatttctatacgggaatttaaaaaattgagctgatataaatgggaagagtgggcggtctggagaagatagaggttggttaacaatctgaagttacacagctgatgggaggaataagttctagtgttctgtagcactataaggtaaagatagttaaaaacaattagtgtatatgtttgagaagctagagaagagaattttgaatgtccacaacacaaagaagtattacatgttcaaggtgatcattatgctaattgcctttattttatcattccatattgtatacatgtattaaaatattattctgtatcccataaacatatacaattattacgtgtcaattaaaaataaaagaaaaaagtaaaactagtctagctagagactgggagaaaatatttgtaaaacaaaaattaattcaagatggattaaagacttaaatgtcagccctaaaaccataaaaaccctagaagaaaacctaggcaataccattcaggacataggcatgggcaaagacttcatgtttaaaacaccaaaagcaatggcaacaaaagccaaaattgacaaatgggatctaattaaactaaagagcttctgcacagcaaaagaaactatcctcagagtgaatagacaacctacagaatgggagaagatttttgcaatctacccatctgacaaagggctaatgtccagaatctacaaagaacttaagcaaatttacaagaaaaaatcaaacaaccccatcaaaaagtgggcgaaggatatgaacagacacttctcaaaagaagacatttatgcagccaaaagacacatgaaaaaatgctcatcatcactggccatcggagaaatgaaaatcaaaaccacgatgagataccatctcacaccagttagaatggcaatcattaaacctctggggactgttgtggggtggggggagaggggagagatagcattgggagatatacctaatgctagatgacgagttagtgggtacagcgcacgagcatgtcacatgtatatatatgtaactaacctgcacattgtgcacatgtaccctaaaacttaaagtataaaaaaaaaaagtcaggaaacaacaggtgctggagaggatgtggagaaataggaacacttttacactgttggtgggactgtaaactagttcaaccattgtggaagacagtgtggctatccctcaaggatctagaactagaaataccatttgactcagccatcccattactgggtatatacccaaaggattataaatcatgctgctatgaagacacatgcacatgtatgtttattgtggcagtattcacaatagcaaagacttggaacgaacccaaatgcccatcaagggtagactggattaagaaaatgtggcacatatacaccatggaatactatgcagtcataaaaaagatgagttcatgtcctttgcagggacatggatgaagctggaaaccatcattctgagcaaactatctcaaggacagaaaaccaaacactgcatgttctcactcataggtgggaattgaacgatgagaacacttggacacagaaaggggatcatcacacaccgcagcctgtcatggggtggggggaggggggagggatagcattaggagatatacctaatataaatgatgaattaatgggtgcagcacaccaacatggcacatgtatacatatgtaacaaacctgcacgttgtgcacatgcaccctagaacttaaagtataataaaaaaaataaaaaataaaatatttgtaaaacatatttacaataaaacacttatatccagaatctgtacatatttaaaacttgtaactcagttaagaagaaggtttgaacagatgtttaaccaaaagatatatacaaatggcaaataattaaaaggttattaatcattagggaaatgctaattcaaataagataccaagctgggcatggtgtcacacgcctatagtcccagctacttgggaggccaaggtgggaggactgattgagcccaagagctcaaggccagttggagcaacagaacaagacaccatttctaaactaagtaaataaataagataccactacacactctattttgtattctttatgagccagtcagatgggttgggtgcagccacaggaggagacatagaagctcagaaaaaaaaagtttattatactcacaggtcctagagacaggaggcatggcatgccatgcaggaccacatgggaaagacatcaggtggtcaggaggaaaaagacaaagggaagggttgggatactgcctttattgaggcttctgcagaaaaggcaaggcagtgcagaatgaacagtttactttgttatggcagccctagcaaagatataagtagtaagtgtgaaacagcttgggaagcttgggaccttgctaaaaaagtaagccatctacgatttagagccaaatcaaaggtgaaaataataaaagctacaggtatttagaagaagagggcatatggttcttgtgaagtccccaggtaagtcttgataaagcaggtagaatttgagatagaacttaaaatagacatgtttgaggtcagtggacaagaacatatgagaatagtcaggatagaaagtggaacaatattcattagtatctattcacctaccatgagccaggcactgagctatggtccaggaatatagtgaacaaaaagggcatggttcttgtcgtcttggtgtgcacagcctgagatacagcaggattgtatgggacaccagcatgcacaccggcagtgttggcacaggacaagtcacagagctgtgtagtcaggacctgtctctcttgaacactggctatctttgtactatgtgattaagcacttgattttgctctatgattattccataaaagggatttgtcatcattaccattctcagctggattttcttctgcatcaaatattgcacaagaagctggattccaaactcctgggagacagtggtgtttattctcctttcttatttctcccatcttaacagatgccaggggcagtgactccccatcttgaattcttgggctactcccagaatcagccatgtctctaacaaccagaacttgtgagcaagactcatccccctgggtctgcctcttcagcactcactgttgatggtgacttgtctcattgcttgtacaggtggtgacagtgccagaatatttcaagaataggtttggtagctatcagagtgagatccttctctccattctgtatttattcctctgtatcttcaataagataccagtgagttgtgtaaaatccagcccaagaaacagaaccaagaaaaaaaagcaagaggcaggactcaagattatgctggatttgtcccagcgatttactctgggtcctctaaattacttgttggcctttgttgtgaagccagagtagaaaaaaatgacttcacattcacaaaaaataaaagaagcatcttctttacctcccaagcctaggttacaggtccctcctctgtattcccaggaaccttgggcttacccatctcatatcagtaggtcatgtgcttaaaagaatccaggaattttcaccacctgtacaaaacttaaacttgttctggcttttaaaggctgtcctgcggaagccccagtctacctttctaaatggatctccttatttcctaatggttacacactgtgctctagtcacactgcttgcctcattgattctcaagtccagcaagcttattccaaatcaaaaccctctagacttgctctgtactgtgtctggaatgttcttccctcagatcttgcatggctaactccttgtattattccttgaaagaaaaatagcacttccttgaaggggccttccaaggatgcacccaattcatctctactccattactcaggtcttggtttttgtctttaattagagacagggtcttgctatgttgcccaggctggagtgcagtggctattcataaatgtgatcatcattcactgctgcggcaggccaggtctcactaacgcaggcctctgtaacaactgtttcagcactgactgagtggttaagttaaatattaaaagctgatagagccagtgctctaatacaaatgctggaatgtaacaaaggctcaccaagagttttgtccaggcctttcctgggccttgaagcatgatgagataaaaaaggaattcttaaaaggacccatttagaattaagcaagtttcattgggggtctgaagaaaccccccaggtctccacaaacaagtttattggaggtctgcaagaactcatcaaacctccatgatttagcaggagacaagataagggtaattgccccagcacctgggcccatttagattaagaaaatttactaaggctccagaggaaggtcttcaggactcagatctcagttacagaataaaagttagcacttatgtctttagataaatgcacacttacacgtagacatatagcttagaaggcacataagttctagaaaactgtaattttgagttagtccaaattttgataatttccaggccttctccctgtaaccagttacataaataaaaaactcttctttcccagttcatctgcatctcattattgggccacgagagtaagcagcctgatcctcgttttggtctaggaacacttgaacttgaactcctgggctcaagcaatccccctcctgagcctcccaagaagctgtgattataggtgtgcaccactgcacccagcttcactgctgtttttattttctgtgaaatgcctgccaccatgtgaaagcaatttatctgcttgcttatctggcttctccacttcagtgcaagcttcctgagaccaagggcctcctgccttgttcactgcgttaccttccccctgtactgagaacatgtttagcacataaggtacttcataaatgttttctgaataactggaatagtggcacttatcacactgcatagaaaatgcctattttgtggtttgtctccattaaacataagctcttgaggatggcaactgagttttggtaacttgtgtcttctgaacactgctgagtgtctatgacatggttggcactcagtaagtagttagtgaataaatggatagatgaatctgtccattttatccctggctttggagatcagaataacaaagcaaggggttatccagttaaatgatgtgcagatgtttcaaaatcagtgtcaactgagccaggggtcaacaaatctggtcagcaggccaatctggataatgatgggctttgtgcagctctgaagctaagaatgatttttatagttttaaaaggttgtaaaaaaaaaaaaaaaaaaaaaaagagagatggtatgtgaccagcaaacttgcctttacaggaaaagtttgctgatccctgagaagtcattcccgttccctttttccagtggtggaactgtaaaaacaactaactctctgaactaattccctctctgaagctccagagtggaagaggctaagttgtgccactggaagaatggggttaactcaagccctaaaagtactaaccttggctgaactcatggggcacaagcctatgctcaacaaaacggatgaaccttacccagtgtccactggtgatgtagtgctattcagataccacctctggtagatggcttctaaggtcagtgtctttgtggaatcactgtggattcagttggaagtgaaagtgcagcctgctgactccgtattcatttcagttggaggtttgctcttctgccgtgttcatgaagatagtttaggaaatgggtgtttaactgatcacaatctcgctgaaaattgctggcattcataccatctcaggtgaggttactctaaccacacaagtacttacattggcacactctacttagtggatgacagagaagtcattctacctaaagatagagaagtctatctctgtgaatgacagagatgtcattctacctaacatctctgcagtttgtagaaaaactctttatagagtttgtagacattgaagcagcagtctccagcttttgcacttaccctaagtctgtaaatgacattgctaagacctgaggagactgaacaatgaaaagaacagagacggggggcctaagtagtgtcctcccactagaaatcagcttgggctggctgggtccctcccaggggtctgacagggacaacagcgattatgtctgcggtggggagggacactgcaggccaccaggtaaaagactgggagcacagaagacaaatgatggggaggcagcagccatgggccacctggtcaggcctgatcagatggaatcttttgtaggggcagttctgtcctaggcagctactgcctaggttctgagagtggaagctctcaccactccttctttccagcaacagtgcaaatctcagatgctgggtgtttccctggcagttcaccagagaccaaggggaaagaatcaaagtgaggcacagaatgccctcaatcagtggttcacagtgcagaggagtgggaattggatttttcttcccagagggcacttggtaatgtttggaggcattctgggttgtcacagctgggccagggggagctctgctggctgttaactgttgcttccaggtcaggtgcagtggctcatgcctataatcccagcacttcaggaggctgaggcaggaggatcctttgagctcaggagtttgagaccagtgtgggcaccatggcaaactctgtctctacaaacatttttaaaattagccaggtgtgatgacacacacctgtagtcccagctactcaggaggctgtgggaagactgcttgagcctgggagatccaggctgcagtgagctatgatcatgccattgcactccaccctgtcttaaaaaataatgataaaaatttttaagaaagggaattaaagggaaattaggaaattgtgacacagaagggcaagataagaatccaacaagagatcatgaaggacattaaagagagaaaacaggatggactaaaactaagcataagtcactcactgaattaaagagatcaagcgcctgaatgtggagaactgggggtgtggtggggagtatacagagtacttgatgtgggagtaactttcagaagagtgagtcaaatgtggctttctttctctctctttgcctgttcaggtggtttgatagctgtggtttataccagcatcttgaatgctgacattatgctttggggatcagtcatgttaataggctttgggaagtaaaacaagatgactgggtaccatggtggaacctttggctctagagctgcctgggccatcagcatctttgtctcacagatgaggatgatacagaaggactgggctctcggctaaaccccaaccttaaccctggaaccacagctctaagtgaaaacagctgaccctgtttttccacccaaatgttgcctttttggcctgctccacccctatcctgtgcccataaaaaacttcagaggcagagcaacacaaacagctgagtgtcaaggtataagcggctgagtgacagacaagcaactgagcgtcagagactataaaaaaacacagctaatttcagacagtgcagttttggagaagggtctgaccagaaacggttaggctttaggaaaagatcactttcccatcctttttccagccaagtgggaggtgccagccatctggctacatgggacccctaacccgaggcttccctggggactgggaggtgtgcgcagctcattgctgcctcgcttagcccttgaacatggcacacgcatgcagcagacacgcccaggctcctaagcagggaggggagggggtgagcagaggaaccaccacacaccatgcctgcccgtggctgttggggtgagtgtggggatggcacctctaagaaaaaacgggaatcacattgttctgaattccatatctaatggctaggccaaacactcattctacctaacatctctgcagtttgtagcaaaactctttatgagagagatagaagccagtcaggcacggtggctcacgcctgcaatcccagcactttgggaggccgaggtgggcagatcacctgaggtcaggagttcgagaccagcctggccaacatggtgaaacccaatctctagtaaaaatacaaatattagccaggtatggtggtgggtgcctgtagtcccagctactcagaaggctgaggcaggagaatcacttgaacctgggaggcggaggttgcagtgagccaagattgcaccacgcactccagcctgggggacaagagcaagactccgtctcaaaaaaaaaaaaaaaaaaagaaagaaagaaagagatagaaaccatttgcaggcattaaagaagaaaagatacaaagatatcacagcaaagtctgcagatttgggccgacgcctgttagggcagtcatggatggagtttagtcttggggccttccagcaacactgaggagtggcctcagtcagatgcctttggttccccaggaccttattcccatcccataagacagtttgaccaccgtgaaggaaaacagccacagagccaacattcttttcacccaaaagagacatttcgtcatgtactcacttgtctgacgtatccaggacaagccttcagatgagatgggatagttcccttgatccccttcatgggcagaaactggagtggctcatttcactcagcccggcgttggccactcctcacaggagacagcatgcaagcgagagtgtgcaggaaccagaatgaacaaatgctggaaccgccaatcactcctctctgctaggagcaggttctgtgcgggccgagtagcgtcgtccaagcatgttacaaccaatgctgtttcagctcttatgtctggaaacagccaagtgccaaccggcttggtggagggtcagggtggcagcccctgccctctcagcacctgggttcttgtccaatgtccaggaagaatcaggtcacatgaaccatttgaaaggggatgcatgtggaggaatttattgggtggtgggtggctctcagcagaaacggaggctggaaacggaaggggatgatgggaaggggatctttccctgaagcccagccatctccagccaggcccctctccacaaagctgcaccatctgaagttagctgcgtctgtccacagtctctgatgctcagttgcttctctgattgccgctcagctgcttctgttgctctgccggctgaagtctttttggggcacaagataggggcggggcaggccaaaaaggcaacatttgggtggaaaaacggggtaagctgtttcacttagggccacagttccaggattcagcggggggtttagctgggagcccagcccttctgtatcaaggagactgaagcccaaacacaacccaacagcattgttgaaagtcatgctgaaagttggggaggatgtttctgctcacttcaagagaaagacgagtcaaagcatgggagtggaaatgacaaactctagtgctttggtacactacactcctcctcacttctgggccgtcatcagtgttcttccctagttagaaggccaccttctttttcaccactcaattaaatctatccaccaaggtcaacagaagatccacccctaaagatataattccaccattaatccatcaacacagccctcttctctggagctcacatcactaccacacaagtcaacatatttaaacacataacgtaattgtttattgagtgtttcacataaataatcatactccctacatccaaaacttctgaagaaccagaaccatggtactccctatgcaaagcactgtctgatgcattaagtagattcatgcatcactaaacggccaggacacattctgagaaatgtgtcattaggcaatttctttgatgtgccaccatcatagagtatgcttacataaacctagagggtgtagcctattcctcctaggctgcaaacctgtacatgttattatactgaatattacaggcaattctaacacaatagtatttgtgtagctaaacctaaaaaaggtacagtaaaaatatgatataaaagataaaatgtgggctgggcacagtggctcacccctgtaatcccagcactttgggaggccgaggcgggcagatcatggggtcaggagatcgagaccatcctggctaacacggtgaaaccccgtctctactaaaaatataaaaaattaaccgggcgtggtggcaggcgcctgtagtcccagctactcaggaggctgaggcaggagaatggcatgaacccgggaggtggaggttgcagtgagccaagatcgcgccactgcactccggcctgggagacaaagcaagactctcaaaaaaaaaaaaaaaaaaaaaaattaccatgaacttacacgtagactcatggaccagaataaagagctgagagagagactcctgtgtttactgaatttttttttttccaagacggagttttgctcttgttgcccaggctgaagtgcaatagcgcaatctcagctcactgcaacctgtgcctcctgggttgaagcgattctcctgcctcagcttcccaagtagctgggactacaggcgtgcaccactacacaccaggctaattttgtatttttagtagagatggggtttcaccatgttcaccaaaccgaaatttaatatatattcaagcgggctcaacaagtcaatgagggagaggctaactctttgatgatgctggaaaaaccagcttacttttggagtaacaaaatttcatgtctccctaacacttaaacaaaggtggccttcagatgaattaacgacttagtgtgacaaggaaaactacaaaagaaaggaatgttagagaatatttttgagacagcgagggaagtaatcatatcagtttatcacgttacatataaggcctttttttcctgagacaagctctcactctgtcacccaggctggagtacagtggtgtaatcacagctcactgcagcctcaaactccccggctagcaatcctcccacctcagcctcccaagtacctgatgtgtctggaattggtgggttcttggtctcactgacttcaagaatgaagccgtggaccctcgcagcgagtgttacagttcttaaaagtggcgtgtccgcaggttgttccttctgatgttcagatgtgtttggagtttcttccttctggtgggttcgtggtctcgctggctcaggagtgaagctgcagaccttggcggtgagcgttacagctcttaaggtggcacgtctgcagttgttgttcctccggctgggttcgtggtctcgctggctgcagaccttcgcggtgagtgtcatagctcataaaggcagtgtggacccaaagagtgagcagtaacgagatttattgcaaagagctaaagagcaaagctcccacagcgtggaaggggactgcagcaggttgccactgctggctggggcagcctgcttttattcacttatctggccccacccacttcctgctgattagtccattttacagagagccgattggtctgttttacagagcgctgattggtccgttttgacaggttgctgactggtgcgtttacaacccctgagctagacacaaaaagttctccacatccccactagactagctagatacagagtgtccattggtgtatttacaaaccccgagctagacacagagtgctgattggtgcatttacaaaccttgagctagatacagagtgccaattggtgcattcacaatcccttagctagacataaaggttctccaagtccccaccaaattaactcgatacagagtgccgattggtgcattcacaaaccctgagctagacacagggtgctgattggggtattcgcaatcccttagctagacatgaagattccccaagtccccaccaggctcaggagcccagctggcttcacccagtggatcccgcgccggggctgcaggtggagctgcctgccagtcctgcgccgtgggaccgcactcctcagcccttgggcggtccatgggactgggcgcggtggagcagggggcggtgctcgtccgggaggcttgggcagagcaggagcccacggcggcggggagcgggggaggctcaggcatggcgggctgcaggtcccgagccctgccccgcggggaggcagctaaggccgagcgagaaatcgagcacagccgctgctggcccaggtgctaagcccctcactgcccagggcccggggggcctgccggcgggccgctgggagtgcggggcccgcccagcccacgcccacccggaagccgcactggcccgcaagcacgcgcgcagccccggttcccgcccgcgcttctccctccacacctccccgcaagctgagggagccggcttcggccttggccagcccagaaaggggctcccacagtgcagaggcgggctgaagggctcctcaagcggggccagagtgggcgccaaggccgaggaggcgcccagagcgaccaaggggtgggagggctgccagcacactgtcacctctcactgaaaccgcaggtgctcacaaccaggcccggctattttaaactttttttttttgtagagatggcatcttgctatgttgcccaggctagtctcaaactcctggcgtgcagcaaatctcagcctcccaaagtgctggaattactggcaggagccaccatgctcagtcagtaagaactttttaacaaagaacactataaacaaagttgtcagatgacagattagggaagattctcagaaatgtttataatggacaagacactaatagtaaaatcaacaagaaaaatgagctccaatagaaatgtgaacaacagatgatgacaatttacagaaaaaggacgaggcgtgtggagcacaaggtcaggagttcgagaccagcctgaccagcatggtgaaaccctatctctactaaaaacacaaaaaattagccgggtgtggtggcgggtgtctgtaatcccaactactccggaggctgaggtaggagaatcacttgaacctgggaggcggaggatgcagtgagccaagatcgcgccattgcactgcagcctggccaacagagcgagactccatttcaaaaaaaagaaaaaggaatttcaaacaagcgtaacttctaacaagcacataactcagaggtatcagggaaatgcgatttgaagccacaatgcacctggcaaaaatgagaaaggtctgtaacaccaagcattgaggatgcggatgtttagggaccctcgtgcagttctggagaaggtctagactgcagctgtctgttctagggggcaatctgggaggatttaataaaattaaatatattgtactccattacctagcaatgatgttccccagaatctacctaaaacatcctcacaggagttcataagagaatatgtgtgagacattcatcaaatgttgattgtgtccattactgtaaagtgggtagatgacatgaggcggaaacattttggagtgttatgcagcggttacaaacaataggctagatgcaccctatggattgtgaaaatgtactgagtagaagagcgagaaacaagatgagatctggagcacaatacgtgggtattctctataatgtcgttatcttttttatttgtttgtattctttcccatctatttgttgtgtttttattgtgctactttacctagaaaatttttaaaactttctatgtttttctttttcatttcttctataaccataactggaaaagttgcctctgagacttcatgtctgacaataagtgaacttcctgaactacctcccaattaaacacctaggaatgccgggcgaaatagagaaacattttttaatagtcacagaggagctcatcagaaaggaagaaaatctccaaaggctgaaaacaaagaaataactgaaatcaagagagctaggctgacagtgatgctaagggtgcactggtggcatttaccaagcttggtttccaaagtcttagatttgagtggccaagtgagaaaggagaagggccaaacattcatgagtgagtggtgaagagtaagccctccagtagaacttggattcttttttttatatttatttttttattttattttttgagacggagtctcgctctgttgcccaggctggagtgcagtggctcgatctctgctcactgcaagctccacctcccaggttcatgccattctcctgcctcagcctcccgagtagctgggactacaggcgcccgccactacacccggctaattttttgtagctttagtagagatggggtttcaccgtgttagccaggatggtctcgatctcctgagctcgtgatccgcccacctcagcctcccaaagtgctgggactactggcgagagccaccacggctggccttttttgttttgtttttttgggagagtctcactctgtcacccagggctggagtgccttggcctaaagggctcactgcagcctcgaactcccaggttcaagcaatcctcccacctcagcctcccaagtagctggaactacaactgcacaccattacacctgggtaaactttatttttttttatttttgcagacatgggggtctcatatgttgctcaggctggtctcaaactcctgggctcaagtgatcctgccacttccatctcccaaatttctgggattacaagcgtgaagaacttgaatttttgaaaggtctcagtgggctaggagaaaatctggccactagcaaagagaaataacaatagaaaaaaaaagtgccttaacctgggctccaggagatggaaaaaagtcttctctgagaattcataatggtgagcctgctgtcctatatatttgggttttttaaaatttaactttatggtaaaccccatgtgaacaagtaaacataaaatcatctaaaatttggccgggtgtgatggctcacgcctgtaatccaagtactttgggagaccgatgcgggcggatcacaaggtcaagagatcgagaccatcctggccaacatggtgaaagcccgtctctactaaaaatagaaaaattatctgggtgtggcggcacacgcctgtagtcccagctactcgggaggctgaggcaggagaatcacttgaacccgggaggcgaaggttgcagtgatccgagatcacgccattgcacttcagcctaggcaacagagcaagactccatttcaaaataatagtaataataataataatctaaaatttgttatactctggcctggcagggataatggcaaattctgtctgcggggatgcaagcttgctgtaattggaatgcttacatcccttccaaaatttacattgaaacttaatcttcaatgcatcaggagtaggaggcagggcctttaggaggtatttaggccgtgagggctctatcctcatggatggtactactgtcttataaaaatgctggatggaactagcaaggcccttttttccctcctgtcccttccaccatgtgaggaaactgtcttcaaggcaccatcatggaagcagagattgggccctcaccagacactgaatctactgacattttaatcttggaccttccagcctccagaactgtgagaaataatttctattgtttataagttacttattctaaggtattttgttatagtagcaggaacagatgaagacagccctcaaccaaaatcttgcatgattcccataaataaattgctgctcaagttaagccctcaacccaaaattagaagacatggaagaatgaaactaccatgaggaagaatcagtacaatcagttaccctcaaatgtcagaaaattgaagtgttagatactaaacacaagaaataaaagtggaactgaaaatattaacaaaattttgtcagacaagatcagtcagacttgaaaactcaaacctctaaaagtggaaaatagatttattgaaatgtcaaattcagtaactgattaaatagcagattacacacagctgaaggaaaaaaattagcaacctggaagatataactgaacaaactccccagaacacacacaaaaagtgtaagtgtaaaagagaaacaaagtgacatggaagactaaatgagtatcaaaatacatgtcagtggagttccagaagaaaaggaaagagaagcaatatttgaagagaaagtggctgaaaatgttcataatttttgaaagagcaaaaatcatcagaaatcacagagcagcttgatagtacattttaaaataactacaagcttgtatttggattgtttgtaacacaaaggatatatgtctgaagggatgaatacccctttctccatgatgtgttcatctcacactgcatgcctgtatcaaaacatctcttgtaccccataaatatatatacctattatgtacccacaaaaattaaaaatagaaaacttttttaatttttgaaaagaaatcacagtgaatctgaagcataaataattttatttatttattaacttttattttaaatttaggggtacatgtgcgggtttgttatacaggtaaactcatgtcacatgggtttgtggtacagattattaacacccagacattaagcctagtacccattagttatttttcccaatcctctctctcctcccactgtccaccctcaagtaggccccagtgcctgttgtttcttctatgcgtccatgtgttctcatcatttatctcccacttattagtgagaacatgggtatttggttttctgttactgtattagtttgctgaggataatggcctccagctccatccctgttcctgcaaaggacatgatctcattcttttttatggctgcatagtattccatgatgtatatatgttgcattttctttattcagtctaccattgatgggcatttaggttgattccaagtctttgctattgtgaatactgctgcagtgaacatacaaatgcatgtgtctttatggcagaatgattcatattcctttgggtatatacccagtaatgggattgttgggtcaaatggtagtttgggttttaggtctttgagaaagttgccacactgctttccacaatggttgaactaatttacactctcaccaacagtgtataaccattcctttttctccacagccttacaagcatctgttatttttttacatactctgatgggtgaagccacaggggcagagcaggcaacttccatgggaggaatttgctgccgtgcttccgacaaggtcaaagtgtagaacactttctattgctaagtaatgtgcaggagacatctctaaccctagctcatcttttaatctgcccctgagacatgcctatttttaaatacaaattcctttccagttttaacagagaggagcgctctgtttccatgttcccgggtttggtcttcagctgtcaggcagccctttgttaggtatctaggtggtgcttcctcacgggttaagaaatagctccctggcagggccgggtgcagtggcttacacctgtaatcccagcacttcaggaggccgaggcaggtggatcacaaggtcaggagatcaagaccatcctggctaacacggtgaaaccccgtctctactaaaaatacaaaaaattagctgggcatggtggcgggcgcctatggtcccagctactcgggaggctgaggcaggagaatggcgtgaaccccagaggcggagcttgcagtgagccaagatcgcaccaccacattccagcctgggcgacagagcaagactccgtctctaaaaaaataaaattaaataaaaattttaaaaaattttaaaaagtactgagcatttgtagcctctagtcagttctttaaaattttcagcaaaatttaataaaatacatatatgaacttaatttgttgaaatcttttatatcatgtgctatacttatctctctgaaatttttaaatatattacccctcaagaaattaatatttgccatgtattatgtgttttaagcctgactgccccaaacgtaccctccaaatttgctgaaaattcatccattatccagtaacaggcaaacagacacttggttttatttgttcagaagttgaagtgtttttctatgtagctcagtaacactcgtttgtgtttaagcatatggctgtcttctctgctcccacacttaaaatgggcatctgaatttaaactagggaataactaaattaatagcttatggtttgtagatattttattggcaagaagaaaaaactcaccaaattgtcattgactgttggttcaattcactgtttttttcttacagtcttacttgtttccctgttgcatccctattatggagatgagttaaagagaacaattgtttgcacacgtgcaggcatttaggagttacctgatgccacccactatggtagtctccctgcttgctgttacaaaccaaactaaaatgttaagccctccaactgactgatggaccccccagccagccaagggcattccaaagtaaagctgaaaaaccagttcaggctattatggaaagtggtgggggtcggggaaaggtgggacatacctcattatatcatcctgtctttggaattcatgcacaactgaccagcattatcattaaaagagatttttaagattggcagggcatggtggctcatgcctgtaatcccagcactttgggaggccgaagtgggtggatcacctgaggtcaggagttcaagatcagcctggccaacatggtgaaaccccgtctctactaaaaatacaaaaattagccaggcatggtggtgtgtgcctgtaatcccagctacttgggaggctgaagcaggagaatcgcttgaacctgggaggcagaggttgcagtgagccgagatcacgccactgcactccagcctgggcaacagagtgagactccatctcaaaaaaaaaaaaaaaaaagattaacagtatagatttttttgtagcaataagacaccagattccagcctgacactagtatagcatcacatgatggatagcaggccctgagacaaaccaaagtattttatccccaaaatatatttatttgacatattttgaaatgaccctgcaaagctgtctctcatgggggaaatctgaactctgtagagaattccctgttcttcacaggtctttcccttgatccaggagaaaattatctaagagcctggcatgttttttggtctgataagagctctgaagcctgctacctggaggcttcacctgcgtgataaaaccttggtctccacaaccctttatctgaacccagacattcttttctattgattccaggtctttagataataactcttttaaccaattgccaatcaggaaatctttgaatctgcctatgacctggaagcccctccacctttcctgctttgagttgtcccacctttctggactaaaccaatgtacatcttacacatattaattaatgtcttatgtctccctaaaatgtgtaagaccaagctgtggcttgaccaccttgggcacatgttctcaagatatcctggggcagtgtcacaggccattggtcacccatacttggctcagaataaatatcttcaaatattttacagagtctgactctttttatcaacaataattggcacccaacatcgggcctcagagcccccaaaagagttgcccaaatctgaagctaagggaccagcaggaacccactgaaatattgacttaatgaaattgcaaaaaggttttaatttttaaattccataatctctttctttttgaaatttttcaagttggtatctcaaaagttcaacttctgctgtacccctgctgcttcagctctttctttctttgagaaggcctgggatggtaacttttgtcagctcctgtgtgtgtgctcctataactttttttattaatagtctaaagtaagggagaggatttttgaaaacaggcaaatcttacaggatctgccactgtctgtgtgtctgttatgtctacatgtttatatgtgccatgtggaagtgatgttttactaccaaactatataaaagagctctaatcagttggcttaaagaggccaggcacagtggctcaggtttgtaatcccagcactttgggaggccgaggcgggtggatcacttgaggtcaggaattcaagaccagtctggccaacatggtgaaaccccatctctactaaaaatacaaaaatcagtctggtgtggggcgcatgcctgtagacccagctattcaggaggctgaggcaggagaatcacttgaatctgagaagcaaaggttgcagtgagccaaggtcaggccactgcactccagcctgagcaacagagtgagactccatctcaaaaaaaaaaaaaaaaaaaagaaataaaaagaaaaaattggcttaaagaaaagtaagtgcttgtcgactaacagacggtagctcagatgccttttacttcacatgattttagtaatctttggtaagattaacttggcaaattgaagctcaaaattgtctccagttcttaagaaatttaaagtcatgttatgttaaattaagtaatcctggattttccactgggaatttggattactaaaaattagaatagttggagaataagatatgtttttggtgaggatgtaaaaacatgaggatatggttttgctaaagaaaatgtatttttttctagtttagagaccatttaagggtcactttaaaataaaatttaaaaaaaattgtttcactctgttgcccaggctggagtgcagtggtgccatctcggctcactgcaacctccacctcccgggttcaagcgattcccctgcctcaacctcccaagtatctgggactacaggtacacatcaccacatctgactaatttttgtattcttagtagaggtgtggtttcaccatgtttgccaaactggtctcaaactcctgacctcaagtgatccacccgcctcggcctcccaaagtgctgggattacaggcatgagccactatgcatggcctaaaataaagaaaaaattatacagactaaatggataaagagaaaaataaaagaaagggtggagaatggatgtggtcacccatcttaaggagctgcagctgtgctgcattcagttactaaaagttagcagtagaatttaaagatggatcatgctcccaggaagttggttcactggatgcataaggaaatacaagctataaccacaaaataagtgatagaatttttaaaaataaagaaaatgcaaattaataaggaagaaggaaaatatttaatcccttggttattgttatctgtaatagctgagatgaaaacaaaagagagtgctgggttgggccttaagactggcccaagctcagatgtgggtctctctcagctcaggccactagcctcaaagtgaaacgggaaaggttcccttgtccccctctcagggcatgcaatgggggcgtggctcatttcttcagtgccccactgctcaaacctctaggggagcatacagacgggcagcctgtggggctcccaccccacagcagtgtctaggggtgaatgtttacagctgaagccccagtgggcgtgtgttacagggtgctctgttacaagtttgcggcctataggcggcttgtgtaaaccctctcaattaggccctctaccttgtcacaaggacagagggctttctgtatcctgggttcttgccttagtataccggaagaatcagatcacacgtgggcttggataatgggtgcaaggttttaccgagtggaggtagctctccactgatggaggatccagaagggagatggttttcccctgtagttgggccactcagcagccccggctctcctccgactgctccagccaaactccgcattgttctgcttgtcatggcctgccagcaagctggcatctgccagcgtgctcttccaccagcgtgctcttccaccagcatgctcttccaccagcgtgctccctcgacgtcctcttgccatccagctgcttgtgtcttcttccggtgatgtgctcctctcaatgtctggctgcctgtgtgtttgcctgctagggtcttgggtttttataggcccacgatggggacatggcaggccagggtggtcttgggaaatgcaacatttgggtgcaaaggcaggagtgcctgtcctcacctaggtccatgtgtgttgagccccagccagggaccacaccctcctctacccagcacttccctttcccttttcatttaaagggaccacgctcttcccttcccagcactcccatatcaaaagctacccacaaatggaaacattaagccagggtgacaaaaggtacctctgaggtatgtaattaccaagaaggtagtcaatgtaggggaagggcaaaaccaagtaactattaaaataagagggtataatataaagaaattgtaccatttggtagattgatatcatcagcttcctgagaaacctttgctaaaatggactgtaagaataactactttaaggacagtatctttaattttaaatgctacagaatgaaagagcatctctgggttgatgcaggacccatagctcactattaaacaattgcggctgagtttatgtgatccaaatgcccaggaggttattcctgagcaaatggccagcctagtgaactggataaatgcccatgtaagatctgtttaccctgagaagggcatttcctaactctccctataaaatgccaagtggagcaccccagatgaaatagctgatatgctttctatacaagccatctaggactggctttatcatgaccaggatattcacccactgaatatggctattacccaagttatggtaaatgctgtagttaagggggtcccttccacatggacaccccaggttataaccagaaagggttcccaatctagactccaagagagggttcttagacctcatgcaagaaagaacttggggcaagtacataaagtgaaagcaagtttattaagaaagtaaagaaacaaaaaaatggctactccataagcaaagttatttctcacttatatgattaataagagatggattattcatgagttttctgggaaaggggtgggcaattcctggaactgagggttcctcccacttttagaccatatagggtatcttcctgatattgccatggcatttgtaaactgtcatggcactgatgggagtgtcttttagcattctaatgcattataattagcatataatgagcagtgaggatgaccagaggtcacttctgttgccatattggtttcagtggggtttggttggcttttttttttttttaaccacaacctgttttttatttatttatttatttatttatttatttatattttttatttttttttagatggagtcttgctctgtcacccaggttagagtgcagtggcaccatctcggctcactgcaagctctgcctccttggttcacgccattctgctgcctcagcctcccgagtagctgggactacaggtgcctgccaccatacccggctaattttttctatttttcagtagagacggggtttcaccgtgttagccaggatggtcttgatctcctgacctcgtgatctgcccacctcggcctcccaaagtgctaggattacaggtgtgagccaccacacccagccacaacctgttttttattagcaaggtctttgtgacctgtattttatgccaacctcccatctcatcctgtgacttagaattccttaacctcctgggaatgcagcccagtaggtctcagtcctttttcttttcttttcttttcttttttttgagatggaatcttcctctgttgcccaggctgcagggcagtggcacaatctcggctgtctgcaagctccacctcccgggttcaagcgattttctctgcctcagcctcctgagtagcagggattacaggcacccaccaccaagcccggctaatttttgtattttttagtagagacagggtttcaccatgttggccaggctggtcttgaactcctgacctcaggtaatctgcccacctcgacctcccaaagtgctgggattacaggcgtgagccaccgcacctggctggtctcagccttattttacccagcccctctacaagatggagtcactccacttcaaatgcctctgactaagtgacattacttctgcagaacaaatttgctgttcttcatgggtcttgcatatgctaataaaacattcggcttaaaagaaaaataggaaaggcaaatgggagtcaaaagactcttctaagatgagtggttattaagaaatgaaataaaatgaaaattgatggggttaaaacaaacgtctttacaacactatcaaaggttataatagctttgatagtggctattatatatagcttggctataatagtcctctaaagacaaaccaggttacaattcccttcctgatgtttttagttgatgccctaatggaataggtttctttttctgttctgacacacaagttctcttctgattgtcaaattattggctaaagggagcccctgctggtccccaacattataaagcccgacaccagtttttagttttctgctttctgcatttgctccagattggagaaatttaagaaaaatcaaaagacacggagttaaaatgagagagctgacattgcctggggcaatgttgaggcaaattacgataatgattgacaaaagggcctgaggcccttcacccagcccccctgctggaaacccagattcactctcaccagggaagataaaacggtctgggatagagaagaaatgttcctagaacaagaacgtaaaaatataagggacctgaagctatccctgcagtaatggaaataatgatgcccaaaagagttccatgagaaaacaaatggtttacgtaagatcttgcttcctggaaaatgcaaggagaagatacttgcaagcagggagcttcttttcccccttagaattaacactgcatgaggagctgctagattctacagtgcttgataaatagctcttccctgactgacaaagagctgcttagtttgcggatggccgttcctaggtgaacaactgacatcctatttggaaggctgctactctgattgtgaagtatacttttatgaacagaatttacctttcttgctacctgagttcccctaaattcggtaactattcatgagtatccttattttatggcaatatacttgtttgcataagttcggttaagaggacacaattggagacactggttattttaccaaggctttgactaaataatatatttttaggagtcccagcaaagccaacttgaaaagagcctatgtggccaatcaattcttgttgaactttatgcacataattaggccaagtataagcctaaaacttaacttacacacaaattggccttaccatgatttctctttagtggaaaaacagggctagagagagaaaaattatgtttcaaaaggaaaactattcacacacctgttactagattgcagccctgacctttgtttctgagcacagattaaatcatgaattatttcttggctataacagtcctctaaagacaaacaaggttatgattttctttatgtttttagttggcattctaatggaagagggttatttttctgttctgacacacaaattcttttttgatggtcaaattattgttatttagctcacatagctttacttcttctgaggaaaccagaattatggtattctgaaggctagagacaatttgacaaagcctgtgaatctccctcatttgagatcctgctgggcccgatgtgtttttcactgccaatgccctgctgctaaaactatacaagcacctggctgggcacggtggctcacgcctgtaatcccagcactttgggaggccgaggcaggcggatcacaaggtcaggagatcaagaccagcctggctaacaccgtgaaaccctgtctctactaaaaatacaaaaaaaattagcagggcgtggtggtgggtgcctgtagtcccaggtacttgggaagctgaggcaggagaatggtgcaccgatttccacatgcaaaagaaagactctgaaaccctacttcacactatgcacaaaaagtcatttaaaatagatcaacagcctatgtcgggcacggtggctcatgcctgtaatcccaccactttgggaggccgaggtgggcagatcacgaggtcaggagatcgagatcatcctggctagcacggtgaaaccccgcctctactaaaaatacaaaaaattagccgggcgtggtggcgggcgcctgtagtcccagctactcaggaggctgaggcaggagaatggcatgaacccgggaggcggagcttgcagtgagccgagattgtgccactgcactccagcctgcgcgacacagcaagactctgtctcaaaaaaacaaaaaaagaaaaagaaaaagaaaaagaatgttaagggttgatgaatgcctgtccacctttattcctgtctggctcagaacatttaaattatgtcttttagctctaagtctcttggctgtaggagtcccacttagagacagaagggacccatggcaggcagccacaccaccccagcaatgctgtgggacgaaataaaagtttggtggcttgctgttttctctgggaaatcttggccagaaggaggagaatgtaaaccaaaaataaaattctaagccctacaacttactgatggacacccctcttaaccaagggcattccaaagtaaacctgaaaagctagttgaggccatggtgggaagtagaggtcagacatgcttcattattccctcctctttttggaattcgagcataactaaccagcattaacattaaaacagagatcttaagactgacaatacagacttcttgtagcaataagacatcaaattcctggctgactctagtatagcatcacatgacagatggcaggccctgaaataaagtatgttagccccaaacatgcttctttgacatattttgaaatggccctgcaaagctgtctcttctgagggaaatctacattctgtagaaagtccccttcccttgccaggtcttttctgtgacccaagagaattaactaagagtctggcaccttttaggtctgataagagctctgaagtcttcatctacatgacaaaaccttggtcaccacaataccttattttaacccagacattcctttctattgattctaggtctttaggtaataactctttaaccaattgccaatcaggaaatctttaaatccacctatgacctggagcccctccaccttccctgctttgagttgtcccgcctttttgaactgaaccaatgtacatcttacatatatggattgatatcttatgtccccctaaaatatataagaccaagctgtagccccaccaccttgggcacatgttctcaggatctcctggggctgtgtcatgagccattggtcacgcatatttggttcagaataaatcttttcaaatattttgcagagtttgacccttttcatcaacaccatgttttgcaagagagtcattgagcaggtgggtgttggcatggccaccgcatggaccagggtgatgggttgccttcacattgtagttgtctttgcaagtgttgccctagaaggttctatttcacctcatgggtttacaccctggcatcatttgctttctgagacatgattgtctccaggccagggttgatccaagctccttcttgctcatggaggcagagagctcttatttgttttcctccctttgtagtgtaatctgcttttagccatgccatagattatgcaaaattgtaaatggttctctctcacacaatttggctgtaggaaaatattattctgtggcctctgtacacggacgcgtcatgcttagagatttcatgcccacagggtatgcatagcagtgggctccttccaccttccctgcaatgaggaggtaattatttgaccatctctttcagccacacttaacaccaaagatcccaactaatggctcgatattttatcaataagactgaaagtgtagcttgtcagatattttctttctttttatttttgagtcttgtattaaatcttgtttcccctaacagcactgcatagctgggcatcgcaaaagcacagcaccggaggctctgtgatctggtcctgcctgcctctctggcctcactctctgcatgcacagccctaggtcccagccactccaaacgctcacagtgctgattactgaattgtcgtgtaccttctctggcctttcttcattggcagagactgttttctttgccagaaatatttttttactcctccacctggccagcgcttcctcccttgagttcagtcctctaaaccaacctgccagtgctccctgcaccacccaacttaacaggactcagcttagcaccatgcatgtggaaggagagcactaggcttcagggatgccagagctgcctctctttgctctccctgggaagggcatgagcaagagggcaggcagtaatgggactctgcctcccacctgggatgccagcctcagggtattggaacctatcaccacagaaaactggaggatccagtcagtggctctcctgctacccatggtctgaagttgcgggcacattgcacatactttcctggattagagaactctccaagccctccctcctgccctgcttcagagagcatgccaatttggcttctgcccatctccagcaatggttcctgtggatcctctgcctagcaacaggatttaccaatggatcagtggcagggcagaatagaaaggaaccagggatggctcccagaggatgttttaccttaagcaaccagagagatgaaggtgccacatagacagatggaaaactgttatttaggacacatttggaactcagctagtcaggggagcaaggatgaaaatggtttgtctcatcacccaccttcctgccaggtgactccggtgggctcctctttggtagggtgccttctggaggctgacttgtgggatggtgattggcttctttcaattgggggtccatcgggcctatagcccctcgagctgcatggagaacagcaacggccctttgctcatctgcagcttacagcactgtctccacttcatcttgatgctgctcctggtcagtctcagcatgctagggatctccttactcacagacccaactcctgataaccaagtaattgctactaggtagggtgctctggggtggaccctaatagcactttggaaggccgaggcaggcggatcacctgaggtcaggagttcgagatcagcctggctaacatggagaaaccccatctctactaaaaatacaaaagtagccaggtgtggtggtgcctgcctgtgatcccagctactcgggaggctgaggcaggagaatcacttgaacctgggaggcagagattgcggtgggccgagatcacgccattgcactccagcctgggcaacaggagcgaaactccatctaaaaaaaaaaaaaataggggaattcctgcattctctttggaaagaggagggctgggggtggcactggagtgaattagaaataggagggtaaccctggaagggcccggcttaatgaaacaaagctgaactcacctaatgctctgcagtgatctgtcaattaggtgttcatttagatagagaagtttggcttttaaaatgcaaattttctttggaagtattaagttcaccaacctcagtatgcattaatgcaatcagggcaatcccagctgctacccacccagggggaattaagccaatggcaagggggaggggtggtgttgtgggcagctgcctacagccttctcctcatgagccatttcttacctcccaggaggcaggtgtcagtcacccctgttttgaatatttattacaaagtctgggttcagagaaattaagtaatttctccaaggtaacaaaactactaagtgtcaggcctgggccccaacctggctccagaactcatgctggctccaccaggttgttataagtttagataagtgtgaacagggcaggagagggctctcccctacccactagaaatgtcaggtgatggttcagcagttatcacattgcctctctaaaaatgataacgcaacagcaccagagagaggccatttcctgatgttccacacctgttaacagcaaaatgttaattgaatgcaggccccagggagaagcaacttcctgggcatgcaagttaggagacaaaaatggtgaagtatgatcttccgggggcacacgccactggaaaaagaaagaaagcctcagacgggcgtgcatataactccctaaacacagtgcgcatgctcaattccaaaggctaaggaaagcactgcgcatgcggaaagcccgcccgaagggcagaatcatgggaaagaggcaagctcataaaagtcctaggatcatggttaaatggggcacttgaccttctctctttaaccttcacatgtcctcctgggtctcttccaagcaccccttcctttctttcctgttctaaggccttttaaaataaacttccactcctgttctggaacttgcctcagtctctctttctgctttatgtctctcagtcaaatcctttcttctgagaaggcaaagactgaagttgctacagacccatatggataggccaccagtaacttggggtaactcggatcccttccatcggtaacaaagtcacccactttgccaacttagcaggacagggacttggccccaacagaaagcagcaggagagagggtcctgagggttcagccagcaagcaacagggtctgaggttcagggaggaccgcagaagggactggggacagaagacctgtacctttctaccagcttcacccagggtctggataaaaactggcacttggaagactgcaagccccagggtcccccagctccatcgtggggattttccctctggccaccccatttttctgctcagcattttccatttggttcattcctctcttgcacacatagccctgctggaagaggggcaaagcacatggggaaaggagctggctgctcacaccccacgtgattgccacctgcatcagtgacacacatgggagacttccctgctcctggcactttgagaagctgggggtgggtgactttctatttcctgttgctcagggtctcatccgttttctgtattcttttctgctgttctcttactctcaacttcttgatgttgctcacttcttgtttagtcagccacacatttttttgagtgtttcctacctgcctggctctagagaacacaaagaaagtagctgctgaagccaggcgcggtggctcacgcctgtaatcccagcactttgggaggccaaggtgggcagatcacgaggtcaggagatcgagaccatcctagctaacatggtgaaaccctgtgtctgctaaaaatacaaaaaaaattagctgtgcatggtggcacgtgcctgtagtcccagctactcaggaggctgaggcaggagaatcgcttgaacccgggaggcggaggttgcagtgagccgagattgtgccacggcactccagactgggtgacagactgagattctgtctcaaaaaaaaaaaaaaagaaaagaaaagaaaaaagaaagtagctgctgaaagaggaaggggagaggaagataaaaatgagtgtttatgggtcagtgacaacgtgccaggccctggtccactgtgcatggcacctctgctcaccactgtcagggaaggatgactctgtccccgactcaacgcaagctcagaagcccacaggcactgtgcaacccttggccctggctcttccagtgacctcatccacaggaagctgattgtgtccttgagaaggcaaaatgtgcacatatggcatcaccaggaagcaattaaaggctaagctgagtctctgtcatcaacacagcagaatctgagtcccagaattctagtctgagaggtggggctcaggctggggaggcagcacagcccagcagggctcctaaacatccctaccatggtttagcaggagagagtgtgggccagagcttcaaataccctccgctgaggctggggtaacaggttccaatgtatctactctcctgatcccagcccttaaaacaaaacaaaaccacaacaatcagctgggttttgttacttccccaagttcacagatatgtttttaggaagaggaaaaaatgacagaccagaagggaaagggagtgccccccttagggtccgcaaaggtgcagctgaactaggccctaggcccaggtgctggctcttctggactgagctagcaccgtctctgatgcccatagagggctctggaatgaaagcagctctggggctgccctgtcctgtgcatccacatgacagagcttctcccagcaccaccatcagaagtagaccccagcgtgatgggcagctgcttcccatatgaagaggttcacattcctgcaccctcagacggggaaagagctctgagcttattgcctccaactcctgcctcacagctgagggacactgagccccacagcagtgtgtcaccctttgccaaggtcacacaccacagggtgccagagccagaacaaactccagggtcctgattcctacactttcccatccacattccatcttgtgttggagtctaacaaccagatctcttttcagtcctttgagatcctggtgtccagctgtgggccaaggtactgtgtggtcttcatggcagggtcccaggtggtgacgcacccctctcctccctccatggctccaccagctctgttggagtttgtgcatcagccaagaggaaacggtagatcaggatgcagagacacaggggagcagaatccccatccccgcagcacagccagatgagaggaggttccaaagtcctgtgtgcagtactcagcaccccttggccccacactctgcaccctcagaaatgtccctccaggcaggggcccaggcattcacttgtcctgagacacctcatgggggtgttcagggcaagtggaggcacctatgagacagccaggtggaaccatctgggctggtgggacgggcatgggagaggacagaaaatgcactggtaggctcccagaggtgcatataagggaaacacaaggggtacgagggccaccccatgggaagtggaagagacagtgcaggggcagaaaagcagaagtactttgtttcctggaaatgttttagggagggggaggtggtgaggatccattgagggaaatgctgatggctgaagaaagatgaggcctgatgactggtagttgggttcctacacatggagaccacgttgtgccccacaggagcaatctggtggtgtggtgtcggggagggtggaggaattgggttacagagcctgtgcagggatttggaaccagagggctcctcagaacgggagaaggagatggtctgtaaggacctgttcgactccagtgagggtatgagggacagtgagggaggaaagcagtcccacataggaggacgcccagagtggggaagcaggtcttggggagagctaggtttcagtccgagcgagaagggagaggatgttccaggaacaggctgagaccctggggcctccagaaggcttgaaagaaaggtttcagcagatggggtcagaaaaggagtgttcagggccatagggggagggtgacctgagcttcttgcagtccctgacgcaaacagggataaaggacataatgagattagtcctgaatctgaggcagagagtgatgaggaggctgtgagtttgcgggagggaggggagggcctggctgggagaaggctgggttctaggttccctatagtcctgccagagaaagtcagagcccagagagtcaatggctccctcctgacacctgcacagggaagtgtacacctggccagggtgggtgctctgtagactgctgtggggtgagggagcagcttctcctgggcataggactcaaggcacctgcaggatgcagggctccaggctccctcagtgcctgctgatggctctcctctgagagggggtaaactggcttcctgggtacccacaatgtacaaggcacttgttctcagtaggatgcaccaggaactgtcagaagtatacctatatgtgacaggcatgattactaccccgattttagagctagggaaactgaggcactgagcagttaatcaatttgccccaggcccaatagataaacaatcagtgtagagctggggtctcaacacagcaggctccctccacagtgtgggctccaagccacactggctgtcctgctgccatcatccagccttggctatgtttaaaaagaaaaacaatgtcaggcgcggtggctcatgcctgtaatcccagcactttgggaggctgaggtgggtggatcacgaggtcagaagatggagaccatcctggctaacacagtgaaaccccgtctctactaaaaacacaaaatattagccgggcgtggtggcatgcgcctgcagtcccagctatttgggaggctgaggcaggagaatcacttgaacccaggaggcagaggttgcagtgagctgagatcgtgccaccacactccagcctggacaacagagcaagactctgttaaaaaaaaaaaaaaaccctcagccaaattaaatttaacagactttaattgagcaaagaatgatttgtgaatcaggcagccttctgagccagagtaggtttagagaaactccagtgcagccacttgatggaagaagatttatggacagagaaaggaaagtgacacagaaaacaaaagtgaggcacagaaatagccggattggttacagcccagcatttgccttatttgaacatggtttgaacagttggccctctttgattggccaaaactcactgatccgcaccagagtaggttacagtctgtttatacctccatttaagttatagttcactatgtacagggaaactatgagggcaaacttaaaaatatgttaggaggaagctttagactaaatttgatgtaatgattcccctctttcggtcatgctctcaattttgatagattgaccaaaactgtagtcattgatgtcactatcgccattgtaaacatacttatttggtctcaaaacctacggaaatagcagaagagtggattttgtaaggcgagaacaaggacatcaggttattttttttgtaagggttagagtagagagtacctcctcatgctggaatgtccagtttacaggagaaaaacaaaacctggtctgttctaggatatatttgtatctttaaagtcttagtttgattatatcaagtttaccataagtgactccattttggtttgatctgatctgttggggttagtacaggagctcagtctaaaacaatggtctttcataatctcgtttaagaattcctcccttttggtcacattctcacataggtgagagtctgaccaaaacttacagccttagcaccactctcagttaccatcattttgggtttccagtctcaacccatcattcataggttacagtgccctcatggtcatacatttatttgagctcttgtcattccagttgaagagacaccatctgaaattctagagatggctgcaagcaaatatttaaaacttttgagagaatacagtgcaccagtggggctactattatgactatcaacaggataatacacagagtttggagtatgctccttagccagggtccccataaaccaaaccacctaaaaccaaatagatcaaagaatgagctagatgaagagtctactcgctttaaccaagcagcccgttcattcatttcttacaaccaaatctctataatacctgatttatttctccacaggaaacaagaagtgccaccaactgcagagatacttctctgtttagccagtaaataatctagagaaattctgttatttagcataactttcacaagagaatgtatttactgattgattgattgattgactgattgactgagatggagtcttgctctgtcacccaggctggagtgcagtggtgtgatctcagctcactgcaacctccacctcctggtttcaagcgattctcctgcctcagcctcctgagtagctgggattataggcgcccgccaccatgcccagctaattttttgtacttttagttgaggcagggtttcaccacgttggccaggctggtctcaacctgacctcaggtgatctgcctgccttggcctcccaaagtgttgggattacaggcatgagccactgcacctggccttcaaaagataatttcaagcctgctgtgtaaccatggcctttacaatagaatctgctgtagagcctatcatcagggatacatttctaatcattgcctcatttactccaaaccatggaaaaagagacctaagaaatgatgcccatctagaagaatgaaggatcgtggaaatgttctctttagcatgtgatgcatcaataggttaagaggagtgaatgaatattctgcttctgactgcttatgaagcaacacatgtgccactaaaatttcttacctacattggccttttatcttccatctatcaagacataagtttgtccatgtataaggctagctgtaaaattcttcatttaaaagtataccccatgcgtgcacacaaaagacccccttttcactcctattgtttgcggaggcataagcaaggaaaaaattgaaagataagagtctcatgttagcagagaagtcttgattcatgatcttggaaaaaagctgtcctcatcaaggatgctgtctacttctggggagaaacttccctggttagctttacctaaggtttccaatggatgtacagttccaagagtctggaggggcccttatgagttgtgagattaaaaacccaagattcaagatctggaagttttgctgtagtgtggatggcaagtgcagtctttctccaattttctcagaaaattcaatcttcaggttctagattgtgaagatgttgattgtcctgtcagtggaccatgaaaagctttctttacctgaaaatacactttggcataatgacctactgttatatcagccctcttgcatgcacgaaaagtttttatacgaccagaaaacatgcactggaaatgacaatggaatgaaatccctctataaaaatttaaatgactctccatgtagcaaaaatgtacctgaagtttttattatctttccaggaatgtgggtttgacaaactaaatattggtcataaactattttagcaatttagaacagtcatcacatacacatatatatatttaatttgaatcattttatctctttcacgattagtcatggaatgcaaagcttttaataacaaaagctttaaggactcaggaaggatgaggtgggcatccaggttctccatgagtccacacttaacactgaacttacgtcctcttacataccagctgtttctccagtgtaggtgcatagcactgataactgataggttatcataggtaatttgacctggaccatggaattcatttgaactgcgtatctaaacaattaattgatttagcataaaaatctggcaaagtaccttcttggtattcaatttttttcctgcttgggtagcagttttataaaccagtcagtctctttattagagttcaggaattcttacccagtccaaatgatttgatctgaaagttatcagaaacctgtattcgagagtgtttgtcagggtccttttcatcccttcatgaaactccttaaagacaccatattctaagactttgtgtgcttgtgaagttttcagaaactgcatcagaattaagcaattaactgtggaaataacttaaaatggtcatagttaaagagacaatttacaaggaaatttggttatttctgtggcttataataatttaacgtaataaccataattatgactgatagcatacacccaaacattagaattctataaacgccatataattttggaatatatattaataacatagtcactaaaatataacttgaagaaggttaaacattatttcttatttgacaatgcctcccatgtagtttaacatgtcaaataattctatttatctttcttttggatgcttcaggagccttttttatcatccaaaagttaaagataaaaaatacttaattttgaaggtgaaatttgattttgggaagcctgtaaaatatgtcaaaggtttaaaacatgtaaccaaataagatcacaggctaccataaaataatagtcatttatttagccaaagtgataattaaaagatttttttaaacccaaaacctacactctttgatagaggatactcagttttccaaacagtcaagagacctgagaaagaccccatgagatagaatctgtctcttctcttctctctttttttcctttttgctgtttacttaaaagatgaacataaatattttactatgccttattgatactacacaatatttttgttcaaaagagaaaaccaaattttacttttgtattagtgtattatcaacactaaagctaatttttataaaatcttataaaaatttatcaaatctgtcatttttaactacacaagattttcataagccttttgctttacgttttctccccaactttctatgtttatctggttttatctattttttactcctcaatttgaaatctttagtaacttcaaactaaaaatttttaacaaacacatttttatgcctttaaaacttcctaatcaaggcataacttacttttgtttagatagtctttatacagaattgtttctctcatatctagtatttttaattacatatattaactataattttaactcttaataaccctaatttctagtgaaaaccactccaaccaaaaagtaattttgaactgttttatattagtatttgtagaaaaaattacaattttttagaaagatgtttcttcaaattactgtttattaacagatctaaatatgtttggcttttctataccatgttaataaaaatgtcaaggtatataggcttaaactcttgtttaataattaatatttcaggtcgggcaaggtggctcacgcctgtaatcccaacactttgggaggccgaggcaggcagattacaaggtcaggagtttaagaccagcctggccaacatagtgaaatcctgtctctactaaaaatacaaaaattagccaggcatggtggtgagtgcctgtaatcccagctactcaggaggctgaggagggagaattgcttgaacccagtaggcagaggttgcagtgagccaagaccacaccattgcactccagcctgggtgacagagtgagactctctcaaaaaataataataataattaatatttcagtattttaagtaataaatgactcagacattttgtgattatctgttactttggcataacatgactttaagatttttaattactaaaaagaattttgaaactataacccaagtaccatccctaattgttgtagaactcttagttcagctaaagatgggggtccttgtcacacggccacaaaaaaattaggctcatagacaatttgaaggatgaggatggcagggtttattgagtgaaaaggaaaaaagataaacagggattctccacaaagccagagttctgctagtgtgcttcccacctcacaaactgaatcccaggtaccacccaggaagaggaggggccaggctcctccccactgcaaatggcacgaacttctgtggctctcataacatctcccccaggtcatctggggtctcaagtaaccatgtagtaccaaggaggactatgaaggtcagggcctgtctgagtcctgaatttacataccaggtgtagaggccaggacagaagacagctgtaaagactgtgcctagaggatccaacccctttccaaaatagccagtaggcaagtagggaaagcagggaagaagggtcacatttggcttgattctgacttgtagctgctggtctaggaactgagaacatgtctccagacctcatcatggacacttattcacatccctaaatccagaggctctaaaccaaaaaaaaacataagttcacagtcaagtcaagcaggtatctaattatatttaactgataattgtgaactcattcctgtttcgccaaaaataaaccagctttatttatcaaatattatcacatacacataacacatatagacatacaaacacacaaaggcagatcttatagcttccataaaggatttttatttgacagatttcaaatagtttttctttcccccatacagactataaatcttccagttatctgtttcactgccctaagcaattgttaactaggcaacaaatttgcatttctaaagggacagctcttacatgaaacaaaaaaaaattatatttcataagcacagagctaagattttaggcataaatattgtatcatcatttgctcaaatcaagggaaaaaatggtacataagtgaaagttgatcaagataaagtggccagaaaagcaccttaagcaaaggcatgacttattatgtaaatttaaaacaacggcaagagtttctattgtacataggcagactcccttacaaatggaggtttcctttatagatgtaaatttcttttacaaaaggcttttaagattgccacttcaattccagaaaggtgtattttagttcagttggtgttctttttaacttatctactgtttcttagctaaaattactaaattcagggtggagcctcttaaggaatagggcaaagagagcattctgtatgcctggacttagcatgaatagatctgaaaaagaagcaaggctattttaactgagggtctaccttttataaatactttatctaggatatctttcatttcacctttggggcagcatagcaactaagccaaaaggttagcagatttaatttttcgtatctattagtaacttaagctttttatttgcctttttaaaagtctttaaataaaaatattgcaatctttttagaagcttctgcatatcaatagacatccctagatgagactatattgggagacctcattttcaaatgcacttcttcaagtgcagggttgttcatttggaacatttcactgtaactttaaattatctttagtaagattttgccatttctgtagtcccagctactcgggaggctgaggcagaagaatgacgtgaacctgggaggcggagcttgcagtgagccgagattgcactactgcactccagcctgggcgacaaagcgagactctgtctagcaaaaaaaaaaaaaaaaaaaaaaatgccatttctgtaagcctttgctactactagcaccctctagggcctaatactgatacacagattagccagaaggtactcagctctttagaaataaaggatcccatttttacctcaaatattgactttggctctcaggtcccctcaagcaactatgtcagtgatttttttccatacctaagtgtacaggaaaaaagaaacaaaggaagtagaaaacacaaaaatccctgtggacttccaaaagccaaagtttacaccccctgcaatattgccatctgctactggtttctttctgacccagtcagacaaaagaggcccctaactgtatccaagccagttaattatcagatacaatccaattgtagactcagttcagtttctgtcagaacttccaaacccagtgttgatcaaaaatttgctcaaacaaactcagagaactcaaatctctgagcaaatctgtggagcctcacaatctgagggagaacttaccaagatccccagttgctgtgagagagcaatggaaacaacaggcacagtgggtaacttgcttgctcacttggcactttgggggttactagaagttctagctcagatcccacttctgacaccatctgttaaaagaaaaaccttagccaaattaaatttaacagagtttatggtttttttttcctgaggatcaaggcagacaggaggaagaactagatagcagctttcactcaaacggaccagagcagcatgtggagtctctagaactattgcaagaataattcaggaaagccaagagaacccacagaccctcttaaggaagtggattgctcctgcaggacctgggagacaccccaattaccgtgagtgcccaaactgtgggagtgagaaagggagattatctggccctgaatacacaccctcactggggaacctgaagtctagatcacaggagaagattctgacaatacctggagctgagtcaatttagagagccgagggaaatacgggggtaggggaagcagtgggaaaagctctgtgggctctctgggttcccagcgaagccatttctgagttgtctcacagggttacctggagagggctgccagaggaactgggaaaaggccacagagagaaggaaacctccagctgaactttgcaacaattccaaccaaacaggaagtctcctggccagaactcaggggagggcgccaatccagtgtgcagactccacagacagggaagcctaaaagccctacttgctttcgcagctgggggctggtagcctggggaaagttcttggccctgctcgcagactgcgtggaaacagactcagtgctgttgtggggtggggcacggtgagagtgagaccagccttctgggtttcatgggagctgggtgaggcctgtgacttccagctttcccccacttctctgacaacctgcatgatacagcaaaggcagctacaattctcctaggagcataactccattgacctgggaacctcactcccatcccccacagcagccgtagcaagatctgcccaaagagagtctgagctcagacatgcctagccctgccctcgcctgatggtccttccctacccaccctggtagctgaagacaaagggcatatacgctttggagttcgaaggccccacggccccacccaccacctgatcctccccatactaccacagctgatgctgtcttgaaagtgtcacctcccagcaggaggccaatcagcacaaaaatagtgcattaaacaaccaaaactaaggaccctcacagagtccatatcgccccactggcacctccaccagagcaggtgctggtatccacaaaaagagacccacagatggttcacatcacagaactctgtgcagacaacctccagtactagacaggaacctggtagacctgctgggtggctagatcctgaagggagacaagaatcactacagtatggctctcaggaaatcacatccctaggaaaagggggagagtactacgtcaaggtaacactttgtgggataaaagaatctgaacaacagccttgaccactagaccttccctctgacagagcctacccaaatgagaaggaaccagaaaagcaactctggtaatatgacaaaacaagttctttaacaccccccaaaaaatcacactagctcatcagcagtggatccaaaccaagaaatccccaatctgcctgaaaaaggtgtcagcgaaactaagcttcataaatgaaggaaagaccgtctttttcagacaaacaaatgctgagagaatttgccactaccaagccagccctacaagaactgctaaaaggagctctatatcttgaaacaaatcctggaaacacatcaaaataaaacctctttaaagcataaatctcataggacctataaaacaaaaatacaaataaaaagcaaaaaaaccaaggtatgcaggcaacaaatagcacaatgaatggaatagtacctcacatctcaaaactaatgttgaatttaaatggcctaaatgttccatttaaaagatacagaatcacagaatgggtaagaattcaccaacaaactatctgtggctttcaagagactcacctaacacataaggattcacataaacttaagataaaggggtggaaaaagacattccatgcaagtggacaccaaaagcaagcaggagcagctattctcatatcagacaaaacaaactttaaagcaacagcagtttaaaaacacaaagagacacattatataatgataaaaggccttattcaacaggaaaatattacaatcctaaatacatgtgcacctaatactggaggtcccaaatttataaaacaattactaccagacctaagaaatgagacagacagcaacataataatagtggggggcttcaatattccactaacagcactagacaggtcatcaagacagaaagccaataaagaaacaatagatttaaactataccctggaacaaatggacttaacagatatttacagaacattctacccaacaaccacagaatatacattctattcatcagcacatgaaattttcttcaagatagaccatatgataggccaccaaacaagcctcaataactttaagaaaactgaaattatatcaagcactctctcggaccacagtggaataaaactggaaatcaactcccaacggaaccttcaaaaccatgcaaatacatggaaattaaataacctgcccttgaatgatcattgggtcaacaatgaaatcaaggtggaaatttaaaaattctttgaactgaatgacaacagtgaacaacctatcaaaacctccgggatacagcaaaggcactgctaagaggaaaattcatagccctaaatgtctatattgaaaaatctgaaagagcacagacaatctaaggtcacaccacaggaactacagaaacaagaaaaaaacaaacccaaacccagcagaagaaaggaaataaccaagatcagagcagaactaaataaaattgaaacaaaaatattcaaaagataaataaaaaagctggttctttgaaaagataaataaaattgatagaccattagcaagattaaccaagaaaagaagagagaaaatccaaataagctcaattagaaacgaaatgggagaaattacaactgacaccacagaaatacaaaagatcattcaaggctactatgaacacctttacatgcataaactagaaaacctagaggagatggataaattcctggaatgatacaaccctcctagcttaaatcaggaagaattagatagcatgagcagaccaataacaacagcgagattgaaatggtaatttaaaaattaccaaccaaaaaaagtccagggccagatggattcacagctgaattctatcagacattcaaagaagagttggtaccatcctattgacactattccacaagataaagagagaatcctccctaaatcattctatgaatccagtatcaccctaataccaaaaccaagaaagaatgtaaccaaaaaagaaaactacagaccaacatccctgatgtacatagatgcaaaaatccttaacaaaatactagctaactgaatccaatgacatttcaaaaggataattcaccatgatcaagtgggctccataccagggatgcagggatgatttaacatacgcaagtgaataaatgtgatacaccacataaacagagttaaaaacaaaaatcacatgattatctcaatagatgcagaaaaagcattcaacaaaatctagtatccctttatgattaaaactctcagcaaaatcggcatgcaagggacatgcctcaatgtaataaaagccatctctgacaaacccacagccagcataatactgaatggggaaaagtttaaaacattccctctgagaactggaacaagacaaggatgccactctcaccacttccctttaacatagtactgggagtcctagccacagcaatcagatgagagaaagaaataaagggcatccacatcagtaaagaggaagtcaaactgtcactgtttgctgatgatatgactgtatacctagaaaaccctaaagactcctccaaaaagctcctagaactgaaaaaagaattcagcaaagtttctggatacaaaattaatgcacacaaatcagtagctctcctatataccaacagcaaccaagctgaaaatcagatcaagaactcaacccattttacaatagctgcaaacaaatgaaatacttaggaatatacctaaccaagaatgtaaaagacctctacaaggaaaactacaaaacagtgctgaaagaaatcatagatgacacaaatggaaacacattccatgctcatggatgggtagaatcaatattgtgaaaatgaccgtactgccaaaagcaatctacaaattcaatgaaattcccatcaaaatactagcatcattcttcacagaactagaaaaaacaatcctaagactcatatgaaacaaaaaaagagcccacatagccaaagcaagactaagcaaaaaggacaagtctggaggcatcacattacctgatttcaaactatactataaggtcacagtcaccaaaacagcatggcactggtataaaaataggcacacagaacaatggaacagaatagaaaacccagaaataaacccaaatacttatctttgacaaagcaaacaaatacataaagtgggaaaaggacaccctattcaactaatggtgctgggataattggcaagccacatgtaggaagatgaaactggattctcatctctcaccttacacaaaaatcaactcaagatggatcaaggacttaaatctaagacctgaaactgtaaaaattctagaagataaaatcagaaaaccccttctacaccttggcttaggcaaggatttcatgaccaagaacccaaaagcaaattcaataaaaacaaagataaatagctgggacttaattaaactaaagagcttttgcacagcaaaagcaacagtcagcagagtaaagagacaactcacagagtgggagaaaatcttcacaatctatacatctgacaaagaacaagtatccagaatctacagcaaactcaaacaaattaacaagaaaacacaatcccatcaaaaagtgggctaaggacatgaatagaaaattctcaaaagaagatacacaaatggccaacaaacacatgaaaaaatgctcaacatcactatgatcagggaaatgaaaatcaaaaccacaatgtgataccaccttactcctgcaagaatggctgtaataaaaaaaatcaaaaaataatatatgttggtgtggatgcagtgaacagggaacacttctacactgctggtgggaatgtaaactagtacagccactatggaaaacagtgtggagattccttaaagaactaaaagtagaactaccatttgatccagcaatcccactactgggtatgtacccagagaaaaatcagccattatacaaaaaagatatttgcacatgcatgtttatagcagcacaattcgcaactgcaaaaatgtggaaccaacccaaatgcccatcaatgagtggataaagaaactgtggtttatacatacaatgcaatactactcagccataaaaaaggaatgaattaatggcattcgcagcaacatggatgagaatggagactgctattctaagtgaagtaactcaggaatggaaaaccaaaattgtatgttctcactcataagtggagctaaactatgaggatgcaaaggcataagaatgacacaatggactttggggattctgcgggaaagggtgggaaggggatgagggaaaaaagactacaaattgagtgcagtgtatactgctcaggtgatgggtgcactaaaatctcacaaatcatcgctaaagaacttactcatataaccaaacaccacctgttccccaataacctatggaaataaaaaaattaaaaataaattaaaaacaaattaaatttaacagagtttaattgagcaaagaacaattcatgaatcaggcagcctcctgagccagaataggctcagggagactccagtacaaccacatggtggaagaagatttatggacagaaaaaagaaagtggcatacagaaaacaaaagtgaggtaaagaaatggccaggttgggtacagcctagcatttgccttatttgaacatggtttgaacaattggccccctttaactggacaaaactcagtggttggcacaagagtaggttacagtctgtttacacctccatttaggttatagttcattatgtagagaaacttttaagacaacgttaaaatatgtaaggaggcaactttaggttaaacttcatttaactgctgtgtgggatggcatttgtgcctttgggctgtggggttgaatgaccagctgctttttccagactggctcccacacctcttaggtcccagaggctgataatggtataattaatgggcatttgagaatagaggcaaggatgtggtcctcaggacttctcagtcccagcataggctatctgtgttcctgcccctccccttgtaacagaggctcctctgtccctgtctgatgagttccttcatttctgcttcctcctcagcctctgctgcaggggtgggaacacaggagacactggcatggaggctgcccagcaggatgacacccagaagacgtcacaatgcacactgctgggagcccgatctgaatgaacacagggtcgtctcatcttccaggagggaatgattcccaggagctgaccatggtactaagccaggtaagcaggcctcaggggacaggccagcgctgcatggacatctgggtgatgttcaagcccctcagttaggtgtttcccctagtttggcctagagaagtgaatggcaacctccctgtgatttctaggctctcctcctggacagcaccaaaaatgtgccttcaagggccccaggacagccttactgtgggccaagtgcagtgaaactgggagttgcctcgagaagacactccccaagagattgccaaagagaatggtgcctatttccatgactcaaagggcttcctctgtcctccaaagagcggtgtttggagcgtagaggtgaaatgttcagaggatcagggaccatctgccctagacccatagggacagagaagggtgagcaattactgcagcaccccagggagggtcaagttcttgtaacaccacctccgccggccagttacagggatctgggcatgctaaggtcagttctttcttattaagagtaagcccatgggtcttcacactggactcgtggaggctgagatgttgtgagtccctacacaggcttccctcctgtgccatggcctgcctgcctcctgacctttgcctattccctctgttctagatgtaggcaaggagaccaagagctgcacctggatgatctgggacatgttctgtggactggagtcaggagggccccaaagtggccccagcaaaggcaacagaggaggtagagcatggtgacacgttgcaaagtgcaaaggcgctggccctgggagaggcaactgagaaagtagaggttgctgagaagacggaaggtacagagtggggcaacatgtcagacaatccctactggaggagagttgtgggcatcagtgggatcatcctgatcatgctcaaggtccttggcgtcatctactttgcctgaagcagctgggctggggccgtccaggaggaggcagagctgctgcttctccaggatcatcatgaacagggacaaagcgtttcctactgggagacccatgggcctgggaccaaggattacattaataaaaatgttcccttggtgtcatgcatcaagggctaccagcagcagcacacacatgccgtgtggcaggacagagcaaagtccattcgccattacagaaagtatgcaaatgagaacatctgttcctttacaaaatgagtcattttctccaaatggctgcactgcataaacactttcactttaaatttaattttggcttttcatctctatatatatttggaatttttgcttgtgtttacttcactgtcaccaattctttcatgtacccaacttccattgcttggttctctccttattttccaaggtatgtccctgctggccaagatgccgagttgtggaagccccaccccacccctgcaagggaatctcacctgtaggtgctctccagcactgatgaccacacaggccatggggaaacaggtgccagggatggaagctttggcccctgcctgaacctcagtgggactgaggcaggctctgctttaatagaacaggcctccccaccactcaactctgtttagcttctgctgtgctgcatcccttgagggcagattaagaagaaactccctccaggccagctctccccagtcacactcacagcctgcctggcatcgtgacattcttgggagttggccccctaggttagatccacttgagctatcagatagaggacactcctcagccgtgtttccataggggttccctaaacctctccttcacttttcttcttcccagtccaaaataaatgatttgtgtctttaggaaaagttccaggtgccttgaagttatttcatcatgagaatcacgctctgaaggtatattcacatgaccagccctcatcctttctctaatccttcagctgacacttttgagtgtctaatatgtgccagccaccatgtcgagctcgaagaaaataaccgtgaacaaagcacaggggaacttctctctggagtatatggtgtatggtggaaaataagcaatcacagcaatagccagcatttcatgtgtcctgctgtcttcaggcaagcccagggtaagtgcattatcatattcaagccacagaaccacccttgtggagggacaagaattagccacgtttcacaggatgcagtgtgtgcactgcaagagaatccagcagaaacctccatctagcctcagagtcagggaaagagggaatcagttggatggataacagaagggacatgtgtgagaagacatgcagcaagagtacaaggtatgtttgaggatgctgagatacggcatgtgcatggagaacagtgggagggagggagtcggaagcctgaccagcaggccttgtatgctttgggggcctacgtccctggaagtgtaggcaaggaagtgataggatcagatttgcttcctgctgctgggaagataaaagtgagacaggaacacccaccaggacactgctagagcaaagcaggcaagttggtggcagagaggtaaagaggtggagacctttggagggaggggccagggatgactctctggctggagcaggtgaatgaagggggcacctgcttcattcaatgaaggtgaatgaagagtaagtgcaggtatggggaaaagatgaactcatttctgatatgtagaatttgagctgcatgaagatgtttattgccatgttgataatattaagtcttctaatccatgaacatgggatgtctttccatatatttaagtcttcaacatctttcaacactattttgttttcagtgtacaaatctcacactccttttgctaaatttatttctgagtattttattctttttgatgttattgtaaatgaaactgttttctcaattttgtttttggatggttcattgctagtatttgggaatacaattaatttttgtatattgattttgtatcctgcaaccatgttgaacttattcattagttctaatcatttttaagtgtacttccttgggagttttcttatacaaaatcatgtaatctgtgaatacagaatttacctttatttatttgcaatctgtatgctctttctttttcttgcctaactgcctaactagaacctccagtacaatgctgtatagagaggtcttgtttctgatatcaggggaaagcaatcaggttttgctattaaatataatgtcagctgagtttttgcagatgttctttattatgttgaggaaactaccctcttttcctagttttctgagagtttgtttttcatcatgaatgggtgttgaactttgtggaatgctttttctgcatctattaagatgattatgtgacttttgtcctttattctacctatatcttatattacattaattgattttcatatgctaaaccaaccttgcattcctggggtaaatcccagctggtcatgctgtataatgctttttatatgctgctgaatttggtttgctaatatttggttgtgtctttgtttctataatcataacaaatattggtctgcagttttcttttgatatctttgagtggtttttgtttgtttggctggtgtgcagtggtgtgatctcaggtcactgcagccttgacctcccatgctcaggtgattctcctgcttcagcctcccaagtaactgggactacaggcacgcaccaccacaccaggctaattttgtgttttttgtagagacattggaatgacaggcatgagtcatcgtgcccagctgatatctttggttttggtatcagggtagtattacactcatagaatgagttgggagatatttcttcctcttctattttttggaacagtttgtgaaagattggtattaattcttgcctggagacatttaagggtagatgttaagttgaacataagaatccagaactcaggagagaggctggggctggagtcccagatctgggggagacaggggagagagatcaggcccagctcagaagggaacctggtagagaaagcccaaagccaggcagatgagattgcacagggaaagtgggagaagagagagcctagaacagaggcatgagaagcatcagcaccactagccatgtaaagaaagagggttctacagaggagaccaagagcacagggtcttgcagcagggagtttgatgatcttggccagagcctgtggaaggggtagagccagcctgctgtgttaaggcaggactggaacatgaggaaatggacatgaggaaatgtttcctgaaggagaaaaggtttcctcttagggggccttttttaaagttttattttgagacagagtctcactctgtcacccaggctggagtgcagtggcatgatctcagctcactgcaacctccacctcctaggcttaagtgattatcgtgcttcagtctcccaagtagctgggaatacaggcgtgcaccatcatgtccagctaatttttgtatttttagtagagagggggttttgtcatgttggccaggctggtcttgaactcctggccttgagtgatctgcccacctcagcctcccaaagtgctggaattacaggaatgagccactgcacccggccctcttaggggcagcttttttgagaatggggatgaacctgaaaccccagctgggcccagctgcctgtcccttccacaacaagaggccctacttggattcatcctgtgattccaaggacaataacttccctgtgtttcttctgggaaagtgagggcccctggggctcactgaaaggactgcaagaaggggctccctttgagattctggctttgctgaaaggtttattctgggaggagtgggcacctcacaggaaatatgactgccaaggggtgatgtgaatgagggaaaccttcgagagagagagagcctcagaaagctcctggagaaagagtaaggctccagctcagacccagatgaaagggcccagcccggaagctgagttctgctctagcatctcctccaacagaggccaggacaggctgcttctcccccgaaacgaggagatccattgcctcactagaccatgcagagatgagtaggaggagattaaggagctctcccagtcactccccaacctcagccccatgccccatagccccctgaagctgggcttctcccctcctccacctctcagcccacctctctctccttgcctaagctcccagcctgcttgtcaccttcactgcagggaaggagcccagatgaaggcacaggcagaagagggctgccctgggggccacatacacccaaagggagagaatggagggtgggatgggcttcaggccaacctgggggcgtgcttgagtgacttccttgctttggagaagaatgcggctgtttggggtaagacgttaacgaggaaaccagaatctacccctgtcctgagcactcatccctgggggagcctctatgactgagtcaccttctccacgaagaacctgcatggggtttcacctatcaccttccttcccatcacccagggtggggaagggacagacctggctgagcagagccacacccagccacaccccaggggtcaatcactggatcttctgaaacctgggtggtgcctggcgcatctgggttccttccttccccagcccaagtccctgcccccagccttgtctctggagggctcagccctactctctaccttctgaggggaactcttggccccaggagagagagcacaactccaaggccacctcccacccattccccgcactgggttcagcctgtgccacccagacccggtgcttctgggcctcgcatttcccctctggcaggagagcaagaaaagatgtgactgtgctccaggaacagaaagtgccattcggacccgagataaagagacttagcacatttattcactcacagaggtgaatgaagggctcagggtttgaactcgatgacactgatggcgatccgggctgcccgctgtaaggcttcggccacttgaggcttttcgtaagtctccacctccatggcacggaaagtgggcacgtgcgtctgcagggccttgcggccctcgggggcctctgccagcatggtaagggccttggtggcattcaggcgcgctatggtcatgggggagtgcagcagctccaggagcaggccgatggcttgtgcctccagggccgcatacttccctgcaggccaccaacacaaggcgttccaaacagcccaaggggccctcttctcaccccctctcaccctagccctctcctgaccctcctccttgtgcagtctcaaggggtttatgcctggtttatgccccaccaacatgccctcaccctcagggctcttgcaccttcgctgagtccggcctgggcctggcctcttcatctcctgcctttccggcctcaactggctcctctccatccaccctcgtatcctgcccaggagttcaagaccagcctgggcaacataatgagattccatctctacaaaaatttaaaaattatccagatgtagtgacaggtgcctacagtcccagctactcaggagactgagcggggaggatcactagagcctgggagtttgaggctgcagtgatcgtgacatcgtactctagcctgggtgacacactgagacactggctctttaaaaaaagtaagcccagctgggcgcggtggctcacgcctgtaatcccagcactttgggaggccgaggctggtggatcacgaggtcaggagattgtgaccatcctggctaacacagtgaaaccccgtctctattaaaaatacaaaaaattagccgggcatggtggcaggcgcctgtagtcccagctactcaggaggctgaggcaggagaatgcgtgaacctgggaggcggagcttgcagtgagccaagatggtgccactgcactccagcctgggcgacagagcgagactccatctcaaaaaaaaaaaaaaagtaaacccaatagttcatatatgttgccaatatttcttgagcacctactctgcacaaaacacacatggttcctgagagatgccctcctcaaccattcgctgcccctttctgctgtccttgccggccctatgctcctgcagtgcccagtggactctcccctttgctggtggaacctctcagcctgggccctgccaactcccattgtccttgggattgatcccaagcccttcccagaggcgacttgtcccctgtgtttgccccacccatgctgggcttctcctccacatccctcatcactgcctcccagggcctggcacgtggcaggggcttcaggaccctcagctggagtgccagcttgggaataagtggcctcatctccctgggtctcagcctcttgtgtctcgagccccgtggccctccaagcactcctacagaaagcctggaccgagaaggacactgggctgaggctgccccaagataaacacgcagggggagcccctgccaccgtgcagtcagcatcctgactacaccagtaaaaggaggggctgtggactccaagaaagccccaacctctcccatctgcatacctcaagcagcattagggtcaggtgtgcagggcctgggaggacctgtctttgggaggctgattgcaaatccaagcccagatggtcctccatggaactcaaaggaagcacagggccccaggctggtgggtgtgtaggggccagagggaaagtcaaatgctttcaggggtcctgggagtgccacgccccagtctgccaggtgtggaaacagcccagggttcttccatgagcccagggttgggtgacttagaggggaagcctgactggctgggagtcccaaggtagggggctcgggggagataattctgaatttgccccctcctccagtttaagaaaaataattaggatgaataaacaccatagagtcaagggctccagggtttgcttagacctcagggtaacagaatcatggatggcaaactaatcaacccttgagtcacagctcacaaggggcctgggtgggaggcgggaattccaggcccagggaacagactggtgcgaaggcacagaggtcctaatgtgagtgactggtgaggggccactgtgctggggagaagagggagggctgggccttggacccaaccttgaaaggacatcagtgataggccaaggggaggttttttttttttttgcaaagtgtggagtttgggggacgatacccagcccctgagtacagaaagctcatcacggctgctagcctgctagggtctccctccctgcggcaccccccaccgcctcaccttcagtgatcactgtggcgaacatcagggcaccggcagcgttagacttcacatgctccactgggtctttcagcagatggaccaggatggggatgacgtcaaaatgacacacctgtttcttgccctctcgagatatgctggggcagagagggaacagagaggggctctgcttggaagggagaagaggcgcaaggcccaggagtgccccagggagacacaaaagaaataattgtgtgggggctaccccaggtagtcccaggactggtccccatgatccaggactggtcatggcagggatgctgggctgcagaggagcattggtgtgaacgcggcccactgccagtgaagaccacggggtgacagggcctcactctgagccagcacacagaaaagaaatagggcatgttctccgtggccccaaaatggggaacagcaggacccaggggtgtcaaccacagggagacctgttttgactttgcctaagagccagagctgacagtgatgggccaagctgcccccaacagcagcagctgccgggcactgggcaactgcagctaaggactcagaccaggtaacttttaggccacttactctggcactgaatgaagttgtggaaatgaggatgatgaactccccaaaagtttcctgagagagggtcaattctgtcccctaaaaagaaagggctccctgggccaggaaacactgttcacaagccccacaggaatgccacagtgcaaagacccctgtgtcacttagtttaatcaacctttcccaaatgtagccaccaaagaaccctcatttttgtagagctcttaatgacctcaaagacacaggtgttccctgggaacacagattgggaaatgaggttggccagccactagctgtgacactgggagcctttcagggcagtgggcctcaaccccgaagcccatgatcaaagttgcagagtcctgggccccacatgcagggattccctgattcgttcacacagcaagacactgagacaagagcgatgcagggattccccgatttgttcacaagagtggggacaagagcagggtttctccagctcagtgttctttagggccagataattctcaactgggagccaaagctcccccgctgcaaaccctgggtttagggcagcaaacagaggaaagccctgtcctcaggagctcccctcggggatgacacacaaagtaacggcagggatggtggtcacagtggacatgggaggacaggggacagcagggaggttacagtttcagagagagagagctctctcctggaaagccactctcatggtcccacagaaaggggacctctgagcagacctaagaatgatggggctgggacagggcccaggaatctgcattttcacaaacctcccggtggcttgggtccggggccccacttgcagaaatactggcctgagcctctagtgagactctcagaagagaagccaggacttagggaaggcaagagggtctccactaaagagacatagccacagctaaggcagagactctggggttcggtgaccagcctgtcctcgtgaaaaggggcccagtgtgagaacacacaccgcaccctgccccctgcagctttgaggctttgggctccctcagtttccaggccaggatgtagactgtgatcctgtgtgacctggtgtgagacacaagacactgcctccttttctcacctgtgaaggcagacatcacctccctggagggtcgcctaaatgtgaggtttgtagacaacgcctggcacacaggaggcactcagtgaccgctgggtgtcatgatcatcaccagtgcatctcctgtgctggccttcctcatggggagggggtgcacaatcatctggctttgtccaggctgaggggtttcctgggatacagtacactcccaggccaacgggatggtggtcaccctaggggagaaggtcatcctctgtcccagctccctcctgcccctgggcacaagcaggcaaggggaagcaggcccagggtggccgcccttgagctctggaccagtccagctcaggtgccttctcccagccttggtagaaacccagcctaggccaggcctcacctgacattaaggagcgcacgggcggccttgctgcggatgttctggttggcgctgaggagcttctgcttcaggacaagcaccacattgctgcccagggcctcggtggcatcctcctgcaggcagaggaccagtgtgtccaggatgaactcctggaactcctcctcctccacctccacctgcagcttccataccagtgaggaaatcagacctttgctgatgatctcttgggcccctacaaggcaggaaagggcactgagggcgggctggccacacacccacccacccatgccagttggcctgcagggctcaaggagggtcttgcagaaccagtgggtgggtttgacaaaaggacttgcaagtgccacccccacacacacgtcccgcctggccaggggcctgagcgaccagcaggcagctgcagtgacagccatgtcaggggctaagggcggaggctcagagaacccaggaaggaccagtcttttgtcgcctgtgtctcagggggcatctaccatagcaagcgcacagcagctggagaggcagtaagccacccctcggagagctgacagctcactcctgcagggcccaggcacaccaggagacctccactcttccctccccctgccccagagttggggagccagccaagcccccgcttcccatccaccaaaatatttcaaagctgctggagaccccacactggtctgaccagccctggagaagagcttggttttgactctgagacagaagacctagagtgtaggccagtgtcacactcaccaaaaagagctgtgccccaactaaaggtgacgggaagccataggctctcgtcttcaagggacctggggctctgtgggaagggggctccacatggcacagctggggtgcaggtactgggagaagcacaatgaggcaaggctcccccataaacaggccccacctggctcctcccagctcccttccctcctgaggaatgtcagcatgtggttgcctagagaacccagcacgagtggcatcctgagcccaggacggtgggcagaacagccctcctgagtcactgagatgagaagcacagggaatgtgcacagtgcccttccctacggcacgcagctgccctcgccactgccctgcagcccactgcctactgcaaagccatctacagcccccagggaggtggccaccagcagacacctctttcttccgccctccccagctaaaccctctaatttactctagagagagaaataaacaggttgattagcctaaaggtctccaagtgccaattagtaccagggatttcctctttgaagacatcaccccaaccttcttcccccactccctgaggacatcaaacagcaggtgcccagggtgatggggtagaaaggcggagcagggtgctgagtggctcttaccgccccccaccatgtctcataatgtccagcagctctccatgccccatcccccaggtcctctggtgtcaggtggcttccagtgcccctggccagcttctcactgtggtatcagatggagcagctagatctgccctgtttgttctcagggctctgaccacccaggaaaagtgggttcctgttgcttctactgtgttggccttttttatttaatatgcacagattgcaaaaaaaaaaaaaaaaaaaaaaaaaaaaagcctaggtctcatttaaaacatatcctttccaatctgtgtgaccttggacaagttacttaacctctctgagtctagtttccttatcactgaaacgggcctacctggcagggggttgtggatgaaaacgtgttccacgtgctgtggatttcttcatccatgtaagggtctgtccctgtgtgcccagaacatctgggcctagggtggcaagagtctcctgaattccaccaacactgagtcccagctacaagcaagggcctgctggaggctgaggagtaggatacaagacaaacgctgcacagcccaagccctgcagatcccatcagtgcagaaaccccccaaccctaccacccctcccgaggcctgatcctctctctcgcgcagctccctgctttgcccataccacacacctggcctcctgctcccgctctgcttcccctcaggttctgcccacggtctccctacccactcctggctatagattcaactcagtggtgacctggacggccctcttccagctcacagcagggaggcgacaatttgaccttctgttaattttgctggcagatggaaggacaaagttctgggatggggacacttgagcaaagacctgggggtaaggaagttgttaattttcaaatcagggctagattgtagcctcgtctcacctatctgagcttcccaggaaatccctgggacaggtgtcattgctgagtcaggatgggcacaagttaggggaggaatatagaaggagttgaggtcagaaaagtcaacattcaaggtgatcacctccattacccacctctccttggtgaggaaactgaggcccagagaggcaacttgaatacctaaggtcacacagcagatggtggcaaagccaggcgggaccctcagccccttgggttttgtttctcaggcatttgtcttgtacttctgctcctagaaatgcttagcacagggaccggggttcattttgagacagagggagaagattaaaaataaaacgcgtgccgggtgtgcctttctgctcgttcactttgcttcttttcagctaaaagaagagtctcgggcctggctatttataactaacccagatctgcgatggcttgctcaagtgggggtggggcacacagaccccagggaaacaatcggggaaatccacccaactgggcggcagcctgagcgtccgctgggggtggggggtggttgcagaagaggtaggacaggtggggcacagagaatcagccagatggggtggcaccagagcaggccaggctctgggccatccatggtttagagacaagcaacatatgcccaccccacccccgggaagtgggaaaactagtggaatagtcagctggggacaggtcactacagaacaggttgacatgtgtgtagaccaggaattccagggtcctaggggctctggaggtgcacaaagggaggccccggggaagctggttctcatggatgtggaggagagcccagaacagcagggctcaaatgtatgtgtttgtggggagtccccgatctggcctggctgatatgtaggggctaggatgggttcagtggttgatgagccaaagagatccaatgggattgaggggtcacggatgtccatggtgtggagccccagtggtggagtctgggtcattttctttgtggtggggcagggcgggtgctgacaccatgttgaggggccactcctcagccagctgtgcctgctgggttggggaggtgctgagtgggctcagtcaccaccatggcccccttcctctggctacagcaaagccccagctgttgtctcccagccaatgagggctcaggacagagcaccagcacccaggttctggtcgcagccacaccctttcctgttaggggactgcacatccacacatggcatctggggcccaccttgccgcaggtgacccacctgtccagctttagccttgcatggccctgtgccctgaactcctggcccactgggcctgcctttgctccaaggggtgcttctctgtcctcagctttctcggcttccaggtagctgggagcatggttaacagcttcttcctttaccacatgctctcttcccgtgcctctggtaccctccattctctggttcctgaccacctccccaactgctcctccatctttttggtaagcaccatctcttcctccagtggtccccaccctctccccttctctcatctccctgggtcctgataatgccccgccactgtctcctaacatgctcttggtctccctgccatctcacagccacagcagaccgtacactgaactcagcctcacagactgacttctgtgctcactcccacttcctctggactgactaactgatgtttttgttattttattatgtccagtaggacaactcacattgtctgtgggaccacgcctactgtaaacaggcaattaaaaacttctcctcctccttctcaaatttaaaagactaatgttaaaactctcgagcagttcttaggccaacgtccctgatcctactgccccaagctggcatctgtgcatgggcaacgaccctggccccagccacactggtcttctctgggttcttcctggcctcgtgctccttcatgtcctgcaccgtccccgccttggaactcacttccctcccaccctatgtcactggccacctccacgcctgctatggcctcattccaagcatctcttcctttgggaagctggcccaatgcccaatgctcccccactccacatgcccccagagccccagtgggtctcctcagatagcctcacatgactgtaaggcccaatcgttgtttgctttctgcccctgccctacaggcagagggtctgccagaaaagggccggtctgaatcctagaactgtgcctacaactataccctggtggaggaggctatctgtaagtgactgctgcatgaatacaatattggtttgatgccaggtgagatgtccctctcttactttgaggtcaagtcagggaggtgtcagccagccccagtggacccctccgcaggctagcctctgctctggaccactggaaagggccatctcactgttgcatgtgggcttacctctgcaaacaattcaactctgacccccagactctgcagtggaaacagcctctggctatcccaagacatgctaatatgcatttcctatatacattaaccctcagagccaccctctgaccacagtctgttacattcccttttgacagaagaggaaacagaggctcagccaggtagcacagctgccggtctctgtgtggtcctcctggcaagaggtccagcctgacacagcctggtggtgtggaaggcaagcacaaagggtagctagcccctcagccattggctgaattcccttggtcctcactggacacctccagtgagcactaagttcgcctccatgatgcccataacaaatatacgtcctgttcctgacagttgaggcagcaccctcacaggtggcccatgaccctgcaggtacgtaacgcaatggtctccatctcacagaagaggaaacattcctagggaggttatgggatgatgctgagatgccacagtgtccagctggcaaagccaggcacatgcccctgcccctccaccacagagctatgatggagagaccgctccatggacctctgccatggtcaggtccagggctgctgctcaaagaatggcatgatccacaccttacaaaggtgtgaggtgataaggaacgcgttagctgggaaggcatttgcactttgtcagggatgctctaggatacacaaagcttcagatttacaaagatggagaagagagacaggagcattcatgtcttggccctctggcttgagagtcttttaagcatggaactgagggactcctggccctgaggtccacagataggctttgaaattgaaaacagaattttgcagcctgggttcagctgcgttttgctgagggtctgatgctttccaccagcttcccaaaagcgccaatcagtggccttaactgaactggctctctcacgcttgtctgggctgggggccagctcctcggtccttctcccttccttccctcccaaggccacccttccgtgtgccaggattgccagggacgccaaagagcccctagacactgggcggtggcggcggggggcggcggcagagatgactaatgctccctcccatcgctgcacaaacctcaccggtgtaaatcgttagggtttgcataggcctttcacacgttctgaaggattggtgagacaatccaggagagcaggtgccactagccccactttgcaaacagaaaggctgggagaggtcagtcggttgcccaaggacgtagagctcacaagaggccgaactgggtttgaacccgagtggagagaaggcgagccgggactggctgcagtaaagagggccaggaccatggctgggctcaggcttggtttcccgggctgccagaggtggcccctggggctcggctaccaggcctcagcgcagcggagtcggtggaacgccggcgcggggagctcttgcgggactgcggcgcgcgcggagctgcgaccccgcccctgtccgtccccattgggctactggcccgtccgtcagctgcctgtgcccaatggacagagggccggcgctcgtggcggggcggaggtgcccggcgcgtggtgcccggcgggcgcgcggcacccccccgcccgcggttggcctggcaacgggctgcgctcgcggctccgccccctgccggcggcggcgcggcgcggggcgggcggacccgcggactggcggcgggcggcgggcggcgggcggcgggcggcgcgggagggcgggcggagggaaccaggccggccggagtgtgtgcgccgcccgcggtccggtcacgtccccgcgtgggcgccgctgcccgcgtcgtacggaacgagggcgccgcggccccgtgctcgccgccccgccccgccccgccctgcccggagcagctcggcagatgctctgtgctgcggcccggaggtgagtgagccgacccgcggccggccgcgcgccgctgagcctcaggggtcgggggcacggccggggcatccaccttgcccccacttgggactcttcccaggcctttgtgccccggatccgccaggacgcagcgtcagggatgcccctcaggggtgggggacaccaagggcggggacgcctgcgaggtgggcagggggcggcctctggtcgggcaggtgctgggggagggatgcgccgccaagccgatgaccccgcgggagggggcggttgaggacccgggagggtggacagagggcgccggggatgccgcgcggggccgccgggcgcccccaagcagcggctgatgcggagcccgggcgggccaggcgagctgcgggagcggcgctgaggcgggtctccctagggggaggatcagggaggggcggccggagccgatgcagggccttgcctgaaaccgaggagagggccccagaggcctgggcccgaggacctgggcccgcagacggacagctagcagttctcggtcactgctcttgcagcgagcaggttcctcacaggcatttagaggaagagatgagtatcgacctgctgcgattgtaatacgttcccggctcaatattttttcccttaaaaggcggtgggggtgtttgggggaggggagtgagggcctcagggctggcgctccgtatcctgcgggcgatccgagggggctctgcctttagggcggtgctgagccttcctgggtgatgatggcaggattcggcctaggccgagaatgggggctcctgttaactgagacaagaggatgatgccaagcgagaccagcgttccgcgtagtccgtgttggggtggagggacccgcctggtagagaggtctgtcttgcttggggagacagctgagcccctgaccggctcctttctgcccaagtgatttccctgccctggggattgagctctctggagaaggctccttggccaaattcaattaagcaaatatttattgagtggtcactcccccagagcttgacgctggggtgcaccgggtgggagtggactgggcctgccctcccaggactgattgaccaccgcataggggaaaacgtctctactcgaccaaccccgcttgagtgcaggtgcaggggcctcgggagggacctcagagtggtgtcctgggctggggggtcaggtgagctcgtgggcaacatgacatttgaactggagcttgaaggacatgggcacagctaagctgggcattgtgggcagagaggagagaatagaccgaggcacttgggcagttaggtctgatgggagcacttagcatgcctggggagtaggaggaggtatggcgggaaaggccggtgggggctgcacggggctgagggagctgggaagtggaatgaccccactgctggttaactgtggctatggtggagaccacggcttcctcatctgtaaaagcgaagcagttccatgaccccatgagctggggtgggcctggagaagagctagctttaaagactggggaaggctccttgcagtctgagactgtgcttccaggcacttctccctcgggcacagccagggcactgggtaaccacccaggcaacccccttgttaggattgagttgcctgtttcggggatgatgcttagctagtgactctgtgcctctgggatgtggatgtttgagagcagtaatcgtggcagcctgggagcatccatctacggggtgcagtgggggtgtggatggcctggcggtgcttggataaaatatgcgccttgagcaagcctcattctctaggaatgaggagatgctggcatctggtttaaaagtcttcctgtgtgttcctctaactgacgttgattttctgagacaggaggtgaataagacataatttctccccctcggaaattggtgtcactttcccccctaagtcagctccctcatttctggggatgtttttgctctccctctgaaggggctgtttgttactcatctttgtagtgtgcctaccctccccacccaacacacacttggctttggccaaggcccaggttgatgcagcgagaacagggcctgccctcgtggggtgtgcagtctgtgctgagcagggtgagctgctgtgctctgtgcctgtcgcctggactgttgcagggacctggcatgtgactgtgggtttgggacacagggaatggattcttccctctgtccccagcctctcagtccttttgttttctagaatctcaggaggaacctcagagacctggaggccccaccagagtggccagaacctggtgcaggagtatgggtggggtctcagtctggccctcaggagcttctagaacaattccaggaatttgcaggtaactggattgacttcacaagggctgcccagggcccccgcagagaggccagtgggacaggaatgctgaatatagcaattcaggaatgctgaatttagtcatcttgtgtgtgaacacatgtgtgcggcttcctcccctggaggcaaggaaggcagccctgtgctgtctgtcccacgctagcctcagaatacttaagacggtgtgtggtggcaaaggcactctcactgctgctgaccatggcaggtgcacgggcacactggaggaggcaggtcagcatgctgctctcccgaaccctccagcaaggaaacctggggtagccaagcctctgagcacctgtgagcactgtgcttggctggaaggagcacaaagcgaaatgaacagaggcgtcagtgcagatgccaagggtcagccccaggcagaatcccagagcagaggctatgctgcggcctgggcagaatgaagagggacgtgggagcacccagactgttgtggctccggggtggtgaggtgagcattccagtctaggtggcagaagacctggagtcaggtcctggtcccaccatcctaggtccagcccctttttctctgaacctcattatcctcatccatacccaaagccaagagtgccctgccctgtccccacaccagcccctgccacacattttggccctttcgtgcgaacaccgccaggggaggcgcttcacaggattgaaccaacagggaccgcttgacagatcctagagcacataggaggagacatcagccctctggactgagccggaggagcagaacctcacgcgattcatccattcatttgttcagctaacatttaccagcgcctgctgcatgccaggcactgtgccaggtgcaggggtacagcagggacgtagcatccactcacagtgctcacaccagacgggcaggggttgacagtaacacatgttactaagtgctgcactgtggagaacactaaagcagaaggtgggggacacgagatgggggtgggggactgacacagtgccatgcagaagtgctgggtgagtggtgtggctgagcaggggagagacagcaggtgcaaaggcgctgagcagacactccctggcccctggaggccccaccagagtggctggaacctggtgcaggagtgtgggtggggtgtcagggccaggtcctgcaggactcagtgggccccaatgaggcaggaagaccttggcagggttggagcagagaagagactggagctgccctcccaggaggagctaatctacactttgaaaagatctctctgctgaggtgggaaaataggctagggtggggtaaggctgggggccatgaggggctactgcaacatcccaggcagagaggctgctgacccaggggtgggagctctggaggccctgagaaatgcaggtgggagatttgtttttttaaagctgcagcttttaaaggacagctgcagttttggtctgaaccagtagaaagatggagctggtattggctgagaagcaagatacagaaaaacccattctggagaggtggggaattaggaggtgggtctgagacctggagagccattgatgggcacatgtggccagagggagagcaaggctggaggtggcaacctggagcccctggcactgaggtgtgtggcaggccggggaccacgtgaggtcacttagggatcaagggtaggtaggatcagaagaggctgagctgggctcctgggcctccactgtggggaggatgagttgagaagcatcgagaaagagagattgaggattgacgggcaagtgaggtggaagcacagtcacagtggcgcctcgggaggctggagaagagcgggtcccagagagcaggtcccctgtgtcaagcaggcagggcatgcccagggactgagcaatgcaggcacagctggccacatgattttgggggcccccatttgaaaattattaagggcctgacatgatggcgcacacctgtaatcctatactatgggagactgaggtaggaggatcacttgaagtcaggagtttgagaccagcctgagcaacatgtaagagcctgtctctacaaaagtaaaactaaaattatgcattccagaacagcaacagcagagcattaaaactgtatggatgcccaagtgagtgcccaggaagctggctggtcacagggacctcaaggataatattggggatgtagtggcccctgtggagaaggaaggcctggagggtgggcccgcaacctgcctgctgcccagtccccacagcatttctcctcccttccctgagtgggcgggtgggttgcgttggactttcagggccgctggagtcagtcacacccagcctgtgagcttcaccttggcaccatggcccagggaacccaaagtgaaaactgcagcaggcaattgcctgctgcaattcttcactaaatgtcttgcttcttgccccttggtctgtggacccttgggcaagaggcagcaggaggcacatcttgaggttgaggtttagatggtcccatcagcaggccctggacctacatggccacagcttcacacagcaatggcttctttgcgttcatctcttttccaaaggaagctgccacatcacagagttttgagttatttgcttctaaattaaggtgtaactctcttttagagacgtccctggagaatccatcaaaaagtgctaagaagcgagactgttaaaagccacagtgcagggaggggccttacacatagtgtcaagcccgggggtgttccttctagcagcctccaaccagaaacacaccccgtccccgagggctcagccaggcctctcatggccatgggggaccgtggttgtggttagagcaaacctttcaggagacccttggcccctgggatggagagctgccaggacagaggtccctttgtgaggtctgcccctgtgagtcacggaggccaaggtcctttgtgaggtctgcccctgtgaggtctgctcctttgtgaggtctgcccctgtgagtcatggaggccaaggtcctctgaggtgtggagagtggacctcatgtgcccagtgccttagtaggtctgggcagccccgcatctgggcagcatggtccctctcaccctggttggtcataggaagggtggctgaggaggaggctgtgctggaggctggcatggcagtgagggctggctcttaggctgtggccctgctccagacagggctggtggggcctctatgtagaacagcgccatgttcctgaccatgtttcctatgccctttcctgctgctatttttttccccttagcactcgccacagcgtgacctgctccctatttgattcattcatcgtatgtgtttgtgtaagctccatgagggcagggacgttgcggagtcaccattgagaatcgccacccagggagtcgctgtggagggactgaatattcgcagacagtcatgcctcagtggccctgtccagccccttttgccctagggctgagctgtgtgctcgtgcgctgcagaacccctgctccagctcaaccctctgctcctaagaggttgtacctttgggtccccagagatgtgtctctgggcctcaggtttggccaccaaacacaaaccaccctcaggtggatgctaccagctgggccccgtcaggcccaactgtgggttactctcaagccagaggcaggtggacagatgcctcgggctgacgccgggccactcagtgatgcaatgtgactcagtggggcctttgtcagacacggggattcacagagtgatgaccttcagaggcatgtctatggaaaactgtcctaaggggatgagccaagaccctgaaggtagtaaaggaacatgatgatggtagagtggcctttccaggtggcccctgtgccccaagatcaaggagtggcctctcaggccagtagaggagctcagggcaggggaaggcaccaggcctgggtagaagtccagctctgcctgtgatggtgaccctgcgaatgctttccactctctgggccttccttgcctttgagttggaagctctgggctgggtcaagtgtacagatagtttccttccttatctcaactctggagtgaccgtccaaagcatgctgtgctgaagaggattctaaggctgtgctgcagcccagagggaaagagtcatggtcgattagtgatgtctgcagcgggcacgggaggcaggatttagatgagcttgccagtgactggtgaacctcaccactgtaccccctcctatctagcagctttaacccaccctatctctccttacatgccccttccttagtgacactgatgctaaccccttattgggaaggactggcctccgtcttcctgagtcccatgagcagctcaggtcattgcttgctgactgtctcttctctcatttgatgcctcactccctgtagtgacctcagggtccaaccccatgcttcgttcatggcagcctctttctgtacactgaagaatgaataagtgaatgagtggtagagactcaaccactctacaaggccgggagcctcctcttggatgtacacctgatgttgatctctgttccagcaaggagcccctagaagccttcttggaattgggaggctggatggccacggaaacaaggtgctaaaccgtgtggtttcagctccaggtgttgcaggagtggggtcagcaagggaggagggggcaaggtgactaaggagggctgaggcatgtaaagtaccaggctctgtgtttgtggggcccggtggtcctgtctgaccttggctatggagcagctaatcaggcttccccagaggcaaagctgggaaaaccttccaagctgccaagaggggccttctgaagacccttctgactatgggtgggagaacttggcacctacagccttcaccctgaccccagcaggccctgaccccctgtgaactggtggtacctcacccctactcctcttgcacccccacactagtggccctacccctaactgtggccaggccaggggaggagcaactccaccatgagggcttggccctcatgcctcctcctgcccagctctgcatggcatgtccctctggccttagctgccccagctgcatgtggcctcaggccagccccacccagccctcttgcttcctgtggccctgtagagtggctaccaggacccctgctggtgagggcgggtgcgggtggcctgtctccgagctgggctttcctccagcatggtcaccccctcacccgctcagttacctctgatatgctgtgcaaacatatttctcgatgaaatgctgggaagaaaaataattagagtgttgcctccattatccaatttcggattaatcaaactctctttgtcctcggccaaaatctattcatttcccttaaacactgggccagtgccaggcattgatttcctctatgataacaccacgcacgcaagcacagccatgcccagccttgccccaccccgtggctgggacacagaggcactggtggggctgcccttgtccccccaacactgcccacctcctccaaggagtctcctggccacactgacacccccatctctgtcgtggctcctggagtgcttggcctcagtctccagtgtgtttgtcttgccacgctggctgttctggggctctccctcctcccaggatggtgtggaatggatagaggaggtgtggagggtgtggccactgcggtccccagggaccacagggaatgggctgcagccccaggctctgggtgggccagggtttgggggattatccccatcactggcacaggaagaaggccaagggggagggccagggcttctaagggggctgaggggccatgcaatgtatgtggggtgggagcacacttgcaggggtagcaacagaagcccagccccaaagggcttacaagatgaggggacatcctggctcccgggcctgagggcttagtagtggggcagcatcaggatcggccaagtccaggtgggcgggggctgtgcgtctacccgtgtccacccagggaaggccacgggcctttccagaagacctcccagaagtccccaactatcccctccgtgagccacgttgaccgattcctcactcagtcactacgagggcctgggattgatttattggcacctgcttggtgctaggtccttgtgggcacatgggatacatcaatgaacaaacagaccaacagtccctgccctatggcacagtgggaaagaggtgggcgataaacactctaagtaaattatacagtgtgctagaaagggaccatgcttggggcaaggcagcacacgtggtgtggctgtgtgcgaatatgggggtcattttccatcgtaaataggatgggcagggaggcctcctaaggaagggacatctgagccattggatggggagagggcgcggaagcgaagtccacttggctttctggacaaagagttttccaggaggaaggaacagccagtgcacaggccctgagttaagagtgagggatggtgctagagaggcagctagaggcagcatggcaggagtgggggagggggagcatgggcgtgggagtcagagaggccaggcattgcacagccctggtgccctggctggactttgactcggggtctgcccatgtcaagcaagcgtcgggagcaaacatgagaaggtttcaagcacaagtgagacatactctgcctcatttttacaaggatgcccctggctgctggtggagcacagggcacagggggctggagacagcaagaccagagaagtcatactgctgcaaaacagatgagaggctggggctggctagcgggagtgagtggtagaattctggacagtcagggcaattaagggttcccctgaggctggctgggtccagccacaacctgtggtgccagcctcagttctcaaggaaagggacgcagggaaggcgtgctgggcatgtagtggacaccactcatgcccctaggtccccaaggtaggggatgggattgtgggatgccacacatggaggcagagggcaggaggttgcagggcctcaaagacccagaaggtgaaatcagattccccactcaagtgagggtttgatggagtcagcagtttccttccctggggaaactggggagccaggagcctggggctacggctctctccaaggcagcaacctctttgatttggctcttaatgaaggccccacttcttctctgctgtcatggccaccctctcctccataggtggaacctttgcatattgatttatttatttactcctggcccagagaaatatctggcttgatttcctcctgagtcagtgttcctcaggcgacactatcaccctttgtctggtcagccgtggtggctgtgggccaaaagacaggacaggtggctgagggtgtccagagccaggacagcacagggttacagggaagggcctccctgttcatctcatctccccggtcatctcatctccccttcctttagcagaaggacactgggaggcccagccggggcatagcctggggttgtctgtaggatggggacactgtgttcactaaccgtagtccttcctcccatctgctcggactatggcttcaggataggcagagagctttgaggaggcaaagaaaggaggacctgtttctaaggtgagacccgttgcggatctgcaggtgcaaggcccatcaggcaggttgtggggagagtgtagagaagccaacccagtggcctgggccctggttactgtggagtggctgcaaagagcccacaaacacggagtcacatgtcctcaagccatgaatcagtgatgtctttcatgtgcgtatgctctcatttttcaaacactgcaaaagctattgtgataaatgaaatgcagagtcatttacaagccttgaggaaatcttggcgcgcaaaaaccctttttacctctgtcatcagcactcactggattaatgggtgctctcccttctcactgtaaagcatgctggcttgtgtcagtacagggttggccctccagggcagcgggcactctctagaacccccttgcccttccacatgtatccctttgagtccgttgtgattgtcccaaacctatttgtgccagttgtactcattgtaatcacagcctggaatactgtgtaaactggtgggctgtgactgtatagagggcttctgtggaaatgaaagtggttgctttggaaaagcctcagtaaaagccgtggttaggtttggtgtgggcaagccaaccacgagtttggggacaaggagtataacagcctaaagttcagattccgggtcctttgccacctcacttgtgttggaaaaagtaaacgagatgtcacgcaaggtgtgctgtggtttaagcaagaagtggcataaccccagaaccggaaactctgatttaggaagagtttgtgtctctgaaaattgacagatatatgaatgtatgtttatctgagttaagtgaaaataaagtacacgtgtgtcatttcttaggtcttcctgctttaattcacttttcagtagatcagccagccagcagtctcaggtttgattgcaacttttagccatcaacagttattagaaatatatgttataggccaatcaggttataggccaatatgttataggccaatcaggttcatgcctgtaatcccagcactttgggaaggagacgcaggtggatcatttgaggtcaggagtttgagaccaatgtggccaacatggcaaaaccctgtctctactaaaaatacaaaaattagccagccatggtggtggacacctgtaatcccagctacttgggaggctgaggcaggagaatcacttgaacccagcagatggaagttgcagtgagccgagatcgtgccactgcattccagcctgggcaacagagtgagattccatctcaaaaaaaaaaaaaaaaaaaaaaaggccaggcgcagtggctcacgcctgtaatcccagcactttggggggccgaggcgggcggatcacgaggtcaggagatcgagaccatcctggctaacacagtgaaacctcatctctactaaaaatacaaaaaattagctgggtgtggtggcgggcacctgtagtcctagctacttgggaggctgaggcaggagaatggcatgaacccaggacgcggagcttgcagtgagccgagatcgtgccgctgcactccagcctgggcgacagagcaagactccgcctcaaaaaaaaaacaaaaaaaaaaaacaccccagaaatatatgtgtaataatgtcggaatctgcaggttggtctttttcgttgtgtttttttgtttttgtttgtttgtttatttgttttgagtctcgccctgttgaccaggctggagtgtaatggcgcgatctcggctcactgcaacctccgcctcccaggttcaagctcctgtctcagcctcgaaagtagctgggattacaggcgcacaccaccacacctggctattttttttttttttttttgtatctttagtagagacagggtttcaccatgttggccaggctggtcttgaactgacttcgtgatccacctgcctcagcctcccaaagtgctgggattacaggcatgagccaccgcgcccggcctcgttgtgtttttttgtttatttttgttttgcatgtgaaggatcattccataatacttggaaaggttgtaaaccaggagtctacaacagagccaaggccacaggggccaagtatgaggaggaggctgcttgatgacactgcagaactcccacggcaggccagcctggaagcccctctttccccaggactaggattcacaaggcccttggagccccagcccacccaagcggaagagtccagggacaacctgcagggaagtgtgaggttttctagcataagaggacatgggggatgggcctgaggaccaggagatgctggtttcacagagctgaggctagctgggctctcagcctggggtgtgcagagtccacagtgtcttccccccaaaccttgcccccagaaactcccattttaattcaataaggtgtgaagtggtcaagatcatattaaggtggggcgtgagctggctgggatgggaaagggcacgtgggagactgggagaccaggcaggaggctccagggaagttgggagagtgaaggaggagggtgggcaggagaagtttcaggaagaggactctccacacagacagaaggaactggaaaccataccaaaggaggggtccttaggggctagcctgcagctcggagaggggcaggtgtgatgcacatttgagaaatatttgtggaaagcagaagcaagagggctgtgggaggcctggggtattgggggtagtaggggagggtagacccaggcagaggggtcccaggggaatccagtagagctggcccacagagtcccagggatatcacgggctccaggaggaggccatgggtcagcagcgacctcaggtcctgaggcctgtggactgcagggtgacccctttgcaggctgctgggaaaggtcattttaggtaatgctctcaaaagggagtgctggggaagcttccgagctctgtacaaatattttttggtgttcctccatctatccatccatctgttctgcgaatctttcacagagcacctgcttcgagggaagcagagctggtgcttgggggagggagggtagagcaggagcccagaccaacctgcggtgggtaccctggggaaaccacacacaagccattggaggcgaaggtgggaggaggggatatgggccagatgtggtcagggaaggtgcctgcaggaggagccggcagccctgaggctgaaaaaggaccagtttgtggggcatcccttccatttcttccccaggggaagtccagtcccactgccgaaccagcggcacaccacacctgttcaaggtcgcgcgggccaggtggcaggcccagactgagtccactggggttccagggatcctgatgctgcagtagtcaggggtcctcatcagagaaggaggttctccctgggcttcacagggctgtgttttcagccaggtggggtggaacagggcactgtgagtgtggtgggtgggagatgcagccagagaggcaggaaccttgcttcttgtggagttaacaaggagggaggggtgagctatgcaggcgatctttccccagagggcagttcctgggagggtagcttgtccctacccatgtccagtgtcactggcattaaggcaagtggggtttttatcttccccggaagatgtggctttttagtccaaaaatacaagcagtccccaacttaggatggtttgacttgcagtttttcaggttatggtgcaaaagcaataaacattgagtagaagccttactttgagtactcatacaaccattcattctgattctccctgtcagtacggtattcagtaaattccacaagatacgggttagattcttttgtctacctgcaggctaatgtaagtgttctgagcacatttaaggtaggctaggctaagctgtgaggttcagcaggttgggggaagtcaacacattttcaacttaggatgggtttatcaggacataaccccatcctaagtcaaggagcatctgtaggtgttgtatcaaaagccttaaaccatcaggccttcttgcagacagccacactggccaggatgaagcagcatggggaagccttgagcactggatgtgaacatatccttgctcatttttgccttcatccccacctggtcctgagcacctgcgcttcgtggcccatgatgcaatgcagccttgagagctgcagccccgcccttcactaccccaaggcccagtggggagctggacagagagccattcagtggggatgccacagacagtgtcgtgctgggaaggcagggaagtcaggtccctgctctcccagatgagtgtgggcgtggacaccaaccctggctcacttgccagaggacgcactgtctgcggttttgtggtcaccctaccatcgcatgtccaggtgacatcgcacgtccaggtgccattgcacactggaggttatgatgcagaagtgctgctccaggaggccataccaacccccatcctgtcctgggtcccttggggccacctgccactaggtggggagcctcatctggagcccctgagttttctggaggcagctctcaggctggaacccccacctcagataggtggacatggtttccaggcagcttctccccaggctaagcccgtctgctgcatctgcggggtcagctctgggaatcaccccaccccttgatgtcctcagcgattcctcactgctgccattctacatttttctctgtgtcctcttctccatggtgctgagctttatttgaaatggcctggctgccttatgtgctcaccatctccccagcgagaatacaagctccttgacacacagactcagcttgttccccaccatgtccccctgtccccaagcagggccacacacagtggggctggattctgggagagcaaagtattgatcatagcaggttgagtgactgatcagttgcccatacagatctgagggtggaaggcctcaggcctgggcgcacgtgctgggtgatttaggagcaacgggagaagcagtggaggatgctctgctgagcagacaaatggaactgagccagggagagggtgacccactttgctgagataagagatgggctccagcctgaggacaaggggtgcagtgtttataccacagcccaacagcctccatcccttcaacaccagtaccagtgcctccgccctggttgtcccagcttgtcccagcagagagggcctctggccctggttccccatgtaccccacttgtgtccccaggaggcacgggcagtggggacagagcagggggctgcaacaccatcgaaccctaggaggtggcctaaggccacagctatgagtggcactaacccttccccagaggaaggtaatcctttttgtttctctctcaatccttctccttcaaggagaaaatcccagtttggtgccaacgtggctctcacaccctccagcaggcgctaatccccgctgtttaagcaacagccagtggccttgcctggcccctcggcagggtcccgcccctggctagtggcagaagcggttcctctacactgttttgtatttagattacttctgtctacggcgggtgaccctggctttccactgaaagtaggactatgaagtcattatgaagtacattttttaagtaaaaaaggcagtcaatttaaagaaaaatgctgagtaaaaacagcaagtgatacccaggtgtggccaggttaggcaggctgcagtcccgtggggcccagttggagggcttggtgggagcagaggcctgcagactcccagccaggccaccccgggaaatcacctccatctttgcgctttgatttctacagccgtaaagccgaggccacctcccaggcctgcttttagcatgagatgacgtgtgtgagcaaagcactcggcccagcagtggcagcagacggggtggcacggaggtgcagctgtcccctgcgtgtctccagccacgggcctctggacctaggttccctgggcaccttcctctcctcccagtggcctcagccacccgagcaggcacactatagttgaggaaagcacagcagagccacagctgggacccagagtcccctccctgaccccaccatgcccagcttccctgagaaagaccctccccggggcccagcccacagttgcccctgacctcccatgaagatgtgtggaaatggctccatgaagagcctgtgaggacactggaccatgaccagaccactggagagaggggaaatgcagtcatggggctgcagcatctgtggagcccacttcccactgggtggggccagcatgacaggattgaaggcagtgggacagaagaactgggcaacacaaaggacacctggctcctcagcaacagagagctgccaccgaggaggcccctacaggtccaggccaggccctgggaaacccatgatgggacacatggctggggcaggacagggagtgtgcagcttgtcagctggaagcacatgcggctccgataagtcgggcgtaaaagggcagtggaaagtgcttcctcattcggcgaggaggaaacctggtaatctgcaatggccacaggcacaggcttttccagaccttcggtttctaaaatagtatcatggtgggagctgatgtagggacggcggctccagagttgggggcagcacccactctttaagagatgatagaatgagcatggtggctcacacctataaccccagcactttgggaggctgaggcaggaggattgcttgagcccaggagttcgagaccagtctgagcaacatagtgagacccccatttctccaaaattaaaaagattagctgggcgtggtggcgcgtgcctgcagtcccagctactcgaggctcaggtgggaggatcgcttgagcccggggggttgaggctgcagtgaactgtgatggtgcactgcagctgggtgacagttaaaataagataaaaatgcctcaattgagcttataaccgcccaaggggttcaccttgcccgctgcctagacagagccgattcttcaagacgagaattgcaatagagaaagagtaattcatgaagagctggctgtgcaggagaccggagtgttattattactcaaatcagtctcctggagcattcaggaagcaaagtttttaaggataacttggtggatggggggtagccagtgagccaggagtgctgattggtcagagatgaaatcatagggaattgaaactgtcttcttgttcagtctgttcctgctcagtcagttcctgggtgggggccacaagatcagatgagccagtttattgatctgggtggggccagttgatccatcaagtgcagggtctgcaatatttctcaagcactgatctcaagagcagtttagggagggtcagaatctttagccttcagctgcatgactcctaaaccataatttctaatcttgtggctaatgtgagtcctacaaaggcagtctagtgcccaggcaagaaggaggtctgctttgggagagggctgttaccgtctttgtttaaactataaactaagtttctctccaagttagttcagcctacacccaggaatgaacaaggacaacttggaagttagaagcaagatggagtcagttaaatctctttcactgtctcagtcataattttgtaaaggcggtttcaagcttggcctgcaggttcccatactcacgcagcaagtcaagtgatctgagttatatgaaccatctacacgcccaaaatgtgggttcagggtaccccagtgcgtttcctcctgctggtccctgcatgctctgagctgtgggctggcttggggttggagccttacccactctgccccacatccttgtgtgaggaagggcctgtggtcacaggcatcagtgagcctggagatctgtcactgcgcgggcctcctccctccccagaccagctgctgggtgccaaggtggagctggcaggtacaggagccgcggctgcctggataaaaggcgtctcagcaaactggggtcaggatgggggtggggcagtgctgagtcatagccccgcttggggcatgccaggcagctcagcctccacaggggactccaggacagggtgagtggcaggtaggcgcaggcagccctggggtcagctccggtagggtggaaaggacttgttggtctgaaatgggttccatgactcctgttgccaccccaagcctgggacagtggacaccactggtccccacattgaggctagagagtcctgcaggttcagggtgtgtggtaggtatctggggagggctgggagcccatcgggcattaggggtgtggccttgctctcccttgctggccctgtggcctgggctgcctgccacctcttggggtcctagcttctgttaccagcaaaggtggccatctgagtggcttctattgggcctcaggcatgactgcctgtgcctctcccccagtcacagtctgggtacagttccgtctcctcaacaagcctaaactatctccctgggggcagggtctgtgtgttgaaccatcacttcgtcttggctcactctttccgtcgcccaagctcagcatggggcaggctttcctgggaggtgaggagggagggaggcaggtagctagggacctggagagtgaggggctggactgccgtctctgaggaagtcaggcacagtgatgagggagctggtctataagctgataagtcttcccgcccctggcttagccggcttgggcagtgagaccttcggtgaccttggctgtgggctgtcttcttctgcctcagccgggggcactgactctgtgctgtgctggctgttgtggaggaggccttgagcaaagctttggggacagcctggaggttacgggcagggcaggctggctcccatggcctggtgtggtcctggcgagctcaggctatggtgggtgtgaccatgggtattatgttgccccagctctatgcctagcagcaggctgagcctccagggattgtgcctggggagggaagtggttcctagagtggagggcatccaggatgcaaaggtcccaagagaggtggcagcactttccctccatgaccatgtacccatcctgactcagggctatcactcaacatctgttacaggaacagacttgagagggccacgtctggaaggagggtgatgagggcaggccgggcctgctggacggtgggtgagaagggagggtcttgagggggatgtccatgtgtgggctgaaggatctgtcccgaaaccacaggaagcaagcggccctcagcagagggttcctgagtgggctcagggcttggagatcgtgccttaggaatctttgggtaggtgagtcaaggaccaggatggagctccttaagagcctacagccaagagatgctagtttcctgaggctgctggggaggaggcaggcaggtgcagactctggcctgagcacagcccactagggcttcttggcctctggctgccagcatgtcgaacctggtgcctggccctatgtcgcactaagtcctaagcgacctcctggtgaatttgccacacccttcacgctgcaaacactacacatctgctgggggcgggggccagggactggatactagctggtgttcactgatacagtccactcatctgtactgagccctggccataagcacagcagggtcctgtaccacagggacagctgacagtccccctttcccagtacctgccactttctcctaatatgtcccctctccaagagcagcccctgcttcagcctactggctggtccctggagttccctgatcgtctccctgttcccacccagccgccactccatcaccaggcactgtgcaccgtacagctcacacatcttgcagagcctcactgcatccacttcccccagccctcacctgtgttgctccccttttatcacctggatgtttgcatccaggagcctcctctggtctggcttcagcgcagcagccagagggatgctggtcacacagggcaggtcatggcacttctcacccaaaccctggctggctcctgactcgcccttaagtgacctcctaccctcttggcaccagccacatggcctccttcctgcccctcagactggtcaggcatgctcccacttcagggcctttgtgccggtggttccctcatccctgatgcctgcttgcctccctccttcaccacctgttcatactcatctcttaccaggaggccagccccacccacctttgctgacttgcagcccgcatgtgccacccccaaccctgcccacctggagctccatttccactgtagcactgggcaccttctgccacttgctgcttatttactgcctgtagtctgactcctgccctcccacctgagcaaaaatagggaatagatcttcatctgcctcattcagcagccccagcccaagtgccagaatcaaagccatggtttagcaagtaagtgtgggatgctggagagcccctgacccatctcccttctgccccagtcgcctcagcctagctccacaccacagctggttcctcctctccagggcatctctgctcccaggatgccacatgcaaccacatgcagatgcccacatgcaccagtacacatgcagctgcacacacgcacaaccacatgcagacagaggcatggacctgtgcatgcacacccaaagatgtgtacatggacctgctcacagacatgtacatggatctgcgcgtgcacatgaacagacacatgcacacactggcatacaagcaaccagacacagacacatccatgcacctgcactctcacagacacaaacagggacctatgcatacacgcacacataccgcaatggacctgcatacacataggcacctatgcatacacgcacacataccacaatggacctgcatacacacaggcacctatgcatacatgcacacgcaccacaatggatttgcacacacacagggtcctatgcatacacacacacaccgcaatggacctgcacacacacagggacctatgcatacatgcacacacaccgcaatagacctacacacacacagggagctatgcatacatgcacacgcaccgcagtggatttgcacacacacaggcacctatgcatacacgcatatgcaccgcaatggacctgcatacacactggcacctatgcatacatgcacacacaccacagtggacctgcatacacacacacgcaccgcaatggacctgcacacaggcaccacatactgccacaaacatgcaggtacacacatggcttaaaacctttcagtggcgtcctgtttctcttcagtgaagaccaagggctcagttggacttctggtgagccctgccccttcctcttgcctggtacctctctcctcctctccctcagtccagccactctgaccttccttcagttcccctttgtgttagggatggtttgtccctttcatccctaacacacatccccacacaccgcagggccttacagcatgttcctcctctgcctggcacactcttttcctggcccattcctctggtatttctagccatgcccagaggcactgtggtggggggtcctgggtgttgagctctagtgatccatcagtggtttctgggccagggaacaatgtggtcatcaactcttggcctttgtctcttggccaaccatcatcaggttccatcctgggacttggggagtcctagcatgtccagtaaagcccgggttagactcagagagagggctggctagagccttgtgtaagagccaagaagtcaagcctcagaataggtgggactgtcataaggtcccatttgaaccacagccaggctcccaacgcaaggcttccttacatccgtgcacagccctgtcccatgcgtggtgcccctgcacagggcgctcatacccccaaacacaacacagccccacagagccgcagggagaattctgggtggggccttctgcttgtttggttcaggtgatctgaaagacgagggtcctcaagcaggggacctccccttggttgtgactgttcgtcactgccccatgcaggtgacagacttggccctgatgcatgtgattgctacctggcctcagtttcccctttccttgcacattgccctgtcgttgccggcgcacactgatcgaagactgcatgagcagcccttagctccaggcttccagacaacagcagttcagggcccaggctgccagcccagtgtccccaacctgctctcctgattccccagccttggagccagggagcacatacatcccaaagcacaaatcacacatccttggacagagcagcttctctgcccaccactggggacagaaggggcgcctggctgtacctcagattttcaaacgtggaattgagaagaacagtcatgacaacagaggacacctcccactgggttggacactgccttctgaaaggagcatgttggcttcctgctggaatgatggtgctggtagggagaaccctgggtccccaggcagtgggctgagggctttggacacctttccacacctaaggggctgtcaggtcgtcagcagggacaagggagcagccacagggtctccatcctccatgcgctcatggttcgtgtgcatattacacatatcatgtacatgtcatctttaagcagatgttctgcccactgtgtgctggagtgggagggtcatctcaaggcttccattctcagatgtaattttcagcctcactgggattgggctgagtgactgtttaatcactgccctcttggcagagatgtttctagggcgttccctggtgcacttctcatcggtggctgcctggtgaagcgggaaagttcctcagcctctccattgattccttccctccctccctccttccaccaaccagtgcttactgaacacccactgtgcactgggcactgctctgttcccagtggggaacgaggccaggacgggccctcctcacccgcactctggctgggggtaggggcgacggcagcacacaaggtcatgtaggtcacacattagctgagggctgctatggaggaggaggacagagggcaaggtgacgctcacagcgacaagcacagcagggcagtgactgctactggctgtcactctctgaggaccaggcttgtgctggacgctttactcttcacagatacctgtggccagtgagggacaggctctgagatgggagtaagtcgccagaggccacacaacctgggagaggcaagcaaggcatgaaggatgagaccaccctgagagtggtgggggtaatatcagggtctgaccaagggaaagaggcggcattagagcctctggctgtcagaggctggcagggctagggagcaggtgtgagaggccaccaccactgccaggagagaccagaacctctgcccagggagaggacagcccaccaggggcctgcttcaaagcaggatcgccaggactagtggtcaaggtctgtgaggggcaagggacagtgaggggcacggatggctgctgggaggatgaagtgccatttgctgagggtttagcaggttgagtttcagatgctggtcacacccaggagttgagggtggggccttggctgttggggtctctctgcctcgggccttcccaccccagggcctgtcacagagttgatgggtggtattaaaggggcgaatgctgcctgtggcaggatggggaggctgcgtgggtctccggacagggacataggtcagggaaggagcaagaggggtgcgtgtgagttgggtggggcctggtgccaccctgggctcacagccggggaagaagcctgagctttgagctgcccctcgtgtggggaggcctggcctaagcacccggcaaagtcacaggggcatcctagggtgtgcccctccctgctggcaggaaaggtggatggggaggccctgactcgcggggttggtgaaagattctgcctgaggcctctaggccaccctgccttgccctggcctcggtgattactactacccttgggagccactgtgacatctggtctcccaggtggatttccccgcagcaccacgtgcagcccccagctccttggtctcagcccaagcccccctctacctccttctgcaggagtgaggcagcccctgcccactgtgcttaggcacctcacggtgctcccacagcctgaagcctccaccttgctctggtccctgcctatctgctggctcctgggctggcccatcagagtgccctcaagggaaagcaggggccaggtctccctcctggtgcttttcctccctgtgatcagaagtgacccagctcctgcgggggtaatgagagtcagggaggcgctcagttatcccagggctgggccgaggcctggccacccgtgtaaaacagggcaaggctgagctctatcagtgctgtctgggagaagggccccagggggcatcacaacagggtgaccttattgaatcctaactggatgcggtagaagtgagtccagcatgggggctgggtgggcagaggcctcgcacacaccctcctctccctcatgcacctggcttcaggtggactgtccaggcaacagcagacatatgtgttacaccatggtgtgggccctacagcgccccatggaggagagggggttggatggattgttgccggctcattttccaaggccagtctctgctgctttgctttcagaagagctccctttcactgtccagcctgaggtggggctgcggggaggaggctcacgcttttctctgtgtttggcaggtgaagggctggatgcacagtgggagccggaggcggggggctgcagggagcacaccagcgaccggccctccaaccctccagccactcagcaacatcgccacagcaaccagcaaccagacggcagcagccgaggcaaacacaagcggacggcttcccaccgtcgccgaggacagggaatgactacggcaaatcaggccactttgccaactagggaggtggagtgtcactagtggggaggggcggccaccgcccgctgcacagagcgccatgccggctggagaagaggcgctggggcaggggctgcagtgtggctcggcctcacccccctgctggcactgagtgcctccagggcagctgggctcttgtctgcctggtctcagtgtcccctgtggcaagagggagaggtgccccatcccgtgctccttgtctgggcccgctgctgccagaccatgggatgtcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgacgctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggggggcagaggtcagagcgcaaaaagtggatccactgcttcgagggcgtcacagccatcatcttctgtgtggagctcagcggctacgacctgaaactctacgaggataaccagacagtaagtggggccgggggttttcctctgcttgttcctgctgtcgtgggttcctggaagcaagaggactcgtgaggtccaggacagtctgcagccagaaagggaaccaggcgcaggcctggccctgctgcacgataactgaggcagctccagcaaggtgggggcagagggaacagggtgtggagtgcaggtgtcatgtcccatgcctgaagtactcagggtgtggaggccacagggcaagagagtgtgaggctccgccgggcatccatgatcaatccatgtgatagtttggcaaatccatgaagctcctgccagcaccagtctcctaccagcatataggtccaggaacagcagccacccctgcaaccccatcttgagtctgcaaatctggcagagatggggttaagagctgtttagaagggataatcccaggtcctggtggaaaggggacgacgtaaaagcaggtgttgggattctttcacagtggcatgggcgcagcccgagggagacctggacccagtgtgaagcggtgggggcttgagagtggagttgctggagagggtggggagccgggtgaagcagcagggcagtgtgctgaggcccagccaggacagaaggtctagcacacgaagggggccacagccaggagtggcagcggtggaggccgtggcaggcaagggaggggctgtcttgcccagcaggattccctgagcacagatttcaagtctgcccttaagagagaggcctttgaccctggggatgggggagtgggggcaaacaaggagtcacgaagttgtgggtaccctggggctaggggagggtgatgctgggagacaagggctcagcctctccacttgggagcactggcctccgaggtcactccttgcttcacccagtcctaaggcaagctttattctttaggttcagcggagagcaacaatggttctagctttggacctgtgccccagccagggaacctggacagctctaggcagtggccatggtgctaggagcctgagtgttctgagagagaggatctttggctttcctcaggcagctggggaggcgggcttgcctccctcccctcctcgcatcaggggtctccctggaactgtgcctaggtgttgatggtgtgcctgggggaaacgaatgacggacgggcaggcaggtgtgtacgcaggcggctgcgtccaccctgttcccagtgtgtatctgtgtgctctccagggttctggccccttaccctgtggttgccacaagttcagccccatgtgtggttctgggcagaggggacatctcagcagatgagtgaggtcaggctcccttgatgaggcatggccgtgggcagagcgcttggggctgagaagctgcaaggcaaagtgaggtgctcaggccagacccttgggacagtgccatggtgggtctgccagtcacacgggcttgcgccactggcctcacccatcaccacagtggcaggcgtggcaaattccccgggcaccaggcctggctcccagttgcatcctttgacaggccgtgcccacaggtgtgctggacacaggaggcaggatacctgggtcctgagtcagtccagtttttcatggagggctttggctgtcatgtttgctttctgaacttgtcagtgaggagatgacccaggtgtcttcacagatgggcccaaggctaggcctttgcctgcctgcagccctcttggctcttactggcctgtgcctgccaccttgctgcctctctctcctctccttctgctctagccgtggtcagcttgttttgctccagcagtactgctctgtccagccttaagcttgtaatgatcctgatccctgcctctcgtacccctgcccttatcctccaggtctcatcccaagtggcgcctcctgggaggccttttctgacctagcccggcacctgcttactcctccatctagtgatgtgtgagtgagctcctcggggcaggccctagatgggctgggtggcccctgtggggcctcacatctctagctttccctctcccaggcctgtccctggggagagccatggtgggcagccatgggcagggacagcagccactggcctggtctcagggatccctgtgaggttccaggcattcaaggcactttctaaagggaggggctggcagccaggctggcacacccaccaccatcaccctggtttctgcaggcctggggaagtggttgttcaccagaaaaggaaattcttgatgagaaacccaagcgaggctggaaattcactggattccaaatgattctgacctttcatgctctaccagtaatatctggagatggaaaacaaacaggctgcagaggaaagacaatcccctcccgcgattcctcccgcaggctgggctggccccggaggtgagctggcccccagagtggtgccggcagtgaggacagcccgtctccagccgggccagggccagagccagtgctggcacgggctggcacagggctgccactctgctctctccttttggaacgtgctgaactgtcctccctgggccctgtcaaaggcaaggcagccaagaacaggccatgctcgttttcacaaaagccgaatgaaccttggggcccagtgccagggctctggacacggctcctccatagccctccttccgtgctcagcttccaaggcctcatcttccctgatgctggcagtgcctccccacccccacgcctggcgaaggagccacagccccccggcccacccgctggcttctgcgtcagcacgttgccaaggagaacgtcagtgtctctgggctcccgggtgtgagggctgcagtgagtgcagggcagcacctcagagcagggaaggcagatttccgggtgtctgtggagcatggcagcgagccacatggggagccacgcccctccatgcccacggttcccaccctcgtccgaaggaattggcagtcccttgccctgactagggccaagtcctgcaggtgtgtcaggcaccccagtgcccccaagcccaacacccagctggggcttcctcaggcagcacaggaggcctgaacacagcccagcaacacaagggggtttttctggcgcacctgtcccctgaatgatcctgtggggcagcagcgcctgttatttttgtcacagatcgaggcactgaggctcaggcacacagctggcgctggcgggcccccagccctcaagtccacaaggacagctcctgagaggccatgtgtcacaggacccaccacgggcctcccacttagccagagccatggcagaggctctgcccctcgtctttagtacattcacacaagggtcagtcagcaaagacagtcactctgctgccctaggagggaaaggcaaagtggagaagctggcacctaccagcccacactgagggacagacacaggtggctgtgaccagcagagcctgggtcttcactcggccccactggaggcacctgagggggtaggtgggcacttgttgcccaacctctgcccttgcggatcagctaatggactctgctggccaccaaatggtgtgggatccttcagaaggcaagattaaaaggtctagttgtaaagcatcaaatgttctcatgtggaaacccacagggagctcactgcccatttcccgacggagctgtcagcattcccagccctgtggcgggtctgttttgcacctgtgatggacctgctgtgcaggctcaaggctcaggctggggccaagtatgagggtgagcacaactctcccagcagcacagggaactgggggacaaggaggaggcagtcacaccagcccagctacagcttcatttccacaaagcctctgctaccagggatacctgccctgtctttctagagctggcaggcagcagttcccagcagtgtccccattgtgctttcatctaggacccacagtagtcacttgggccccacaggcaggctgggtcacagcagggttcaccgtgggaggcctggtgtctctgccacttatctgagagacagctggtcaacatgttatcagtgagggtatccaggggacgggggacataagaacatgccttttgtggggcaagttctgcaggtggcaagtgcttgagcagccagcctccaggcaggtggtctatgcctggccctggatagtggtcccttgtcctggggccattggcttcctgaggaacccctccccactccagggcaggtcagcagcctcagcacaccacgagggcaggtccacacccacccggcacagcctgtgctctgagcagagggcctggcacacagtgggtgctctgcagactttgtggagcgggcgggaggcggtaggcttgggaagagctggagctccagagccctggcttctgggtgcagagcagctgggacactcagcccttcccaaggagaccctatgggtgctggtccataacaggagtgtatgcagtaccctgaggaggggctgcccaaggccgtcctgtgaacacagcgtgttcctgccaccctagcgctgtggtttatcatttagcccaaaaagggtgcttgttttagtgcttttaaaatggagtttaaacatttgtgccataaaatggcgtgttgtgggtgaaacaaggtgtttccagtaagacaggcttatacctattgatgacagagctggttatatttgcccaaggagggaattacaaatgggcaatagccagacacagatgataccctctccccagcataccagggcttagattgagaagggaccttatatatcctttagtgttcctaaccagccggctttgcagatgaggaaactgagcctcagagaggttccttcacataccgcagggctgagactctggctctcagggagggtcctggcactggcccctgggaattccagtggcccccctcttcaccatactggtcccacatcctgtgggtgctggggttctccagcaagggccttgggggtatagactgggttccacccttggagctgctgtgtagccagccttccctcaggagagtggaggacagtgacacctgggcttgggagaggtgagtggctgtgaaggttgacactcccctcgtccccttgtctcctggcctagtcagtggcaggaccacagggagccctagcagaacatggcctcactctgcctcctgttcctgacctggtcaagggcatagctccaagccagaaggcctgccgcccttttcccgacacacacaggtctcccaagcagttccttctgatcttgcaatgtgccagggccacatgcagtttgtctgcagcatcctcaagttatcatgaccctggaacagcagagcctcctgaccagatccagaggcagggccaggctggcacactgggctcccaaggactggacagcccccatggcagtgcagcttgagaggctccacaggggtgggagacacagaggaccaagcccacagcagcaccctgatggcacctcgcatggcaggcatggaattgggagcagggctcagctggccacatgatatccccagcccgcatccctctctaagcttggcctggcttcctctctatggcctgttatcctacccgagcactggagcgatggggccagcctcaagagggctgggcacacacctatagctgggccacccgtggcctagaggccccaccaacacttgtgaacagcccctgccatcccttcagcaccggctccccgcatccaagttcccttgcctcattgcccaggactcagccttaactggggctgcggccacctcagtgggccttcagccgctctgagcctgtggccagtgctcagtgaatgatgggtatctgctcgcctagggtcccaggctttatgcgtgaccccatgggatgctggctcaagcccaagatgggagggggatgagcagggaggggtggagaaggcagcatgtcctggcacctatttgaggcccttgctagcacttcagtccttgggttagctccttccttcctctgctcccagggaggatgcagccacaaggcccctgtcaaaagcagctgctcctttcctgtcacactgggagcttccaagggtggggccatttcttagcccgccttgtgcagtggctccttgccctgggtaggtccttggtcagaggtcagccacaaggcaagaggcggcagggccctgggctcaagccctgctgcttgggctgcccccacacctgctctgcctgcagggccttttcctttggcccccaactcctcatcatcatgaacctggtggctctgtcgttcagtgcatcagccacccctccatgatggtcacctcctgctgtgtcactagaggccattcccagggcacaagctgtcactgaacacagcagtgcagcagccaggaggccaaccccatcactctgtctcttccaccatgatgacgttgtcaggtgccttggcagaacctccatggggatgcccatggtgttcctcagatctctcagacaagtgttcctgccacaacaggaggtcagccagcgtgggctctgctggggcctcctttatgggaaggcaggagtcagtctcttgccctagtgctggtaagccttgagggaggagggaggagagaacaagagagttctcttcggcaccatgccaggcagggctgcttcctgcagaggagagtgctgagacccagggctagtggtggcagagcctccctctctgcatgccagggcagtgaggggctagagctggctcatactggctcacaagagctaatttttcaattttcaggatgtttgtgagctgtttgacattatatttgtggcttcaaagcagccaggtaggagtaatcacaccccaggaactggcaaatactacaaaacagttctactcctccccagcccccgcctccatgccagttgttagacctttaccagtgcaccacagccagtgactcccaagcatggcggggagagtctgccagccaggctcagtcactggtgtatggcaggattgatccgctactgccatcttactgaagaacccgacagtgtccttgcctgtcagtctcccactgtgcttccccagtgactcccagctctgaccctgtggccgcgtgggttgcatctgttcgtgtttaccccgctggagaaagggaatttgccagagcggctcttcacttgcctgcctccctcccgctcttcctcggcagatttaagagaatcctactccacagagagcaaccttgcattggctaacacgagaccacaagctgggggccatctgatgttctccatctgagaacaagccctgtggcatccttgcaggaagcagtccttgttcacccagtatgtgtgggccctgggcctgacaaactcagtctagggacagaggcagtcctatcccttcctccctcaggtcagctggggatggcatcaagcaggccctggaggacctgtgtagccagggctggcctcaggctggcttccccagtgcctacaaatgctggccgcatgctctctgtgactggccctgagcctgccctaggaaacagttttctaggtgcagagaagccaggaacaggtgcctcctctgtcccaaagaccaacatttgcaggagagacgggggcctagacgttgggagcaggcctgcacagattgggatgaacgtgggggtggtgatctgatctggaccttgcagaatccagtcaaggctgtgggggagcagtggggacagtcaacaaaggcaggactgagggggctgtcgggggccatggagagcacagagctatgcacagtgccctgcagcgggatgacggaggaccaggcggtgtaaggtctaagcaggcagggcaaggtcgcaggcacagtgtccagtccccagtgtggcccagggtgggtgtcgctgcctgagcgccctgtgatgacggagccagggttcagccccaggactgtgtccctcccagtttatacacctcctgctctgcctcgtgatcaggctggatgctcacaatgataccctgtctgaactgttccaagagcttcagggcagagctgcttcccaccccacatcccctcaacctgcatcggctaggcttgcccaggccagtgggtaattaatttcctgagcgcattagctctgctcagtacacacacatgagaacagctctgggttttaagacacagattactattgttttaagggatttgtataatccagtaactgaaaaacaattttccactatctagaacagactccaaggtggaggctaagagtgctgggggccttgctgacttggggatccctagtaaccagtgtagatggggggatctgccactcaggggagtcctgtgactggccatgaacaagacaagcagtgaggacaggatgcagcagcaaggctctgtgctgaccggatgcatagccctcttcacctgaggccccactggctcagtctagtttctggagggattggaatgacagtcagctagggtgcatggccctgggcatctcaggggggacacccagtgttggccagggcagagtgaaaggtgtttcttctctctgcatgtggctcccgtctggatagtggacaagcttaggccagcccaggagcctggctgcagctcaccctaatccctgcttcatcacacctcgtggtggacatgtcctcagctcaggtactttctctaatttcattaataatgaaaccagagtcgactgggggccctgggccttgtatcctaaggttcccagcccaggccggccagggccacagccccacacaccttttcctggcctgtggtgaccaggggagaagcacagcagcatcctgaccaagggggcccagagcctcgaaggcaacttggctcagctggaggagtgactatgggcaaggtcctgccccacagggccacccagctcaagcagtaacaacccaaatatgtttttttaaaggatgaatatttttgaaaaccatctttttggccataggcagaggttccccactgggatctctccccactacccccagtttctcatgtccctcccaggaaagagcctgagcctgctgcagaggggttcacaagcccttgagcctacaggtgtgggtccgaggctgcagtgccagcggctaggagtgcagagtgcacccaccttgctgaacaaagcaaaggcaaaccaggcaagggtgtcggccttgggttcctggggatcctctggagctgaaactaggaggggtttctcacactgtgctttcttcgcatggtgatggcgtgcaagctcctggccaggcctgtgtctgtgttgacagcttccaatctacaacacacctgtatcatgctgtttgttaatttcccttcagcgactgacactggctggtggggagcaggggtgcaggttacttaaaagcagcaagatttaacacaaaaacaaataggagacagttctcagctgaaacagaagtggactggggctttggaagaggccagtcctcccagttgggcaggagagcttatggggtcaaggtgagagcaggtgggacccaggtgctgagggtgcccacggcctccctttctgggtctgggtgtgaagccagggagcaggacacaggagctccaggccctttcggagcaaatgctcccaccatcttggaattttctgtcccaggactgggagtctttgagcattgttaaggcaccacctccagtcacgtgactcccgccacatatcacacttaccctggggctctgcctcctcagcaactttgaccaacacccttgggaatacagaggctcccatttggacctaagaccctgcaagtcagtgatggttgagatctggtgagagcaaaaaagcaaaacagagtgacatgagggtaaggggggtggcgccttgggcctgtgctggagaacagcagccacccacctgcagggctggacaggggtgccaacatcctggaggctgcacacagacttctgggagagctctgcccagtgggtgaagcccagctgaggcatgagaaagtgctctgtgtacagcaccgtctccatctcacactgggccctggcactgtgggtggggccctggcctggctgtggcccagggtagtcatgtggacttgtgtccatctggactgcccaggtgaagactggcccagcagcacagttcctgagctcctgcccctcccctggctagtgaggaggtagggcagttctggaagtactctgaaggctcaggctgtaggataacatgtgtgtgctggctgacaacagaatagtggaaatggaaggcccagagacgtgagcggttggcagagcctggcgcagggcatgctggtgcactgcatgcacaacctctaagcctcccagcccgaaggggctccccaccacacagatgaggaaactcgggtttcaggaaaagttgtccctgtggcaaagtgggggccttctgacctggacatcccgctgctgcccaggggaatgggcagggctgggaagcagccacccttgccattactacgggtcaccccaccccctccacactgcacacacagggaaaccagggagggcagacaggactgcccaggcaaggtggcaaagccgaactgctgcggaaggcagggagcagcacgctcagctgtttctggcaggttcagagcaagggcttttcaggccattagggcctgagctagggctttagcggcagcctgttatcttgtttaaacagcccttgctgtttgaggtgccaggcttagctggtgctgttactatgagcactacagttgtcaccaggcatagttgcaggggggagggggccaccggcaagcagaggctctgacttctggactcggctggaacacacccctgccctggcccccatcccagaggagccccatctgtcgctggcctgggacctacaggcctgagtactctgtaaaatgggcccctcccaagctgcctgtgccctcctgagctgcctacatgggcagctgagcagccctgtgcgggtgggcaggagcggtggcctttcttatccccagggaaaagtcgagggcctcatgaaaacccagggcctgagagtgtctgaggacaggagttgtggccaccccaggttgtcaatcctcctgtgccactcgagagtctccacttcagccaggcaagtcctgtgaactgggggcctctgtctgcaggtggcagcagctggggtgtagggagcagaagctggggcgggagcaggggtcccaagcacagtgttccagcaagaagcaccggaacccaccaagggagcgcagcagtggagtcgggtcctgggcctctgcacacagaaccccagggggttggccgcagggtgtgaaaatcaaacccacattttcattcaccagaatacgggatcagatagttcctgatcgttttaaagccggaagagcacctgcttatcaaatgcctcttcagtctgttctgccagattgacccattgaccgacgaagccacagtgaggaaggacacagaccagctgtcactggagggccagcccagggcaaggcctgctgcgggggaggaaggcccagcccgagtcccttcaaagcctcctataggtgcccatcacccaccccagccacaccctaggcatccacagaagtggcgggtctgggtgtgaggcctgtgccccccgccctgatccagcccatctgtgggccaggagcaggtgcatctgtgcagaagggtggggccaggggcacacaggtggggagcagccaggcaatcccaacccctgcccctgtacacagctgccacaccaaacgcctgcagcatgtgccatctggccttgcctgccatccaccccgtgctgggcagagcaggggagagcggtccccaagcagacagcactgctcataggcaggccatgggcaatgagaacaggggccaatggtgctaaaagctgtgcagcaaattaaaagggttggggttgtgactagggcttacttcaagtgaaggagtctgatagctgaccagctacacaaacccaaaagagcagcccatgcagggtagcacagcaaaggcctcgaggtgacagagacggaagcaggagtcaggagacagccgggagaggcctggattacacagcctgccatggaaggcactggagggtttgcacagggggcaaccccagagcagaagcaggtagatggatcctgaggagacatgaccatggtagaatgggaaggagattgtccaggaggtgccctcatggggcagaactcagagccatagcccaaaactggaccctgcatgcaatgtcccagggccccagcttcctgcctcataagctgtgtcatggcctaggacctttcttcccaggcaggagtcagctccacctgctctctggctggcacagcctggtgctggccaccccaagtgttagcatcctctgcctgctggagaggtggtgtccctatttggggactcagtactctgaagtcagggttttgccatgctcttctctgtccttcgaggcaggagacatgctgtgcatgctacaggagcttaggaattgtctgagggtgaccagtgggggtccagaggaaaggtgctaggaagacatggaggcttccaggggaggctgggcctgaagctcagctccatatccgatgtgtcatcgtgggaagagcagtgtcttcatgaggcctggacagtgcctgggtgggagatagctccagcctccttggaagacctattgaccacgtttctcttgtgacgcacttcactgtcacccagaataactgctgtctcacagctaccaggacccgagcctctggggtaaggtagagttcaaggagaaccaaggcagcccaagtgagcctggcagcagagccgagggcagccccaccaaagccacggagccagccctgctggcatccagaggccagggtgggcctgccctcccatggccccgagctctgcccccaccctttaggattgcaccctgccttgttaagggatcagctgctgctcctctcaggtctttttgggagtcctgaatctgaagtgagcctgggagaaagggagtcagacaggagaggggtgggtgctgagccaagtgagggtctcaagaccaaggggaccccagagcatgggtacccagggcctacacttgggaggcctgtggctgggccaggaggatgaaccagtgtggagttgagagccatggagtggcagagaatgggtgccaggagctgaggtgttcaagctggaacagagccctccgtgcaggcagggccgagcctgtctccctcagcatctcagatgctcacagaaccacgggggcagcagggttcagtgttaaaggccaggctagaggaatggaaacagctgccccagccctggaagctgtgggagtggtggttgccctgcaagagaaggctcagagcataggcaggccttctgctgggaggcaggacccagcagttgagcaggtaccagccccccacctctcagttcctgaggctggccgtcagcaccatgtgccctgtgctgtccccgcagactggctccagggacagacaggagctcactgagtcattaaccctcaatccaattctccaatctgtcaaggtagcattgaggtttgcgggaggaagagggaagcactaaccagattggactgtaagtgaccctggtcatccagctctgtccccagacacctccccatttcctgaggctagtagcagtgggaggatgaccaggcctgaggggtggttcgggctgtctggtgctttccttggggcaagggtagtgggccaggcaaaggggcctaggcaagccaggtaacccctctgagcaccactttccacatctagaatggaaatgttttgagcctcgtgagcccaggagcctctcacagtcacttctcggaggtgaacagaactggagggcatcacggcagcccccacacaagaggaagtccagactgacgaggccacagggtgacaagagcgagccacgttctggggccctcccaccaggaggcccaccccacccatggtgctccagccaggaacaggtcaccagaggtcctcccctctcccctgcccactgccctgtctctcagggcacagcaaggcaggtccttaaagagacagagggagagcagggtaccctcgctaccagagaccctctcccaccacctgagcagatgggcagtagacagtgtttggccaaccaggctgtgtgcccctgtgggcacctgccccagctcaagggtcagcagcttcacctgccactggtctgctgtggtgtgagactctgagggtgagggtgtccaccctggttgtcatagaaacagcagtgcgtctgcagagagttcatgccaagctcagcagagggaggaagcagctggcctgggaggcagctgttgtcattgactcctgagagctcagtgttgggaaggacccaagggcccaccacactctgaggctggcgagcacacggggcaactcaggcctccctgcccaccatctttctttgggcagctgcaccatgttgtctgtcctcttgtccacttggggtcagcgacgattccatctaggtgctgggtgaaccaagcacaggggtgctgcctcagagccacttcgaatgagggggtaggatagcactgggattccagcaggcgatcatcatttgctggggggcctgcgcgccttccctgtgagcgtgagcaggaatgactcatgcctcctccacctgctctcacactgagcctctgccggggagtggcctcactgtctgcctggtttttgtctgtctgcccctttgtctcccagtcccattacctgtcatgcatcctaagctcctgaggacagagaaggtggagagtagcagagccagagaggctctcctgtgacgtggctggctctgtaccgagcagggggtgcggccacaaatctccaagcccaggccaggggagagaggcaagcgcactggactcggttccgcctagtggcaaagaggcccagaaaagtctcaagtgcttgggacagggccccatctgcatgtgatgtgttggggcctctggaaacggagatgccaaggcagtcttctctgaggtcagtggtgatgccagagaggtgaggctcaggccattgccagctgcaccagagacaccaaagcactccagggtcccccaaggtcactttagtagaacccagtgaccatcttggacaaacagcttattttactgaggcaggagctgcggcccagagcagaagtgacatgcccagggtctcactgcagtttggtgggagaattaggtttcagaacacaagacagccagtacctcccaggccccttcctcagggagccagcagggtcgtgggcaagcggccaggctccacagggcaagcccctttggacttaaccctgtttgtgacagccctggtccctgacagtcctcagatcccggtggcagtgggcagtgggctgtctgaaaccaaggtgctccttatttccaaaccagaggtgtctgatcacagagtgtgtcactaggagcatgttctgagaagccagggagcctggtgcccaggttcccatccttagaccagtcctctgtcccttgcagccttagtctcatccacagcaagactggagccttgggggtaaccaggaaaggacaggcactgcccctggcattcatgcagggaccaggagggccagaacacaggcaccctcagcctcctgtcttcaccccgcagcccaaaggagggctgcctgacctccgggcctcacttctctcccagcaccaagaaagaggttcccagctgcatttctggtttctgaggggcccttctgcttccccagctgccacagccccaggccctgcctgggggtctctggaggaagcagaagaggcatccttcggccccgccccaagcacaccaggctctagggcccagtgctcaccaggccgtttgctctttgcctcccaagaccgtgggaggtccagggacctggtcagtggcaatgccttccaccaggtacatggttgaagaggtgcggggagcatgccagggtgcagccaggaggccagatgaccacaaccaggggtatgacagccctggacacagcaggtctgtggccacggcaggagggcgagatggacacttagcaggaggctgggctgagctcctggtggagtcagggtgggactgtggcagggagacccccttctccagcaaggacagggccacttcctgagaaatggagcatcggacaaacaccagcggggtgggaatggcaagtgctcaaggtgagcacgatgcagctgcgacctgtagactggctgcaatggggagcctggccaggagaagccagagacggacaccaaggtcagatcctgaagcacagaagaccctcagtggggatagggacctggctgcagggagcaaggtggccagtgtggacccatcaggaaggcaggggcctggtctggggaccccacagctccagctgggcagagctaccccatgctgtgctgtgccatggaataccagccaagagaccaggagcagggagcgttctgataggaacatccagctttcaggtctgacgtggcccattttaccagaagaaggggacctgctctgagcatagcagccccctctgcctggaacctcacagggctcacctccaggctagcaccctgcccctgcggctgaccctggccaggaagacacatgttagacagctggctggacttggtgcctgctgtggctgcaactcccctgggaagacagttgagtgttctgacgttggctaaactgcatctttacaacagctggggccccagcgccacctggccctgtgcccaggcaaggccctgctggtcccagcatccttctctcccacagatcttaccccggctcccaccccagcactctggccagcaccgcctccctgtttcatagtcccatcaacccctcacacactggctcccagctgctgccaccaccttgagctgtctcggatagcctcctgcccatacccctttggcctgagggtagatgtaggccaagagcttgcacctacaagcttccccaaaagggaagtgaactcaggaattcctgatgaggattccaggactggctggggaagcacggggttgcaagcgaataagctatttcctttgcgactgataccatccttggagtggatttcctctggtgccttccctgttccacagctgcagaggcatctagcacagggggccaacaccacaggcccctccactcggtacacctgccaggacctcggcgcatcatcagatggtggggcccactcgccctctccccactagagaagtctgggaatgcctgtgtcccagaccccctcggcagcactcaggatggcccaggcaggttgcagaggctcctgcccaccaggcctgtcacacagagctctgggaaatggagatgggcagtcagtgccagccaagggcaggcacccgctaccgatggaggcatgttggtcactgtgtcagcagtgccccatgtccctccagccacaccctgcccagcagacaggcagccccaccaaggtgtccccaagcttccaccacaaagggaggcccagaggggtgagaggcttggccggtactttgtgaaaggtgacagcatgaagctcatctctgtatgaaacctctgcctcggcccctcagtcagggtgctgccctcagagcctggtactcggtggccctggtcaggcctggtggctcagctgcaggctgggtggccgcagggctggcctgtccatggtgaatggagcgcattcatgtctacaaccccgccccacagctctgctctcggcgtgaaaaagctgaattcacggttcggatgaacactcccagcttttctacagtgggctgacttgagcttctcagtctgtaacagaactgaggacttgctctacagatgaggaaactgaggcccagggtgggacagaccggccccggccccacccttcccagcaatgcggctgcatccccatgcctctgtgcctctgccagcccctcctgcaatgccttcccttcccctcagcccccagaggtccagtcaaaacgtcctgctcttgtattacccctcgccccctgcattcctgtggtgtgtcacctgtcagagttgtagctggccagcactatctgcagcagtgccagctgctcacagtcacttgtgcctgggtgtggggactaagctgtccatgtgtatcccacatcagccctcagccccctcacgagggaagtatgcttacatattctgtgtgtgtgtggttatttttttggaggggggacaggttcagaacagctggcagagcaggaggttgggcctgcattggccactccgcagctgccacaccggctccagcattccctcctgcctgtcctcacccaccttgttgagagcaaggctgtctgcttgcctccatccctcacacaagagcacctggagagcctctgcccagggaggtgaggaaagggagagggcagtggggactgccatgaaggcatctcagaagctggcagggctgggggttccaggtcatctgtgtcccagggatgatgctggttccaggaagagctgaaaccttaatgtcacgtgcattttatgtgaggtttgaggcccctagttgggccagctggccttgctctgtgctgtggccacagcaaactgcatggggtcctgtggagtaagggacctagtggagagtgagtggacagggagaccagatgggtcagtacagagccttccccagccatgtggccatatcacactggcatcacccacctattccccaatacaacacagtccgggggcccctcacctggctgaggtatgtgacaaggctctgagctgatggtgtacgttcagcctgagtaggtgtttgcatgtggttgcccccaaaccagtgtgatttggggctgcatggatccagagtagggaggtgacggtcccaccatctctggggtgtgtgcaagggtcagggtttgggaaggggttggacaagaccagtgtccctgaggactgcctacctgctgggagctgacatgggaatctgggagtgcgtctggcctcctggagggggtctcgggttgcccagaggggagcgaggaggaggcccagaacataccccttcctagaacaggaaggtggggtgaccctgcagggtggcctcccacacctcagtgatgcctcggtgacccctaaggcagaagatgcgtgaagcaggcatgaggccctgagcactgctggccacccctgcaaatggaggggccccacctgaagttgggggccggggctcatgtttgagccattttgactgggtctttttcagtttattttctaaacctcagtttatttgaagcacagtacatgattgctcacttcaggaaattctgttcaagttttcctagcagagttactcattccttcatctgtgcaaggggagggtggtggtcataatcaccaccctgatccccctaccccctgggccctgtgtgaagatgacaaggcagtgcggttggctgagggcctgggccaggccaagcacaccaggaaggtgccgcgcatgtgccagatgggccctgaggccgctggggtcccacagcaaacaacaaaacagtcaaacaggtgccagcctctgtcatgtgctcaccacgtgcccaggaccacgtctgtgtgtgcgtttgcctgggtaagccttgcttcgtgaagctgccatgacctccgtctcctcactgaggggcacagggcaacaggctgccaggtgaggggctgaggggccttctgggggccactggcctactcgaggcacagtgagttgtgggaacgaggagtaacttggaggtggagctgcgggtgcagagggaaaaagacacctgggtcatgaagggctggcctgtccgcctgaggggcccagaagtgcagtgaggggatgacgtggctacgcgcctgtgacagggcacctgaggacatttgcagtgcaggagggagagcgcttcagagcaggccagtgtccctcccacccggcccagtccctggtccctgggtagtcactgagctacctcatgcaggaccatggtcttagcaggacacctgtggtggcctgtgaggcagggacaggaaggatgccccactctgggctcctcagggagctgcaactacagtgcaggatgggctgtgatactcagcactgtggatgtctgtcaaggcagggtgtaatggactggaggtcagaacgtgtgaggccctggatgagcctctcacctccccacccccagcccaggcgcttgtcccacacagctgccttggatgtcattagctggaaagccgtgagtgcctgatggggaaggagtggggtgtggggaggtgtttaggctgtgacaaagggatgctaactccaaaaacaggcccccagtccagaggcctcttaaaatgcaaatatgccgcacctgggagggggacaggcccctggctgagatgaggaagcctggaggatgcctctgttccctctcccaccgcaggcccatgagctctcagaccagcaggaggctgatgctggaatatgcgcgcacctgctgggggatctgtgcgcctcagctccaaagtacaggagctagactccagtgtccatgtcaggtcccatccagctgggatgcaggaaaccaaaggcagccctcccatgacccagcactgagggccagacctgttaccaggaacgttggtaactggaagagcctggtacttggggctgttctgtgccccacaaacagagggaccggctgtaaggagactggcctgatggggaatgagaggggctgagccagaggtgccgacacggtatgttttaagtaaggtccaggtggctgcaggcgggatggaaacacatccaccattcatcacatcggccattgcatctccaggctaaggggccacaggagcctcccaaagagccaggctgacctgggccctgtggccagcaaagaagtgttgctggctgaatccccatctgcagcatcgagacctctcccactccgtccggctgagctggccctgcatttgggtagccttccctcagctgcctcatgctgggacagagggaagcaggtcttccgatgagacctcgcaggtgagaggacgtcccagtgccaaggcgaatcacagtgggtgtggcgtggagagggcccactggggtgccagtggtagccacagggcaaggcccagcagcttggggttcttcccgtgtcagcacctttgtgccttctcacaacagtcccagcattgtacagatgaggaaactgaggcccagagaaaggaaatgacttgtccaaggtgcagcatgcaccggcagtgagtaaaccccagaccctgtgttcatggccagggacatctgcccctttgtgtcaccaggagaaccttggtggagaatcaggagtgagaggcctcaccacccccacaactaaccaggcgcaggctcctctccactccctaccttgccccggccgctgacctgggaatgtccttccaggtgccggacctggtctggccagcagtctggcagccacgttcaggggaaataccccagacccgcaggccagcaagctggaagccccttagggatgggctgtcagctcccctgctgtagtgagaaagccacggcctggggcagagtcccttccacaatggcaagtctatttggacctgtctgagcaggagctctcttctcacaaatggccaggaaatgacttccacaccaccccagggactgcatccagctgcctggtggctgaaggcctggttacaaatcacctcaccattccccgacgccaagcagtgagattcccaccattgcacaagcttctcacaggaactgtctgctccgtgttatttatataaataaatgtgcagacaaaccccagcctcctagaaggcgccatcttgctggtaagcaggccctggagagagcaggatgggcactggagccctgggctggcatcacagcagtgaatggtggtgtgtttctgcctccctcttccccgccccgccccaccccccgcggctgccttggcagccatagaggtgaaggcaaggagggcttcttgccagaacaggacactgtggcagttggaaaataccaggctctcaactgcaccctggggagtcagcccctcttgaggccttgggccccatatgtgaagtgaggagccctcccccttgccatggggtcatggttggcagaggcagctcctctgaatccagggtctgtcaggctgatggaggaagtcactgcaggacaagggggtgatgcactaccatggggcagggccacatgactccaaagctgcatccagctctaccccagtggcccacaggtgggctgcagcaggacaatgtttaaccctgccaggccagggagggcaaaaccccatgcaggccaggccaggccaggaaggagaacagagccacatccaccaagggcaggaggacccaggggagcccacaaaggccagatgggtgcaggaggcacagccagtcatgttttgcagggtgagcagagcatggacaggtcagagggctatgaggccaggccctggaggccagcagaaggcatgctggggcttcttgcttcccatatgcatgcttgagtcacagtttccagagctacagcttcaaatagacggctctgttttcagtggtggtgatttgagtgtcaggatgccgctttgcccacctgtctgcactccaggctgcaagagtgcaggcaccgctgtgacacaggctcccgaggtcaccaggcaagcaccagggcccaggctgggcactaggtcagaggacaagactgggcttctggcctggcaacacctttccccactgcctcctctgcagttgatctttcagacccaaatatgaggctcttctctaggtttggcctcctctcatcaacttcagctggtcagggtcctgactttgtaaccgtctgtggttcttcagcctcccgctctgtcttgtcccccatctctgagagctgcaggcctctggtctaggaacaaacccacgatgcagctcctgcctcacttgctggtccatcagcaccacactgccagcaccacactgtcccatgctgggccctctgaccttctttatagccttcctgttctataaagattacaggatgggcacccaccatctcctaagcttcacctcctactagggtggagcccatgtgcagtgaaggctcagcctgcgtcagggacgctgggatggagtgaggcggcaagctcaggtgcttcccacgctctgaagcttcctgtctgagcccggaagtgaggtatgtggttggtgcctcctgcaggctttcctgactcctgccagacagggcccagccaagaaacaagaccaggaaaccaggcgtctacacagagattttgttattatttgaggcccatcatctcctcggtgcccactaaatattagtcagtgtggttcccatggtttgtctcaaggaatagaggaaaccaggaagcctgagcctgaaatgcctgcaaagcaaggggagtcctgggcacaagcaggggcctgagctgagggaagggcccacactcgggagatgtttgtctgtcctgatgaggctgccgcagtggcggaatcctgataagagtgtactgtgaggcaccgtgcccacctccagctgccttgtgagataagtacctgagtttccatgacctctaagtcaggaacaggaggctcaaagaggtgtccagggtccccaaggtccactgagaggcatcagcagggaagcagtttagacaccatggaaggggctcctagtgcattgggacagcttgactcaccccaggactcacgggggccacagtcaggagtgtttcatggcgttggacaagaagagtggctgccttggccttggagagagggggtccacgtggtctatcggcccctcccactgctgccagctgagctctccctacacacaggtgccctgcagaggaccagtctggtttagatctgaggcttcagatgaccagtacacgtgaactgtttccgcatcagtgaggtggccctcctgctcctcctcttacctaaattccactgcctgcccaggaggtgatgggctaagctgggtattaaaaccatctcaactgtcatccccaagtgacccatcagggctcagagaggcagacccaggcctagcacccactctgtgcttgtcccctcacccttgaacccccaggtccataccctgctggtggccagatcacgcccttcccaaccccggaggaagccccctaccccaaaaggaccctgccatccctgcctggctctattcctgcagccccaggactcccacctcaagctccatcacctggcatgagagctgatgtggactcagggcgcgctcagcaagtgtttgctcagtaaattaataatacgtgctaatggtcatatctgttatttaactgatgcaaaatttggggtcagaagcatagcccccaattacagcatcatttctatgagaaatgacagctctgttaccacagtcctctatgatgtggcttccaggaatccattagagctaattactccctcagcagaatgtgacattcctagaccaccacttatctcacatttgggaatgtgcagccaggttcactgcggaggcgctggctcctctctgctctgctggggatgagatcttgtgtgttgcttgtctctgcagaaaggccagcacccccatccccagacctgaggctgctcactcctcaggactcctgttattccgaagctcattctaaagaaagagcaagattggtttggaaaaacagtcttccaggtggagtgcagggttccagggtaatgacgggtacctctgggtatccttcctttctctgcacagatgctgccagagctgttcctcagagaactcaggggctctggagagcagggtttctatgcagcatcctcctgggcacccctgccctcaggcagcctcctttgggcccaccctgtaggagcagcaagccagagcacctggttgtggggcttggagcacatatcctgcctctctgtgcctcagtttcttcatctgtaaaacaggagtgggcagatgtgagaacagactggcagctcgtgtccagctgtggttaccagcgtcattgtcactgcagtcattggtgatgctgttgcttcgtgcctgagtcatcactaccagctgcagttaccacttgcattaccacggtcactggtgatgtagtctagtcagaaaagttcctttttttttttttttttttgagacagagtctcgctgcgtcgcccagactggagtgcagtggcatgatctcggctcactgcaacctccacctcccgggttcaagtgattctcctgccccagcctcccaaggagctgggattacaggtgtctgccaccatgcccagctaattttgttgttgttgttttatttttagtagagatgaagtttcactgtgttggccaggctggtcttgaactcctgaccttgtgatccacctgcctcagcctcctaaagtgctgggattacaggtgtgagccacggcgcctggccagaaaagttcttaaatccaaagcatcagatctaagccagattggttccagatttttgatattttgctcattgagtttatcttagaagcaggggtagcttttgccagcagcaaattccaggtagttactccttttagaagttagaatttattcattttgcagggaagtggtgaactggggagtcagacaagagcatcatgcttcttaaaagcccagacccctggctataacacatcgaagattctcagaagagaattgaggagcggacaggcgccacactccgttgtggtcactgcctcttcctggcccaccacactcctgtcctctgcatgtactgagagctctgtccaggatgccagggtcctgcctcggcagagaggcggtgccagatgccccacagcagctggtgggagtgcccacagctggagggcaggggaggagcctggcctctggctggtgtttccttcccagctctcaagaactggagactttggttacagaagtgaaggctgctccctcacagacttcctagtgtccgatggtaccacatggaaggatcagagttttgaaggactgggccagaacccagatagggcacaaggctgccagcgcctgcattgagggagctatgatgtgacgggggctcctgcagaagatggccttccttgtacaggtgtggggcagcctgtggatgggcagtgggaagatggggggtcctcggagctggaggtgcccagcggtttaggaggctgtgcttggcacatctgtagccccaaagctatatgttgagatcactggcacccagaggagagacccaaaaggggcaagagaacatcttccaagcacttgccactggcaaggagggtgctgccggctatttccgtgggaggtgggtgaagacatttaacctgggcttccccagcagaaggaggtgccattgcagggaccagtcttgggctgagaccctagcaaaggcttcctctggcagggctgcaggtctagggtctgtctctgcctgctgcgggcctgattaacgccagtactttcctttccccagagtcggatggcagagagcttgcgcctctttgactccatctgcaacaacaactggttcatcaacacctcactcatcctcttcctgaacaagaaggacctgctggcagagaagatccgccgcatcccgctcaccatctgctttcccgagtacaagggccagaacacgtacgaggaggccgctgtctacatccagcggcagtttgaagacctgaaccgcaacaaggagaccaaggagatctactcccacttcacctgcgccaccgacaccagtaacatccagtttgtcttcgacgcggtgacagacgtcatcatacagaacaatctcaagtacattggcctttgctgaggagctgggcccggggcccgcctgcctatggtgaaacccacggggtgtcatgccccaacgcgtgctagagaggcccaatccaggggcagaaaacagggggcctaaagaatgtcccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactttgccttcctgagttggccccactccacttgggggtctgcattggattgttagggataggcagcagggctgaggcaaggtaggccaactgcacccctgtcgcctggaggagggccagctcgctgcccgagctctggcctagggaccttgccgctgaccaagagggaggaccagtgcagggtctgtgcaccttccctgctggcctgcacacagctgctcagcaccactttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctactagtctgatgttttataaatcaaaacctggttttccttctctgacattttttttttgttttgttttttggtttttttttttttttggccaaatctcgtggtgtttcgcagaaaaaaatccagaaaatttcaaatgcagttgagtattcttttttaaatgcagattttcaaaacatattttttttcaggtggtcttttttgtgtctggcttgctgagtgtaaaagttgttatctggacgatctgtctctctgctccaaagaaattttggagtgagtggcagtcctgcgccagcctcgcgggacacgtgttgtacataagcctctgcagtgtcctcttgttaatggtggggttttctgctttgtttttatttaagaaaataaacacgacatatttaaagaaggttctttcacctgggagcaaatgaacaatagctaagtgtcttggtatttaaagagtaaattatttgtggctttgctgagtgaaggaaggggagcaaggggtggtgcccctggtcccagcatgccccgcgcctgagactggctggaaatgctctgactcctgtgaaggcacagccagcgttgtggcctgagggaggccctgctgggaccctgatctgggccttcctgtcccagggcctatgggcaactgcgttgaaaggacgttcgccaagggccgtgtgtaaatacgaactgcgccatggagaggagaggcactgccggagcccttgccagatctccctccctctctccgtgcagtagctgtgtgtccgaggtcagtgtgcggaatcacagccaaggacgtgaagagatgtacgggggaaagagaagctggggattggatgaaagtcaaaggttgtctactttaagaaaataaaataccctgaatggagcccagcattgtcccagtgtgctatgtgtgtagctgacctgtggctggacttggtgccatctggaagggcagccggggacacctccattctgaggtcccatattccaaaccccacccctatacctccacacatttaggtagagtcattttgcaatgaacatcacaaataaacatcacgagaggaaagaaactgcaaagaggggaaacctgccaggtccatgcagtcctggtgtggaggtctgggggtgatgatgactcctgcccctcccgctgcccccaagaccccacccaacactgacccaggctgtgccataccctggacccctcccaccatgtggacacctcagccaatgtcagagtcatcctgcagagtggaagaggtgccctgagggcctggagggttcctgtgcccccagtagtgtagggcaaaccttgtagggttttggagaggaggggtccctgagcatgcagtgctcgctgactggcttgtgtggttagaggtatctggatatagtggaaaagtgccgatcagaagtcaacggagtgcattcaccgagggcctgctgcgaaccaggcacggagccgggctccttactaatgattttatgtaacaccccacctcagcaggttgccagaggtgcccattttacagatgaggaaaggtgcctgaggtcagggagcagtcaagccaggattcaccaggccagggagctgttgctcccactggaggagcagagacgctgatctttcctcctgctggagtccttgcctggcttggcacctgcacaggatggaagcctacagggagcagcacagaaccaccctgcagcctcctcctcaaagcaggacctcaagcaaagtggggggtcggcaggcacacacacgcatgcatgcacacaagcacatgcacacacgcgcagatacgcacgcagccctggtgctgtcaccgccccatccctactcctaagcccacgcagggactcccttcacaccttcctacgtcaccaaacagccagaacccagaggggcttttgtttctgaagaaataacgtgtgacttaaaatcgttgagacttattttgtgcttttaatgccaactgtgaaaagagcagtaatttcgccgtgagcatctttaatctaaaaatacatggctaaagggagaaagggattgagcctcccttcctaatgtgtgcaaagatcagaggaggccttccctggagggaggtttctcccggttcccagaacctagccaggagtctccagttcccccataggctgcagagaaacctcaggcgctgtcgacctctctggccccgtcctcccctgcagttcacctgcactggttctcctcctgagcctgccttgttccgctcttgcccccaatgatccctttgcctagcatgtccttccccatcctcacagctcaaagtcacctgggcagcttcttggaagtctcctccttccctgcattccatctgtcagggctccagggtcgagtgggaaggggtgttggaaactccattgagcagctcaaggccagcgcctctgacccacctcattcctccaaacaatgccccatggagaaggcgcatgctgagctgggatggtccaggagtcttagccaacgggaggtaagcaccaggactcaccaaggttgctggtgagaggaggctagagtaggtggcagggtgcctgaaggggaggacctggggatggctgggccagccctgcccactgcaggtgactaatcccgccttgtcctacttcacgcagccccagcctcctttcccaggacccaccatcatgtggctccctgtgggatattgccatcctcacctatagcccacgtggtcaccctggtggtgcaatgggtcaacaacagtggtcacgataatcccagctctcctcagtgactgctcactggggggcacactcatgggaggccaagatgcttgattccattctacagaagtggaagcagagaccaggagaggcgatgacttatcagcatcacacaatgtgaccccaccaggccaggacctgaggggctttactctgtccacattccccagatccccacagtggcaacaggccctggcaccctacttccaacgtcagccctccagaacaaatggtccatctggctcaggggacagtgccaggaagggctgcactgcaccatgaggacttgaggcaacactgaggctggacctcaccctggatgagctcacctcacccagatgagcctgacgagatggggatgcctgacaggccgggaaccaagaggccagagtgtccctatcagtgaccatcattcctgctaagtccaggaatggggtacaactacccaccaaagactgtcaggctgaggatgtgcctggggttctggtgcaccctgccctgagggcaggcaagacagaaaagggcctgctcctctagggcagctggcctccacccctcaccctgtggcatcaaggggaggaggaggaggaggctgctctgggtccatcgaaggaagctgggtgtccacgggtggctgctgaagagggacagggtgcagtggtggcccacccaaggccactagcctggaatgagacatacggctcactgcagtgggagcacctactttgcttctccagcagcccacgtacctggggttcagatgacattgggtgcattctgggtggtatagctgtagacccccagatttctccctagcttagatgctatgactccagggatgtcccctgaacccccaaatgacttggatcaaactgcatccagacatttcacccgcggcaccctccccttcccaagcccagttctcctttccaaggtcacggagccaatttccagaggcagggcccaggcgcatccttgctgcctccctcctcctctcgggctggtgctctcctccgggctgggagggtcatccatctccacccccgggctgcacacgtgtggagtcagggtcagaacaggccccatcatgctgctgctaaagctgggctggggtctcagagcctggcacaaggagagggagactggaggcagggccagaacagactcacaggtgtgcccagtcaggaccagtgggatggtagagggatacttccgggggaccctgagctgttcaactgcaccccaaaatctggttagagaagaattgtcaatttcagccacagaactctctctcccacaaaaatgaaacctgttttctcatggggttctactccattcctggacttagcaggaatgatggtcaccgatagggacactctggcctcttggttcctggcctgccaggcctccccctctcatcgggctggggagcagaagcagaccctgtgcatcactcagggcccagctggcagggagcctgggctggcagcctgtgtgtgacatctgtctctacaatcctattttctcctctcctgacacggcaccaccacggcgcatgagtagccagcctggaaggaacttagaggaatgcgtgtgggtgagcgcagcagcttgggcccagggcccctgcagggccagggcccacttgggacaatcctcagtcctggggtgccccctcctggttactctgggaaatcatgcaagtcagacttggccagagcaaggattctgaaaccactctcccagacacccatgacacaggggaagaaactgaggcacggtggccagaacaaaacaggggcccaacacatactgtcaaatgaatgaaggaatgagcaagcaggtaagtgaactgtagcaagaagacaaccagcaattgatcctttaaagtatgacataaaacctactaaacagccaatatttgttgagcgctagccacatgccaggcgccctgccaggtgcagagggtgccatggtgaaaacggccttccagtgtggccactgataggaaaccataccaatggccaccagcattcactgggagccagctaagccctgctcagagactgtcccagctaagccacacaggtgacacccacgttcccacaggtgatggtactgcccaaggtcacacgctggtaagaacagagccactgaaatagatgccctcgccaccccccaggccccccacccagaggcccatgaaggacaccacctggggcacagtcacactcgctaatccagaggccacgacactcagtgtacccccagaacagatctcctgggcgtctgccacattgcctccttcccttcctccctctgctcattgtccaactgtcccctgcatacccggtgtcccaggcctcccttctgggcccttcacagatcatgagcagcactcagtaaaccccgcgatgaagggccgaggctccccaccctgaccctcactgaggcttctgttcgtgagcttgtcagtaccacagccccctactcctaatggtgcgcccagtgttggtggatggcagaaaaagacaaggggaggagatggggaaaagcaaactcgtacattttagaagaaaatatggcagaatatcttcatgagtcagggtaaagaaagattatcttacacggcactcaaaaaaaaaaaaggccagagggaaaaaaaatcatgaaattgacttcattattcaaatgaaaaactgctaaggctgggcatggtggctcacgcctgtaatcccagcactttgggaggccgaggcaggaggatcgtgaggtcaggagttcaagaccagcctggtcaacatagtgaaaccccgtctctactacaaatacaaaaattagctgggcatggtggcacacgcctgtagtcccagctactcgggaggctgagtcaggagaatcacttgaacctgggaggtggagtttgcagtgagctgagaccatgccactacagtacagcctgggtgacagagtgagactgcatctcagaaaagaaggaaggaaggaaggaaagaaggagaaagaaagagagaggaagaaagagaaagagacaaagagagaaagagaaagaaaggaaggaaaagaaggaaagaaagaaagggaagggagagaaagaaagagaaagaaaaagaaagaaagaaagaaagaaaggaagaaagaaagaaagaaagaaagaaagaaagaaagaaagaaagaaagaaagaaagaaagaaagaaagaaagaaagaaaaagaaaaagaaggccgggcatggtggctcacgcctgtaatcccagcactttgggaggccgaggcaggcggatcatgaggtcaggagatcgagaccatcctggctaacacggtgaaaccccgtttctactaaaaatacaaaaaatcagccgggcatggtggcgggtgcctgtagtcccagctactcgggaggctgaggcaggagaatggcatgaacccgggaggtggaggttgcagtgagctgagactgcaccagtgcactccagcctgggcgacagagtgagactctgtctcaaaaaaaaaagaaaaagaaaagagaaagaaagaaggaaagaaaaagaaagaaagaaagaaagaaagaaagaaagaaagagaaagaaggaaagaaggaaagaaagactgctgcaccagtgaatcaacaaaggcacagtgagaagccaagaaaacagcctggtttgaaatgatatttgcaatgtaggtaaccgacaaagggctggaatccaggataaattacacactccttcaaatcaataagaaatggaaaaacaactcggcaacagaatgaacacactctctccagaggcactgggcaggagaggaatctgatgaggtgtcaggcagagggaagatgtttcctctcaccaggacagggacagtaaagccatatcacagtgaaacaccatagcacatccatcaggctgggatatgccccgggctctctggaggccagaggctgggctggaagcagttgcaatatccagcaaagctgaaggcaaacacattctccctggcccagcgatgccctccctggcagatgctctaggggactctccttccagggtaccaggaagccctgggcaggaacagccatggcacagtccttttgcagtacaggagtacaaacaaccaacaagcctgccagcctgggatgggtgagtgtatcatgatacattcaaacaccggaacagtgtgcagtgatggaaatgaatgaaatacagccagtggcgcaacatggattcatctcaaaatttctataaatctctaatgttatttaggttttttaaggttttggaagtaacagagggatacatacagcaagatccacttacatagttttaaaacatgcaaaacaagattatatatcgtccatatgtaattatatctgtggtaaaatataaagatatgcattttggggacatagtcaccagattattagtagctcaaggaaaggcaggaggaagagtgctctgggtggggggaggttcacagggtgcttggactgtacctatgatttcttcaaataaaaatttcaagcaagtataaaatatggatatagaatgtaaagatttggcaaagctggctggtggtatccaatgttccttatcaccatctctgtacttctctgaatgctttaaataggtcacaatcattgtaagaggactggttgagagcagcaagtcccctgtctccacactccaagaatgaggggactagaccctcgcttattcctcaggttcctgcatggtgagcacagggcattaatttagctcaacccagcactggtcccccatggatcaccctaataccccaggggctctcaaccctggggcatgcatgactgtcattcaaggtgcattttcagaaatatgtgtgcagggccccacccccagagactgctcctggtggcctgggagaggaccaggggcacggtggtgtttttaaaaaaccacaggcctagtgtgctcaactcccaggccagatcagctggaagaagatgtgcttcaggagccaagcaacaatcctagaccctcacaggctctgctctgttgggcctgcctatctgcacctgatcccgtagtcatttctctctgagccttaacccagggaatgctcacgcctggccttgaatgtttgcactccatccttgggcaggacgctgagctatacaccaggccagtgtttccacttcaacctcatttctggcctctgaggcaggtactttagacatgggaaataacctgtccagggcacacggggagtgaggggaagggcagagggaacccaggttcatctgactcctgggctacaatatctgtttgtccaccttgagctaaggtatccgcttcaaggcctcctatcatggcccttgaaataattccctcgtctaaaaatactcattgcatcatgcgaccaggcaggtatcaatctgccataaatcttaactctcgagccgtggtatcgggtagctgttaccctggactccccatctagtcagcagggccagtgggacaggaactgtatgcaacattgcctctgggacgggccttctttatcccttaaatgtgtgctatggtatttcacaaaagaaaacatttacaggacatccccttttaatcatcagggaaatataaattaaaaccaaaatgagatactactacacacccaccaaaatagctaaaataaaaagacagaaaaaaatctatgattaatgaggatataaatcacctggaactctcatatactgctagtggaagtataaattggtacaagtattttattcattttttttagagacaggatcttgctatgttgctcaggctggagtgcagtggttattcataggtacagtcccattactgatcggcacaggagttttgacctgctttgtttctgatctgggctggttcacccctccttaggcaatctggtggtccccccatctcgggaggtcgccatattgatgccaaacagtgcggacacccgactggcgtagggcactacagcctagaactcctaggctcaagcaatacacctgctttagcctcttgggtagctgggacatggcatgtgcagatgcaagtattttagaaaaccattgggtagtaccttctaaaagctgaacataatcttacccaggccagccattctcttcttaggtatgtttcaaaataaatgcatatacatgtccatcaaaagacatttataagggtgttcatagccactctattcttggtagccataagctagaaacaattcagatgtccgtcagcaacggaatgggtaagtaaactgttgtatactcacatagtgtaaataccatactccagcataaacaagcaaaaatcagtaatacatcccacacgtaaatctcagaaataaaacgttaagcaaaagtagctacaagcaagatattacaagctggatgtttccatttatgtaaagttttaaaaggggcatcatctatggtcttataaattgaagataccatttatcattggtaagggtaatacccagtatgggcatgtgggaagtttctggagaggtggtaaatactctctacatgtcttgattggggtggcagttacaccacatgttcactgaaaacaacttgaccaaatgttcgtttaggatatgcgcttttcttttttctttctttttttttgtcttaagacagagtctcgcactgtcgcccgggctagagtgcagtggtgcaatcttggctcactgcaacctccgcctcccaggttcaagcgattcttctgcctcagcctcccaagtagctgggattacaggtgcccaccaccatgcccagctaatttttgtatttttagtagagacagggtttcaccatattggccaggctggtgtcgaactcctgacttcgtgatctgcctgcctcggcctcccaaagtgctgggattacaggtgtgagccaccacacccagcggatatgtgcttttctaatatgtatgttgtaatttaataaaaagtggacgatctacaccctggtacatatgtgacctggagaggagaccgacggacaacttgagtgcccgacagatctgtgtgcaggacgcaagcctacctctaggcacctggaccagctgcatgtatgccttgtacaggttcccccggcagactgggctggggtcattcagcaggaaggacagggcaaggacgatgtcgtgctctagaaaggcgtatctagggaagggagggtggacagtgacataagtgagaccatgccctgagaggctcaaattagaagagtcagggtccctgctggagtctgatccatgctatctggggtagaccacattcctctggctttgtgggagcagacaaaggctacaggtgcgtgatccatctcacctgaacctccaggggagcgagctcagcaggcccagcccaccttggccccttgttcttctggtctcccttgcctccacatctatgtacaccagttatgcttgttgttatcattatataagttcagtaaatattaggcaagccaattagatgagaagaggattttctttttcaaatttgtttatgagaaaaagttgaatgctttggaaggactcaaaattgagccccaactcccaaccaaaaaaaaaaaaaaaaaaaaaaaaggagatgattggctgggcgcagtggctcacacttgtaatcccagcaccttaggagacctaggcggatagatgacttgaggtcaggagttcgagaccagcctggccaacatggcaaaaccccgtctctactaaaaatacaaaaaatcaaccaagcttggtggcacatgcctgtaatcccagctactcagaaggctgaggcacaagatcacttgagcccaggaagcagaggttgcagtgacctgcaactgcaccactgccctccagcctgggtgacagaatgagactgtctcaaaaaagacaaaaaaaagagatgattgtaaaagattctagatagctcacacctaatcccagtgctttgggagactaaggtggtagaatcacttgggccaggagttcaagaccagcctgggcaacatggtgagacccagtccctactaaaatgttaaaagttagccaggcatggtggtgtgtgcctgtgttcccacctactcagtaggctaaggtgggaggatcgtttgagcctaggagtttaaggctacagtgagctaggatcatgccactaaactccagcatggatgacagagctagaccttgtctcttaaaaaataaaaagattctaggccaggcgcggtggctcacgcctgtaatcccagcactttggaaggccaaggtgggcggatcactaggtcaggagatcgagaccatcctggctaacacagtgaaaccccgcctgtactaaaaatacaaaaaaaaaaaaaaaaaaaaaaaaattagctgggtgtggtggcgggcgcctgtagtcccagctactttggaggctgaggcaggagaatggtgtgaacccgggaggtggagcttgcagtgagccaagaacgcacaactgcgctccagcctgggtgacagagcgagactctgtctcaaataagtaaataaataaataaatataaattaataaataaaaagattctagaagggttttgcatacaggttatttcattaatgtctttgagttcttgctctactttaaaaaaaccaaagctgcaaatcagacgatgttatgagtatggtttaagcaaaaaaaatatgataggaaacaccaaccagtggtctcatatccgacaaaaagcctgggtcccacatggggattgatgaatgccttatcatttgtgttttgggttaaaatgaaccatttaaaggaaaccatttcttcagttccttgctttgtaatcatttcttttgattaaccaactgactgctgggcctgaatgcatctgaaagaggccttctgaggtcacgtctctgagggctgggttcaggaatgaatgagaatgcatgtgcaaacccctcagccaagtgcccacaggaagtgcccaaccagctgtgccactgcggcatttattataaataaaaataaattttatttattttatttatttatttattttcacttatggtgtgttttgaatcgtctggaaaaagaaagtcaccgttggacacacaagttgcaggggtcttccctgaccacgggggcttccttggtccgtgtctagtcacccactccatgtctctcatgctttgatagtcagttgtgtttgcctgtgtgcctcctcaccagaggcaagcaagagggcagggaacaggctgccaggaagctctcttgtccgtgggatgtcatgcaaattaactcctcaaggtgacaagatgccaagcccagggctgctatcctcattcccccttcctgtcactacttctgtgggtagaagaggcagaagagtttcaacctgggcagttcagggcagctacttagagcttgatgggctctgaaagctattgacattggttataagatcaccactgacctcaagggaaatttagaagttggccacatttctgagaacgctgaaggagtgcacgggccaggccattatcaggtccctggtcagggatggtcacttcaccatgtcttcctgccttgctaatgtgggcacagccaggacccctggcttaggcactctaggtgctgctaaacaaatccttactaccattcattataagtaggttgatgcaaaagtaattgcggtttttaccactacttttaattgcaaaactgcaattacttttgcactaacctgataattgctcaggcttcagggacctgtcctctcagcatctgtcccccctaactggggattactacctaatgtccacatcaggtccagaaaagtagggaggaaaaaccagcaagaaaggtgacttgactcctgtgtgcccctaaccttttaaagcaccttgcctgggtcatctaagatctgcagagtgaggctgggattaggattgttgcccagatcacagagcaggaaagagtgggccccccaaaaggctggggcttgtgtccctacttcactggtctgtctgcagtgccagcctgcccttcttggtacaaagcatgtgaattagggtgctagccatggcaccacctccacacacacatgcacggttcacacagggccggggctgcacacaggatcagccaccaaggcagcgagagcttggggactagcagggctgagtgactttgggttttatgagatgccctgcagcctctgcctctctgggttcaagcaattcttgtgcctcagcctcctgagtagctgggactacaggcatgtgtcatcatgctcagctaatttttgtatttttagtagagactggtttcaccatgttggcctgtgtgcctcctcaccagaggcaagcaagagggcagggaacaggctgccaggaagctctcttgtccgtggggtgtcatgcaaattaactcctcaaggtgacaagatgccaagcccagggctgctatcctcattcccccttcctgtcactacttctgtgggtagaagaggcagaagagtttcaacctgggcagttcagggcagctacttagagcttgatgggctctaagtaaaggttaggggcacacaggagtcaagtcacctttcctgctgttttttttcccttcaaatcctgaaccgatttgaagcctctctgaatggctgcctgtttacaccaaacaacccccaaggcagtcagcaccttgcctttcttgtcttttcttccttctgggcctgtgcacactgggcagtggccccctttatccgaaagacctgggccagggcttgggggtgtttgtgatgtggggttctgtttttttggggggtggggacgggggctggtggggagaggttccagtgaaaactggaaaacctgctagaaaaattctaaaagagctgtaacactggggttttgtttctaatacaaagtaaaactactgatcgccagtcaagagggtgaacccagctgatgtgggaaagcacctccaaccaccctcaccctgttgccccaacacctaactaaaatactctataaaattttttttaagtgtaaaaagtgaagctgtgcttacacaggaaaaggacacttccaggtgccagaaaccaagaactcagccatcatgaacaggaagtgaggccaccagaccagatactcactttgaggatgttattttaacaccctcacagggacaggagccaaagccacagcccctgtggggatctgggttggggaactgggctctctgtaaaaagctaagaagtggcaaaattgttgcagaagtaagatctgaactttcttcccaccttgaaagtgggaagctcagctaggtgcagtggctcatgcctgtaatcccagcattttaggaggccgaggcaggcagatcacttgaggccaggaatttgaaaccaggctggccaacgtggtgaaaccagtctctactaaaaatacaaaaattagctgagcgtgatgacacatgcctgtagtcccagctactcaggaggctgaggcacaagaattgcttgaacccaaagaggcaggggctgcagtgagctgagatcgtgtcaccgtactccagcctgggtgacagagtgagagactgtctcaaaaaagaaagaaaagaaagagagagagagagagcgctcagagcttggaactaacataaaataaataaaaatcagtctggaacagagggccccataagatccacacagaggcaaccaaaaccaccccacaaagagtcctgctctggctaaatagaagcccctgcaaaaactgatgcggcagacaacactccagagcactctaagcagctcaagtgcatccacccaggggagaagtgcggctcgcaagcgtcacactggtttccagaacagcatcccacctgcccacgctatggcttgccgtgatgtggagcacctcggtggtctttatgcgcaccatactgttgctatccttcagcaaagctttcaggttctccatacagcctagaaaaaaaaaaaaaaacaaacaaaccaacccttgaatttttgccagtctcagaaaccaaccaacccagaagtcaataagtgggccagttggggcaggaatgtaccagagtttctgctgctttggggcactggggaatcatgttggttatgcagcatttcagagtcactgaagaggctcatgtctcatccaaccctccttgtgattctccctgcacacttcctaccagtgacttctcacaaagtctgtcatgaggttaagaaaatggcctttgccatttctttgacctcaggagagatatggggtcaaattataaccctgtgtcaaactagtcatatgactttgagtgggttacacctacggatgccagatttagcaaataaaaatccagctttggccaggtatggtggcttacgcctgtaatcccagcactttgggaggccaaggcaagcggatcacctgagatcaggagttcaagaccagcctggccaacatggtgaaaccccatctctacaaaaatacaaaatattagccaggcatgatggcaggtgcctgtagtcccagctactcaggaggctgaggcaggagaatcacttgaacccaagaggcggaggtttcagtgagccaagatcgtgccattgcacttcagcctgggcaagagagcgagatgccatctcaaaaaataaataaataaataaataaatacaaatctagctttatttatttattgggcaaccctagacttacaatccttctctgaaccatgcttttcttatctgtgggttgagaatggactctcccctgtaggtggcctttctaaggattaagataatccaggctgggtgtgatggctcacacatataatcccaaaactttggaggctgacctgggagaatcaattgaggccaagagttcaagaacagcctgggcaacacagcaagatcttgtttataaaaaaataataataagaaattagtcagccatggtggtacttgtagtcctagttactcaggaagctgaagcaggaggatctcttgaccccaagatttcaaggttacagtgagctatgattctgccactgcactctagtctgggagatggcaagaccctccctcaataaataaacattttttaaaaagaacccgggcaccgcacctatagtggaactggcctggagtcaggctcaaacaatagcaacccttattactgaagttctacccagtgcctgaagccatgctaggaccccagtcatggtcacctgtgctgtgtcacgctcacctatgttcatggccttgtagatacactcggggtcatgcatgaggtcacacaaggccatgagggctttctgcctcgtctggaggtcctctgactgcagctcctccttcagcttgggcagggcccgatggccataggcagtggtaatctgggtggcattgatgttaatgggaagctccaaggagttctgggaatgggccatctttccccaactacagaggcctttccaaatgaagctctgcagaaaccactcactaaaagagaccaaaaagctgtcattatttctattatgatttaaaagctacttctcatctgatcctccaaactgtgagggcaggcaaatgggtatttttactttcattttacagatgagcaaactgaggctgagagcaatgaagagatttgctcaaagtcccagtgaaggtaagtaagtagcagcccaaactgcaaactccagagccctcccacacaatagtgcttcacagaagaaaccactgatactttcatctggatcttcagtcaaaggcattaaaggacaaaacaaaccaaacaagcaaactccaagttggtcactctgtttagtgcttaccttgtgccagcaataagtagtatccaattcaactaccccataaggagggggctggtattatccacattttacaaatgaggaaactgaggttctggccaaggagcttactggaggccatgaaactggtaagactagaagccagtgttcaaatctgggtctagctcattcactgccaggaacccatattcagatgcttctgacacatccatgaaaaggaattaatgttaaaaggtgatttatggccacgcgcagtggctcacgcctgtaatcccagcactttgggaggcccgaggcaggcggatcacaaggtcaagagatcgagaccatcctggccaacatggtgaaaccccgtctctactaaaaatacaaaaattagctgggcgtgatggcgcatgcctgtagtcccagctactcgggaggctgaggcaggagaatcgcttgaatcagggaggcggaggttccagtaagccaagatcgcgccactgcactccagcctggcgacaaagcaagactccgtctcaaaaaaaaaaaaaaaaaaaaaagtgattaacttttattgccgacacacacacacactttcagcaactatgggcagtgtaggttagtagttaagaactggctccagattcaggcctgggtgaccttggcaagttacttcctctatctgtgtctttctgcagcttcaaaggggagatgataacagtacctccttccctgcctcccagagttgtcatattaacgaatacacgtaagcctggcataccagggcttcagctatgttggctgtggttattattacggttattatcatggttagtagaatggacaggccacaggcctgtaggaatctactccagtaaaaggtaagccagatgctcacgcgggacaccagatgacaacggtagaagtgggggccggactgggagggacgtggccatgtttgagttgagctcccctcacaggaacggtgggtgctggagacaggggcctgccttcttctaagcggcgtgggctgggagagtccggccggagacaaaagaccgtgattttgagtgtggggacacggccccgtgtgaatgggactgggtgggtcactgggcccccctgtccccgggcccctagcccaccaccgccgcctcacctgcctccgcagccctttctgcttccagtagcccgcgccactggccaacctattcagttgccaggcgacatcgttgccaggcgactccagcagcgtccgcggcgccgcggtcgacataatcagcacccactgcgcaggcgcaaacagcccaaggctgcggccggctgcaaagcgggaacaatcatttacagggttgctgtggagaccaaaggcagctcagctttgttcaaagtacagaagggaaaggaagtgacttatttacgcccttctctgtactgggtactttgcatgcctctgatcctcagagtaaattcataaggtggtaacatctagtttagagacaagaacctcagagaagttcagtcgtttctcccaatttttttttttgacggagtttcgctctttcacgcaggctggagtgcagtggcgcgatcttgactcactgcaacctccgctccactccgcgccaccgcacccaacccgggtgcaagtgattctcctgcctaagcctcccaagtagctgggattataggcggccgccatcacacccagctaatttttgtatttttagtagagacagggtttcgccatgttggccaggctggtctcgaactcctgacctcagatgatccacccgcctcggcctcccaaaatgctaggattacaggcgtgagccactgcgctcagccagtttcccccaaattacataggcctgatctcaagactgcctagccctgcccatgccccttgctcttcaggctgaccgcctggtaatgacaaaggttagcctctgcagtggacccaacacactgctggccagcgtagctgttctcaaaagcaagccagacccagccaccacctgcataaaaccctccatggctccccactagtctcagggctgagtccaaactcctagcctagtgctccagtccctgggtgatggcctcctccagccatgccagactctctcttaacccctcaaatgccacctcgctcatgaagcctgagcgctctgtaacactaattattacctctttatccttcaggatgcaacttggtgaacacttcttccatgaaaccttccttctccctgaaggagtgaagtatgggccatcccaaaatatgctggattggtatattgaccattttgagtggacaacattggaaaaatagtggcctcagaaagggctaactgggccaggtgcagtggctcatacctgtaatcctagcactttgggaggctgaagggggagggttgcttgagcccaagagtttgaggttacagtgagatatgatcacactactacaccccagcctgggtgacagagtgagacctcaactctaaaataaataaataaataaataaataaataaataaataaatagatataattttaaaaaaagatacaagaaaaggcaaacagatatgcttctttctgcattcagcaagccataaagattcctctaggagcggtaccctcactgtaccagggcaagaaaatagcccttgtcacctgagactaagaattggggactgcaatggacctgaataaatatacttaaccctgtcttccactaagtttatgcccctcatattatctcctagtgaatcccctagaatttactgccctagccagatcccctttgtcctgccatttcttctcaaatttgtcatcctttgtctaaaaagtataaaagcatcttgctttggccacttctctagacttcactctggtaaagatccccatgcgcatgtaaaactaataacacttgtatgcttttctcttgctaatctgcccagtgtcagtttggtttctagatctaggcaaagagcccacttaagagctaaaggaggattggggccaggtgtgctggcttacgcctgtaatcccaacactttgggaagccaaggccggcggatcacatgaggccaggagttcaaaaccagcctggcacacatggcaaaaccccatctctactaaaaaaatttaaaaattagccaagcatggttggtgcgcacctgtggtcccagctactcgggaggctgaggcaggagaatcgcttgagccgggaggcggagattgcagtgagccgagatcacactactgcactccagcctgggcgacagagtgagactccatctcaaaaaaaaaaaaaaaaaaaaaaaaaaaacagctaaaggaggagttcagggtgatctctagctcctgccaaatccccaaatccaaattagtaagtgaccccacagcttaatcttcccttctcctaaatcccattggcacactcccttcccctaattctctatttacttctctgcttcccgcagtggactccaatttccctgagggtggacaccatgtccgttctctttccttgtctccccagtgctaggcatataccaggaagctttcagtacatgtaggacaaatgaatagttaatggacttgaatcaagctttacagtataaaagcactttcaccatctcaggtgatccattgaaatagatagttgcgtttattttatagttgagtaaactgaggtgcggaaggtggaacaactcacctaagttcaccccctaagcctcaaccttagcagtgaaactcactaaaagacattaaacagagccaggtgtggtggcccttgcctgtagtcccaaggactggggaggctgaggcgggaggattccttgagcctaggagttcgagtccagcctggacaacatagcaagactccatctctttaaaaaaaaaaaaaaaagacatcaaacaccagcctccagcacacttagctttgaattgaagatgactgagttagatctgtgtaccaaggcttccatattgtgatgcagaaaagttaaggagctgaattaagtaggttctcaaactgaaccccggacttcgaagctggttccacggttttataagggccacaagaggccatctagcccaaaacagctaactttccaaaccgaaactagttcagaggaaatcactgactcaggtcagctttttattaaggaaattaattttgtaccgtgagctctagaagccaggcatatgatattcagacagcactggattcagaactatgcagactaaggtcagtagatggtaggcaggtctatcttctgcagctgcagggtgcttgactccaattaaacatcaataccacatcaggagctcttatgccataaccgcccaacctctcccagccgagctgatcaccagaacctgcgcgaatctctccacggtcagccccacccagggctcaggctccgcccccgggcctccatagccccgcccaccgcccacccatccagcaccgcccttgttgtcatggtgatctccggctctccagggtgtccaggagtctctctgctgccagccccgcccagactccaggcaggttctcgttgctatggtgatcgccggtgcaagctggatgcttggacgcgccgctgccagtccaacgcagaccccgcccacgacgtcgacgattcgtgtagcccgcaggtcccgcgtggctctcgttgccatggtgatcgccgccgctggctcaggcggaccaggccgcgcggagccccagctttcacagccatcgctggtgagtcagctcgcccactctgtccgaccctcccggtcacccaaccccgtgctggcacatcccgaggccagggccgcgagggcacagcgtccgcgcccacttcccgcccctataacttgaaagcggcctgcggccccggggcgtcctcatttccggagcgcaaactctgggccaggcccgcgctggttgtggaggagagccaggtcagatgcgggaagacaaccggactccgccaggaccaccccagcccagcctggagaggagtccggacagaaaaaggagacagaggggctgttgaggaggctcgaggagtcagaggcctggtgaagtgagggttttcagggaaaaggcctagttggctgaaagttaaggcccccaggcccacctagagccttcgtcctttgcagactgggagcaggagacccctccccactctacttccactgcctgagctgtgccatgcctcacagcccagtaaggtaagctcagaggggagctcctccttggtagacacctgtcaaggggagacccaggtcttctgactcccaggcagggtggggcaggcctggttcccccataccatgctgcctgctgtatgcagattgagagaaatggcctctgccccatattcctgacagagagggaagcctggatctggttttatttataattcttgagacaaggtcttactctatcacccaggctggagtgcagtggcaccttcacggttcactgcacccttgacctcccaggctcaagcattcctcccaccttcctcccaagtagctgggactgcaggcacaggccaccatgccctgctaatttttttggtttttttttgtagagactgaggtttcactttgttgcccaggctggtctcaacctcctgggcccaagtgatcctcccaccttggcctcccaaagtgctgggattacaggcatgagccactgcacccagcctggatctgatgaaaagttaggtggaaactcatgggtgaatccccaggtatttgcacagctccttaactgtctttctcctggttgggtccacaggactgtggaagaatgaggtcctccctgacacctttggggccccctgtgagccgcgaccgtgtcatcgccagcttccctaaggtagagagtcattacgtctgcagtgctctcctggccctgcagccacatcagctctccccactctacactcatgcctagaagtaaagcaggtgaatcaaggaggtctgtccattgtcagatttaccttgaggagctgggagactggtcactgactgcccaaggtgggaccgcaagttaatggtgacactgggcagcagtgtggcctggaggttataagggctgggattttgcagccagacagtccttgatgtgaatccttcattctgattctgtcattaagctgtgtggctgtgggcaaattactcaacctctcagagccactgttacatgaaggtaattcctctcatattgggtgcctggctcatggtatgcaggagctcccctgcagtcatagttgctgttgttctcatcatcgttgttgttatcaaaacagcattccagttccatgaccccaaatccagggctctctcctcttgccattccgcctctatgagcttgaaaactcacagctctcttgtgtctgtattaaaatccaatattaattgcagcagggaatacaaattgagtacaacctccatagggggcagtggacaatatttaccaatatagaagatgaccctgccctctaagatccagccattctgtttcttttttcttttttttttagagacaggatcttgctctgtcacccaggctggagtgcaatggtgccatcataattcactcctctaactcctgggctgaagcaatccttctgcctcagcctcccggagtagctaggaccacaggcatgtgctaccatgcctggctaatttttaattttttttaatagagatgaagtcttgctatgttgcccaggctggtcttgaacccctggcctcaagcaatcctcccacccgggcctctcaaagcactgggattataggtgtggaccaccacaactggccttgctattctatttctaggaatttacttggcagatattctggcatgggtttacaatgtgcataaggataggggttggagcagtttgtaagaatagaagataagatacaacgtaaacatcctcggagaggggactggttaaacaagtaatgcttcctggcacagacatgaggaagaatgaggcaacctcttcaggagctgacatgcaacgagagccaaagtaaaccgttaagtaaaaatgcagggcatggaacagagtgcagtagagtgtgtgcagcacactccggtgtgtgaaaacaaggagagggagaaatgtctatttgtttatatatgcagaaaatatttctggcaggatatataagcccctactctcagtggttgcctctgtggcttcggacaggtgcagagggatagatcctctccatggaatggccttttttgcatcttggattctgtggccaggctggtgaggaggaggtgactctagacaggtcctgggtatttggagtatgtggctcttcctccttcccccttctttaccttcctccctaagttccttcttcacacacctacagagaaaggctttgtgtctcagacctgtggacagttccccatgggttttccatctcaacagaggctcaggcaattattctctctgcagagcttgacagtggtaactagggatgacagagactggtctttcttgagtcaaaaggaaggaaagtgtgattggcacaaaacagtccaggtatcatgagatgaagaacctcattggcagagcagacggcgaggatcagagttaaggagggttgcctgacatcacacagctgctcctggtacctctgggatttgacctggccgtgtctggctccagagcaccctaccccagggaagcagcttagggaatccatcctggtttcacaggtggcattctcccctcctgcccataatagtcagggatcaaggccactgctggtcaagttcatcctgcaccccagggccctgagaaattcagtcaggttgagcagggtcttcagactgcttgccaggcaagtccttccctttatgccatgtgcctcagtttccctgtctctgaaatcagctcacacttcttaccctgcagccttcattatcacagtcttccagccatcctgtaatgaccattgtgtctgagccagtccctagcttaaagctgtcatggaagctgacagaaagaagcagccagcttgttcatggtagctgctgctcttctgcaggaaagtagactatcaggctaagctgctcacctgcattattcagttactcctccaacgaccacatgaaaaggtgctattatgagcatccctgtttaatatttaaggaaactggagctcgataagtttctgtaacttgccctttgccagtctcctttcaccatccctgctgcctcaatcacagctggaactgagagggcagatgggccaggcagagcccgaatccatggttgagacactgcggctgagggaggggagctgtggatccaagcagtgttcagagggacagagcaggtggctgtggctgtgcaggggtggggggcggggggcgggacccttgccatacacagatcacaccaacagcctcaatggtgtccttctccccacatccttgccacattctgtatttagcctgggccaatccaatggcaaaaaataatggtcatctttagtttgtttaatctcatttttttctaattacagaccaggtgagggtgggtggggtacgtgcagttttttctgaccctgaggcccatgctcttaaaccactgctcaggtctgccttccaagaaacgtggacagcagaaagcgcctcctaggacattttccaggcacatgtatgcatgtttttaaaacaaaatgtcatcagagattcatagaaggtatggattagagacagggtctcactctgtcacccaagttggagtgcagtggcatgatcatagctcactgcagcctctgtctcttgagctgaagcaatccttccacctcagcctcctcagtatctaggaccacaggcatgtactactgcacctggctaattggatcttggaggatcttggcaccaaaagagctccactcgtctcgccctgagagggttgagacccagagcagacaggcctgtcacatgcatgcagcaagggaactgcggccccaggtgagacacagatctccaagtccctgcctgggctcgcccctctggactcacaaggccccagagcctcaaggctgaggaaatagaagatacacatgacaaatgggtcagggaaagctaatgaggctgccagctgtgaggcctaggaaggaaggctgggaagatcatctcccctcactgcttggctacgagggcggagccacagctttgcaggatgatgtgtccgtctgtctgtctctttgcagtggtacacgccggaagcctgtttgcagctcagggagcacttccacgggcaggtcagcgctgcctgccaacgcaggaacacggggactgtcgggtgagcctgcagggtgtgggatgggggagcaggtggcaagaaggaatgagtgcatgaagcacgtgaaagaatgaacaaatgaaacacacacacgaggctggtgcagccctgtacaggcctgaagatgactggggttttcttttttttttctttttttttttttttgagacagagtctcgctctgtcgcccaggctggagtgcagtggtgcgatctcagctcactgcaagctctgcctcccgggttcatgccattctcctgcctcagcctcccgagtagcggggactacaggcgcccgccaccacgcccggctaattttttgtatttttagtagagacggggtttcaccatgttagccaggatggtctcgatctcctgacctcgtgatcagcctgcctcggcctcccaaagtgctgggattacaggtgtgagccaccgtgcccagccagatgactggggttttcatctggcttcagttaacacacctgccatatggaacaactttccctcttctaagtcacgcaggtgatttttcagcctcaggtcttggtacaagttcatttcctctgtctggaatgtctttcctaatcccctcgcttccccttccccttccccttcaggtctcagcgtgtcaagtcctctgggagccttctctgaccccccactacccttgcccctggactggggagggtacccctcctgggtgctcttgtgcccccaagaacttatctcacagaattgcaggctggattcctcactagacctagcccaagagggcgagggctgtgtctgtcctcttcctgccgcggcagctcctgccaccactggcagagggattgtgaaatagtcattccttcttttaacaaataggtacaagggcctgcttttgcccctcttcctaaggagctcatagtctgctcagggagttggctgagctcacaggggtcacagaggtgcgatgaggctgccagagagcgcagctagaggttcccaaactgcacagagtgggtgaggcagagctgagatcagaatagccgaagtggccatggtggtgggatgagagtaatggcatctgttggggaatgctggtgccatatcaggtgcttcacacagatgatctccctgatcccttatggcagcactggaggtggggaaactgaggatcagagggtacctgctgtaagaccttgtcaacacctttactcattcataggagaaatggagtcagaacgaaagggccctctgggagcagggtagacacaatccctgctctcacggacctggcaaggtgacctgcagcccaggtcaccaggtgacacagtggtgccctcttgctgtctgcaggcagaggaagtgcctgtcagatatttacccaggttggttgctgtgaccatttggctccttggggatgagctgcaaaaactcttaaagtgttgtcaacagtcccaggaagctgggacaatggcacctgtagtcccagttactcaggaggctgaggtgggaggatcactcgagccaaggagtttgagactactagcctgggcaacacagcgagaccctgtctctaaaaaaataataaacagtccgagaaacgcctctgcacagagtgtaggacacacagagggtgagggtggcggctgctcttggggaacagtgacccacagagagcccaagaacctcagagccgatttgcctcaagccacagcccggatgcatagagcctcagccctgttcggggtgtgccccttggcctgtcggacccttacagatctctaagtgagcagggcacggtggtgtcatggtcagggagtgcctgcttgcaagaggccggagcccacatcggcgcacagccccgggggtgcataggagggtgaggggctgcccgtcccttttgccggggtctccctgcacgtggaccctgtgtctgcaccctcagcacagctcccggacagcacagacgtgcccacggctgttggttggttaccacagccacaccctggcctcctgcctctgcccctccacctgtgactcggcctcttgttatgcccattcctaattctcaggatggggactttggccaaatatggtgaggggtgcagctctaggggcagcagagtctccagcctctcccgtctcccctctggggactgtgaagggggaacacagtgtctcagcagggtggcccatcctgtgtccaggagtgaggggtgtctcaccagcagagagctcagggaaggaaggggctgtgagtgtctgaagacaccctggaaggcatgcccgacggcaacacggccatatttctcacaggctcaaactctccaaggtggtggtggttggcgatctctacgtggggaagaccagcctcatccacaggtacaaggcttcctctgcccctttggccacctcccccagcaccaggttgtcatacctttgcctgggtggcccagataatatcaacatagcagaaatcatgtggcttccaggaactgctgtgcctcagcctgctgggagccggataagagggggtgcaagaaatcggggagatggcagggctgggcagaaattgtggcgtcccaggagcctggcgcttgtcagactgtccccctggggccacgggctctcccctccactgccctccctgcaaatggctgctcagtttcgctcagtttctaactcacagcttgccttccgagctcctgcagcctccctttccccacattgtccttgctggctgccctgcccacccatggcctgcgtggaccatcgcttcctgatgggaagtggaccttatttgcctaaagacttgcagtgttacaagtgaagcttccgggcacatttctgtgagtacacccctgtgacgacttcctcatcccccacaggttttgcaagaatgtttttgatcgagactacaaggccaccattggggtggactttgaaattgagcgctttgagattgctgggattccctatagcctccagatgtaagttgctggttcccccatggctcgtgggcagcttcctacaggcacctgagaaaggatttggggagctccttcactgtgtccatgtcaaggaggactagtctagacaagcagagcctgggggtgttgtgtgacacttagcttcctggctcccagagcccccacatgctctgtcagtcccaaagttgtctcattttggtcattggctctggggaaggtgctcacagcctgacctgcccacctgcccatgacctccccaatgcccaccccactcctcttgaggccctggctccagtccctccctgacctaggcctcctgtgatcccactcaccaggccagcagggtggcctcccgcaggttgctgctgagctctgagcctctgttcccacctgtaaaatggggtcaaatccagtccctgcatgccaggcttgggcaaggagggctgagatggagtacacagcacccacatccttcctcaggtctgaggcactcgtcttcctcctcacactgcagccttcactccctctccccagcctcactttccttccacttctgtcttttttttttttttttttttttgagacagagtcttgctctgtcacccaggctggagtgcagtggcgcaatctcagctcactgcaacctccacttcaagcgaatcacctgcctcagcctcccaagtaggacaacagctgtgtgcccccacacccagctaatttatttttgtatttttagtagagatggggttttactatgttggccatgctgatctcgaactcctgacctcaagtgctccacccgcttcagcctcccaaagtgctgggattacaggtgtgagccaccgtacccggcccacttctgtttgtcttccttgctaggccctgggagtctgactcacgatggcctccactggccttaccccttccctctgccttccatctgagtggcccagggccactctcccaccccttaccctctcccaccccagctgggtagcttccctctgccccggcacctggagaatgctgcaggcctgcctgggctcgggccctcacctctactctcctgtgagacccttccgtgctcccctacatggctagccccgcccccctcctctccacttgcctgctggcattcaccaagctccttcctggtgcctgagttcgttcctcaatcctccatgccctgcctggactgagccttcagatcctgtggatgtcagttcctaactctgtcgagatagtgcccccttctctcaggacttccacagccccagcaaagccctggagatggaggataacaaatcttgcccaagggagagtacaggccagtcaagagcaaaggaggctgggagagaacgcagggctgcaggactgagggatccagagagctgagaagagcaaagggccagtgggggtagctgaggtggagccgggaaagactggctgggggctgggctcacccgtgtgaccacaggccatatctcattagagggccctggacaaaacagggacactgtcctggctcagcctctcattgtcttacattgaggcctttgccagcctccctacgggctcatctctaggccaccaccaccagctcctcccccagagtcttcagaaatgaaagaaaatatgaatgaattaatgaaagaatgaagcccaaacttctgtgtcatactggatcacttgaaaaaaattcagaccatgaccgggcatggtggctcacacctgtaatcccagcactttgggaggccagggcgggtggatcacctgaggtcaggagttcgagaccagcctgaccaacatggagaaaccccatctctactaaaaatacaaaattagccaggcacagtggtgcatgcctgtaatccaagctacttgggaggctgaggcaggagaattgcttgaacctgggaggcagaggttacagtgagccaagatcatgccattacactctagcctgggcaataagagcgaaactccacctcaaaaaaaaagaaaaaaatcagaccatagatgtcttgtttgtgacttgtctactttgcagtttactgagaaaagttcaattttgatcagttgacctcaaaaagcgatggattggggaacaattttccgactcagccctgcatagtgactacctgccttgttctaagccagggcaggtagatctcagtaggtgctctttcccctcttctagactgtgcccatggcagacatcattaatcgattgttgtactcttttccatggagccagggctttgcttctaatttcttctcactactgtgctccagagagctggagctaactgctgagacccacctattgctccagtgttaggtatctccaactcctactttgggacctgcagtgtggaaggtgaagcaatgacccagtcacacccatcacccaaccaagtggcagagccactgctggaggccccgcctggagccccagtgccattcacagagccttctctacaagtggactgctacatcttcagagcgagtcatgtcttgggccgtatgttccattttaatgtctcagtcagaagggagtgagctgcaactccatccatccaggcagcagaacaactaatgccacacacccccatccactaggaatgagagaagtccactgggggcaccctaggaagagatcataaggagctgggggtagggacatctggctcacaacaggcacttcctgaagcccatgcagctggcacaggcccttagggtctcccacccatggtcccgtagcctgttggctcaagacactgtgattgtgtagcctgacaccatttccctttctttctcacccacctcacagctgggacacagctgggcaggagaagttcaagtgcatcgcatctgcctactaccggggtgcccagggtgagcaacatgccacgtcggggctcaactgcatgcagcagcggggtccctgccgggctccacagtgggaatcccgagttctctgcacaggcaccagttttttgtcctccaagacccactgagaaaacaccaggccactgcttgggaacagggaagctgccttcatccccaggcactggctgactttggcgatcacaccctttaaggaccctgtggtagtgggtgctggctttaagtctcagccccagtttcagctcataaagatgctcagagatgaaagtgcttttccagaggctcagagaagggcagcactggactccagggggaggtcggaggaggcttgtcctgtcttagcagagggggctgggccagggagtaggagtgaaagggggaccacgggaggactgggaggccccaggtgggggccagcagggccggatgctcaccacttccatggccaagggcagccaggtggtgctgggcagggctcaccgtcagcagggggcggcagcataagctccggatgcctaccccaccttcccaggaagaagacagaaatggatttcagtgggagatgtgagagaacctcaaaagtatccaaaaccagactcaaattataaggcaccgatatgtctactcggtagtggtgaaaaagttacaacattttcttttagacttaaaagaagcaaaaataggaaacaaaccaggcagccctcagccgtgggttggagctccagctctgccctggtcgcatggcctcctgcacccttcgcctcttcgggcctctccttgaaaggatgcttctcccctgggaataagaggtgcgaggcgcctggcccacctctccacatggcagcctggctgccgtcatccctttcctcagtttcccccttcctttctcttcccatctgccttgggaggggcgtgggtctccctgtagccttcagccaaggtgcagaggaagcccctgtccggccctggtcacacccctgggggcagtagagagcatttgcctggaatgttctccacatagggctcccctcaggaccccaacaggaccggggtgcggccagtgatgagaggagctgagggcccaggctgcatctcccggttttctgcccacctggctccccggaagttgtttcgctaaagcaggttgttgctaaccatcactgctgtagctgctgttggttgaaatgaaagttggccctggactaacaggttttttttttttttgagcctgagtctcgctttgtagcccaaactggagtgcagtggcgcaatctcggctcactgcaagctccgcctcccgcattcacaacattctcctccctcagcctcccgagtagctgggactgcaggtgccggctaccacacccagctaatttttttgtgtgtgtgtatttttagtagagacggggtttcactgtgttagccaggatggtcttgatctcctgacttagtgatccacccgcctcagcctcccaaagtgctggaattacaggcatgagccacagcgcctggcgactaacagctttttaaaacagctgctcttgtttaatcctcacagcaaccctgagagctacaggtctcgtcctcgccattttacaggtgggaaaactgaggctctcagcagttaaggccctcacctgagctcccttagccgtaagtggcagagggtgtctgacgctaaagcccatgcgctcgctccacgcctaccttgtcctgcctccctggatcccacactgaggctgggctgccgggtgcaggctggagggtcccggtgggggacagccatggggtgtttcctcctcagccttcattgtaggaggttccggtgctgagtgcctggttggggggctgccctggcagttccttgggagctgggcacctcctggggagcccccttgctcgcctcgcctggcactgattggctgttggctttttccgggtgtctagtgatcatcacggcctttgacctcactgacgtgcagaccctggagcataccaggtaagtctgggctctctggcccctgcagtctccctgggctcaggaagctgcctggaagggctcccagaccctggccagtggaccctgaccccgtggtgggtgtgagtgaccagggccccttgtcagaaccagctgcccacggactacttactgtccaactgcctttatcgcttgagatttgtccctattctggaggagccagcacatgagtgtgagcccagcacagccacccccaggcacgtgctcagaggggccccaacctgctttaatacactgcctttgccatgttgcaagtccggatactttttgaatgaggtgccccacgtgttcagttcactgtgggccctgaaaactgtatagccagtctttgaagtgacatgaatttggcacttgcagtcttgagaagagagaattggcaatgtgacccattcaagaggctatcctacttctgctgggaatcggccagctactagagcaaagccctctcaccttaccttggtctggggcattcacacccagcaacttccaaaccccgtgagggaggcgggggtgatggttctagttgataaacatgcagggctcatgcaaggtctcaccgggagaggccagaggtggggccaggaggggtcttcaccacctccagccagtgctctggtattcccacccctttgggtccagccaacgcccttccggctggaggtgcagcatcctgctcagccagtgtgggccaggaagccctccttgtccctcccagcccagcacttcagccctggggaggtcccaagtgtgccctctgccccctgtttggggtgggaggatgggtgaatctctcagcctctctccttacactccaggcagtggttggaggatgctctgagggagaacgaggcaggctcctgcttcatcttcctcgtgggaaccaagaaggaccttctggtgagcagagtggcactggtggtctgggtggcccttgggaaaatgcctccccttacagccctcattggaggagccatggggagggagggaggcagcacagtgggaagcaggcagctgcctatccccctgggcctccctgcaggagagccgggacgctgggtcaacaagggccatttctcccagtcaggggccgcatgtgagcaggccgaagcagacgctgtgcacctggccagggagatgcaggccgagtactggtcagtgtcggccaagactggtgagtgggccagggctgtcaccatggtggggcagagccctgctcttgggccagtcctgtggggcctgccatgcagtgtttccctctgtagccagtcgtctgttccctctgtggccctggtgcacactggcatcacagccctgctgtgctggtgcctggcagcactttcattgcctaagaggagctgcgtcatctctagaaggaagctgggaggcctgcctcacggatgggggaatagtgaccccaaccctgtgtcatgccgtgctggcctgttctccataaccggagaaccccataactactcataactaccccataactactcatgaggcacgttccattttagtcctgtgaagtaacttccagggccacagggtggcagggccaggatccaaacacaccctcacctgtaaccactgcactatcctgcctctggccctgaaatgccaggcatgtgacatcacctggcatagagaagggcccagtgacaggggctcccatcccttcccagtatcactgtggctcaaagaccccagctctcactgaactcactccccaccgggtctacccctggccatactgggtccccagcccaaggcaagatgcccagcatctttgagcctccatctcatctgggaagcaggtgatgccatccatctcccttttttgtgaaaaaacgttttaaattacaaaagccaggtgtatttactgaggaaaacagaaaatccaaagacacaaagagcagatggcaaacacaggttgttgggggatgaaatgaagtcatacgcagggcctggcacataataggcccccaaggctctggggactcaggaattgggcccagtagtctttaccctgtgtaagaggggacagcagatatctagtcggagactgggtgagcactgagggttggcgtcacaagtagaagcaccactttcagcccagcgcaaacaactggcagtgccttccactgctcctttccaacagtgagaactgctctgtgagaacccttcctcccttatcagagtaacagtgagttcaccgacagctcactatggaccaagcaggactgccctatgcggttgtgcaggttgctggctgcacaagggcagtgtgcgtgttaagggctggaaaccagcccgctctctgatgggcagccacctctacctggaggaggatgcataaaggctccatgtgggggctgacagcaaatcaatcctcacagccccaccggacaggtatggaaagtgacaggagggcaggcacatatctgtcctgagttccacatcttccaacacttgggccatagtagcatctgattggaagagtagatgctgggaagcaaaggctcagaagtttgagggagtggcccaagcaggcagtggggtgggagttgggaggctggagccaggtgggaggccaggccagtggaccctgcccctggcactgtgctgcctgtgtgagtgggtggggctgtgccctcctggggtcattgttactgtcagggtgctctagaaagggctacgtgccaacctgagggtaggctagcctggctttcacacccagatgcattaaggggcaaggagaaacactgatgaggtcccggctgtcttgtgggcccacaggcgagaacgtgaaggcattcttcagccgcgtagccgccctggcattcgagcagtcggtgctgcaggacctggagaggcagagcagtgcccggctccaggtcggcaatggagacctaatccgtgagtataggtgtgactgggttgggctggggagtaggctggaggcctaaaatccacatgcgccatcctcgtcacctgaggccttgccatttcctgaacttgtggccctctcctgtcctttgaccctcctctcagggtgtcactgcagcctcaggcctgtagcccctctgattccacctgccaggtcagacaccctccctagccctccctgttctcctgacacatggacctcatgggcatccatgaggtcctcatagcccaggctgggcgtcccaggctctgcagatgtgtcctggccccggctctcccagtctgcacctttgccctctctgttccagtgcctggaaggccctctcttggcttgtgtcaggccattcaggccttgaacagcaggcccagaagcttcagctcacagctctgactgtcagggccggcatcccctgcccagtgtcagctacaggattcctggttgatgctaaattacttctcccctccttacagaaatggaagggagtccgcccgagacccaggagagcaagaggccctccagcctgggctgctgctaactggggcctgcgtggaaggcctccgctccctgcacacacacggacaggaatttccgtgactgtggtgtggagactggagcccaagctctgcagcgtgtcgccctcaagctgtaggcccatgttccagtccctccacccacccaccgggctcagctccagggcacagtcacttgtccgttgcaggttgggcactagaaaaggcccccactggctgcctgggagccccacaccaccgggccagtgcaggcactgtggtgatcccataaaaggccagtccatttgcagggtcatcagacagtcacctttggcctcaagaggcctcagaactgcaaactcctgcgtcggtctatactactcggccatggcccacatcagcagtcaaccctgcactctttcccagcgatcttggatgtgtccccaggatccgtcacagtgttccaggcaacctggacttgtcaaagtcagcacctgaaggagaggccacctgccattccccctgggagttttctgttgtcagcaggacttatggttctgggtctcagagcttcaggcctcactgtccttctgccacggatgctcaaggttcctgggcagaccagcacctctggaggacaatggacaaaatgtctcttagacctgttctggctgaagggctatctctggcacctctgagatccctaggtcctgccctcctggtccgtgggccaggatgtgcagaacaaccactcaggcctttctggcccacctggacagtgcatttacctgtgtgctgcgggaggcagactgcacagctgtcctagggtaactcactctgcagcccttgaacatggcactgccctcctctggcactcatgctgggcctgtgcccactgctgcctctccatccctctctcattggcctatacatctcttaggacctttgtaatggtgtccatgcacctttagaggacttcagaggccctgccaagtctagcatgttcctgtctccaacaccgcctcctgcacatgcagagcagacagaaataccccacacattccccagcctctctgcccagtatgctcatccacagggttttctcactgctatgaaccagccccacagccccaggcccctgtcacctggctatgcccactcatcccacccgtctcgtgctgttgcttcccgtagatggcgagcaccttgcaggcagccttctgatcagtactgctctcctagggcctggcacactgcagctgccctgtaaatgttcagctcagcgattgccaaataccagttagggaagaacactggcatctttttctattcattcccccttcaacatattttttgtagttttttatataaatgacttttttttttttttgagatggagtttcacccttgttgcccaggctggagtgcaatggcgtaatctcggctcagtgcaacctctgcctcccaggttgaagcgattctcctgcctcagcctcccaagtagctgggattacaggcatgcaccaccatgcctggctaattttgtatttttagtagagatggggtttctccatgttggtcaggctgctctcggactcctgatctcaggtgacctgcccacctcggcctcccgaagtgctgggattacaagggtgagccaccatgcccggccataaatgattttattcatttttatgttttcttttgggcggcgggatggagtctctgtcacccaggctggcgtgcaatggcacgatcttggctcactgcaagcttccccttccgggttcatgccattctcctgcctcagcctcccgagtagctgggactacaggcacgtgtgaccatgccgggctaattttttatatttttagtagagagaggtttcaccgtgttagccaggatggtctcgatgatctgacctcgtgatctgcccgcctcggcctcccaaagtgctgggattacaggcctgagccaccgcgtccggcctccataaatgacttttaaaggggttgtatgtttagtgtgaacaaagacagtacaaagcatataaaatacaaggtgaaagccccccccccgccacattagctgcgcccctgaagtgtctccagcagaagagatggatgaatggaaggacacacagatggacagagagcaggaaagactgttagctctgctaacagtcaggactattccttctggactctgtgcctttgcctgcacagctagtgttgatggcttgtttgttgttttcaccagagtgagctccttctggacatactgcctggcagcctgccttcctagggagctggcgccaaggcctctccctgatggcacacaaggagcctccttcctgtagcagcgcccagttttcatgtggatggattgtagttcatttgaccctccccatccgcgggccatccggcttgtgtccagcttttagctcttgccaatggtgctgcagtggccattcttgtagttatagctttgcgtactcaggaaggcccttctcccgactgcggcccccagcctggtccactaaatgcagcctgtggtcgggcagacagcattggggtccattaggaagaccaggtttgctgggcataagcttcacaggacgggagaacctgcccatggtggactgtcgttctccacagctcccttcccttgccccttcgggcctccaggatatgtttgcgggggtgggtgtggtgtccagctgttaccagcttctgagctagagctgtactgcctcacgtacacccccacctctgtaaatggtccttgattaaatcgtcctcatattacctcctgcaatgtgccagctgattcccacacaccctgactgacatagttgtggcctctcgaactttgatatttggcctgggaggacagaagagtaaggtcgccacggaaacgcaaggggctcagttgtccccccaccccaagttgatgcagcatcttctcggtcagaattgcttcagggtggtttgcgcaccctcactttgatgatttaatgaagacatttccttctttcccagcatcgggcagtaagtttcctgggcagaggcactttctgttggtctggtcttgtgggcccaggcaagcagccccctgcagccaaggtgcggcaatgaccacagtgaccgcgtccaagtgctgccgaaacgcctttttcctcttccctgtttccctggaccctttcctgctctctgtccatctgtgtgtccttccgttcacctgtctcttctgctggagacacgtacctgaagcaggtcctctcctgtcacttcctggctccccagggctaggtcccagggtgctctcgctctggctttcgaggctcctcaccacccagcccaccccacccccacaggcccctgtgctccagtttcatccctggtcacaatgcagtctgcagatgccagacccctcttctgtgcccaacggctgggacacccctactcccagagaggcctctgtggacacccccacagctctcgcagcacttgataccttgagtgtgattggtcacatctgggctttctcccccacccatctgtggaaccccaagagccaggacagtgacctcatcacctctactgtctcccctagcacctctgggaggaagggcccacagtaggtgctcaatagatgtgtaaagaaggcagggaagcaagaaggttgctcaaacaagaccatgttcccagcagacagattgcactctgacccagatgccaccacacgaaacttacacctgcctggggaacaatcctgtgcttggctctccttggtggccagggacagttgtgcctcatccctcacttgcaaaccccagtcctgtctgacccagagaccctcacagggcatcagccagtgaaggcggtttggggctggaggatatgttctgatcttgggaagagcttggtaggagccagccacagaaagtttcagggcagaactgaacaggtctcgggaaggacacttcatgccagctagagaggctctgggcacaggaaagaattggacttcgggcagaaaaatgtttgtgctatttagtactatgtaacaaatcactccaaaacttcattgcttaaagcaacaagcatgtattatttctcatgattctatgatttgaccagctattcttccgctccctgcttggtagctgggccactaggatgactctcccagagtccaaaatggcctccctcatatgagtggcaggtggtgtggctctacctgaatgcttggcagggccttgccacatggcagcttgggcttcctcacagtgtggtggctggtttctaaaaaggactgtttccaggctgggcacagtggctcatgcctgtaatcccagcactttgggaggccaaggcgggcggatcacgaggtcaggagatagagaccatcctggctaacatggtgaaaccctgtctctactaaaaatacaaaaaattagccaggcatggtggcacgcacctgtagtcccagctacttgggaggctgaggcaggagaatcacttgaacctgggaggtggaagttgcagtgagccgagatcttgccactgcattccagcctgggtgacggagtgagactctgtcttttaaaaaaaaaaaaaaaaaaaaaaaaaaaaaaggagtgtttccagagacaagccccaatgtgtaagtgcttatcaagcctctgtttacatcacacttgctatatttggccaaaatggggcattttggccaaatgtccaaagtccagagtcagtgtgggaggggatttcataagggtgtgaagaactggaggtctgatgcattgggggccaatatgggggggtggggtgcaatatagggaactaagggagagagtaagatgaagggctgtgtcccaatgtctgctccttttttgtcctgaggcaaagcaagggctttctccctaagcaacagctccttaccctgacctttgccaatgaactcagcatagaggtgcttcctcaagaaagcctgctttagcctctccagctgggtcaggttgcccttgatccctatcctggtctctttacaattcccttaccgtcctggtggccttggtggtctgccttgttcactgctgcatccccagcaccagcctactaagtaagccttggaatgagtgcacggctagtctcacagtgcagcctcacacgatgttgttaactggtgctctacaccttggatcccaagagggcgaggccagagcccaggtcacccctgaccccagcaggcaccaccacccaccacccactggaacccacttgcagtggaaattctgacccactgttccccaaagcagaagtcatccaggagtggggtgcctcctgggggagtagcaagaggccacatttatggagcacgctctttgtgccagccccgtatgcagtgaggtgctctggaagctcgtttaaccacagcaatgctgtgggctcactaccacccccgccctgtccccgcctgacaggtggggagactgaggtgcagacagctgaagagatgggacacacctgagcacctcctcctcctctgaactcctggtccctcccctgcctctgctgccaaccccacttggagtctaatcccagtgggaatctgctgcaggtgccctcacccctggggctcaatgtctctcagtcagttgccccagcacactgccacccagggtcgaaccccaaaaggagtttattcgcatggccccaaccaagctcagccctcctcagggtcccccagctgagccttccccttcactgccgctccctgcaccctcacaatgtgagtctatgattctgtccttcccagcccagcagccatggttgacagaggctccacagggaccggagcaaggcagttgctctcagcatctttcaaccctgtcccctgggtgcctgcctgcctccccctcctcccagccctgctgcaggcctctggagtggagaggaggccagcaggatccattcgactcacatttcagcctgggggatgggatggaccactgtcagacaaacctcactctctggagggatgcagggcatcttaacccaggagaactcaggtcacctacaatctaggtaactgaatactgaaatggacagaggatcggttaaattgacacgttcactcattcattaactctttttttaattaatttatttttttttttaaggcaacacagccagggtctcgctgtgttgcctgggctggcctcaaactcccggtctcaagcaatcctcctgtctcagccttctgaacagctgggactacaggtgcactactgcacctggcttcattgactaattctcattttttttgagatggggtctcgcattgttacccaggctggagtgcaatggcgtgatcatagctcagtgcaactttccatcatcaagcaatccccccaccccagcctcccaagttgttgggactacaggaatgagccagcatgcccagctaatttttaattttttttttaatttcacagagatagggtctgtgttgcccaggctgcactaattcttacttgttcatgcattcagctttcctggagccccctttctggcccagccctttgcattctcccattcactcctcccgcagcccacacggcagatgccagcccgaccccattttcacaggtgagccaggcttggcatggggcataagccctgggtccacacaggcagggctagactgggaggcagctccctccagctcttgaagtcctgggcccccggggatgctgacaggtagccaaggaatcccaggcttggaggggactgcagagagacacagcaaccaagggagcccaggacagggatgagagaagacatgtggggggtttcagaggaagaaactcacagcacagagagggacccctcctctcctgagggagaagcggctcctggagactgggtggaccctgggcaccgctccccgccacacacacacacagacacctgccgcttcaggcactgtgtgagatgcgatgccctcccagcagttcccaggctcctctgccatctgctgtggcctaccaatgtcatctcccatatgtcagccttcccctgaaggaaactgatgagcagccaggacgtatgactgtcacatgctccttccaggcagcacagacccttcctggcctcctcccctttgtccaggcaccccctcagtattcagggccaccagccagtgtctaagcctgggccccaggaaggtgagggagcaggcatgggactcctgtccctgggcactgtcagcaggctcaccccttgtcttctgggatacatggtgggtggtctgggaggcaaaccaggtctgggctccctcttccctgacaggtggttggcacccctagcctgagggtacactaggcctctgctcactggaagccacagcctggcacaactcactggccctgtcttcgggaacgagctcatcttgtcccagcaatttcgcctcctgtgaaggctgccaatggtggccaggagactccgctgggattctcctgactgcagggacctcatcaataattgattctgcagaaggcagtggagttcctgaggaggggcccaggtctggaagggaaggttcacagccccagtcactcggaacctgggaccagcagctccacaggggctcgtttctcactggacaaagatggccctcagatctttgctccgcactctggctgggggcaggaataaaggacagctgtattgatggcccagttttctgatcttgcccccagctccctatggttgatagatgacagatgatggatgacagatgatggatggtggtcacatggccacatcccacttgaagggagccctcctctggcctccagcctcccaagtgggtggggacaggggtggagacagcgcggaaaaggagcaagaaagaacaaaagctcacgcaggcttttaattcgggctcaggcagatctgagggcagaaagcccagccatctacaatgtcttgcctgatggtactgattgtgactcaggaggttgggctcaagtctgggcccccagttattgctatgtgacttggggaggtcactctctgagcccgtttccctgcctcttgttggggtaatggctggggaggtggaaagaaatcacgctgaaggacctcagttccaggctggccccctggtgagggctggttggataggacccctgaagactgtgtgaccctcatgagcagagccattgcacccacccacaaggggcctttgggtgaattagaaaaaggtaccttggctgggtgcggtggtgcacacctgtaattctggcactttgggaggtggaggtgggcggatcgcttgagctcaggaattcgagaacagggcaacatggcaaaactgtctctacaaaaactataaaaattagctgggcatggtggtgtgtgcctgtagtcccagctacttgtgaggctgaggtggaaggatcgcttgggcccagaagcttgagactgcagagagctgagattgtgccactgcactccctcctaagcaactgaacaagaccctttaaaaaaaaaaaaaaaagcaaaaaaagaaaaagccacctgtgcagttccccaaaaagtcaaacatagaattgtcacatgacatggcccagaaatataccgttcctaggtatatcctccaaagaactgaaagcagactcaaacaagtacattgccttagtgggagcctgccatagtctaggtggtttttagaacaacagaaatttatttctcacagtcccggaggctggaagttccagatcagggtgccaacacggttggattctggcaagggcccttttctaggtcacaaactgtagaattctcactgtatcctcacatagcaaaaagaatttgagagcgctcttcagggttcctttaaaaggccactaatcccagccaggcacagtggctcacacctgtaatcctagcactttggcaggccgaggcggacagactgcctgagctcaggagtttgagagaagcttgggcaacatggtgaaaaaaaaacaaattagccgggcgtggtggtgagcacctgtagtcccagctactcgggaagctgaggcagaagaattgcttgaacccaggaggcggaggttgcagtgagctgagatcatgccactgcactccagcctggtgacagagcgagactccacctcaaaataaataaataaataaggccactaatcccattcacgaggactccacccaggacttaactacctccgaggcacattgagggttagaatttcatatatatatatatatatatacctacatatttcccacttagagatggggtctgactatgttccccaggctggcgtgctgtggctattcacaggcacaatcccactactgattggcacagaagttttagcctgttgcactttcttttttcttctttttttttcaaggtggagtctcactctgtccccaggctggagtgcagtagtgcaatcttggctcactgcggcctctgcctcccgggttcaagcgatcctcctgcctcagcctcctgagtagctgggactacaggcgtgcaccaccacgcccagccaatttttgtatttttagtagagacaaggtttcaccatgttggccaggatggtctcaatctcctgacctcatgatccacccactgtggcctcccaaagtgctgggattacaggcgtgagccactgagcctggcctacactttctacctgggcaggttcactcctccttaggaaacctgatggtcatcatgttgatgacccaggaagtcatcatactgatgctgaacttagtgcagacacctgacaggcatagtgcactaaagcccagaactcctagattcaagcaaccctcccacctcagcctctggagtagctggaactacaagtgtgtaccacaatgcccagctagaatttcaacatacaaattttgggggacacaaacattcagtccattgtatacatgtacatacacattcaagtaatattattcatgctgagcgcggtggctcacacctgtaatcccagcaccttgagaggcagtgggggtggatcacctgaggtcaggagtttgagaccagcctgatcaacatggtgaaaccccgtctctactaaaaatacaaaattagccaggcgtggtggcacgtgcctgtaatctcagctactcgggaggctgaggcaagagaatcgcttgaaactgggaggtagagattgcggtgagctgagatcttgccattgcactccagcctgggcaacaagagcaaaactctgtctcaaaaaaaaaaaacaaaaaaaaaaaaacaagcaatgttattgacaacagtgaaaaagtggaagccaggatcggtggcacatatctgtagtcagcttcctatctaacaggccagtcctcaagcacctggttaccaggaagaagaaacaaaaattgttaaaaagcacccttccttaatgcattttatatccatctgttaaaacaattgccatcataaactgattctgtaagaataagacatacaaatggaatcatacaatatgtggctttttgtgactgcttctttcacttagcataatgttttcaaggctcatccatgttgtagcatttatcagtacaatatttcatttcatttttttctttttcagacagcgtctggttctgttgcccctctggagtgcagtggcactatcatggctcactacaatctctgcctatagtgatggtgcgcgtatagtcccagctacttgggaggctgaggtgggagaactgcttgaatccgggaggtggaggttgctgtgagccaagatcacaccattgtactccagcctgggtgacagagcgagattctgtctcaaaaaaaaaaaaaaaaaaggccaggtgcagtggctcagcctgtaatcccagcactttgggaggccgaggcgggcagatcacgaggtcaggagatcaagaccatggtgaaaccccatctctactaaaaaaatacaaaaaattagccaggcgcggtagtgggtgcctgtagtcccagctacttgggaggctgaggcaggaaatggtatgaacccaggaggcggagcaagaatccgtctcaaaaaaaaaaaaaaagactgggcacggtggctcacacctttaatcccagcactttgggaggccgaggcagggtggattgtgaggtcaggagatcgagaccatcctggctaacacggtgaaaccccatctctactaaaaatacaaaaaattagccgggtgtggtggcaggcgcctgtagtcccagctactcgggaggctgaggcaggagaatggcatgaacccaggaggcggaacttgcagtgagccgagatcgccccactgcactccagcctggggtacagaacgagactgcatctaaaaaaaaaaaaagaatgtcatatatttggaatcatacagtatgtagccttttcagaatagtgtcttttcatatggtaataggcatttaagtttcctccatgtttttccatggcttgtcagctcctttctttttagtgctgattaatattccattgtctggatgtaccacagtttctttctttctttttttcttttttttctttgagacggagtctcgctctgtcacccaggctggagtgcagtggcgcgatctccgctcactgcaagctccgccttccaggttcacgccattctcctgcctcagcctcccaaatagctgggactacaggtgcctgccaccatgcccagctaattttttgtatttttagcagagatggggtttcaacatgttagccaggatgatctcgatctcctgacctcgtgagccgcccgcctcggcctcccaaagttctgagattacaggcatcagccactgtgcctggccttcttttcatttatttatttaatttgagacagggtctcactctgtcgcccaggctggagtgcaggggtatgatcatagctcactaaaacttcaacctccctggctcaagcaatccttccacctcagcctccagagtagctgggactacagacacatgccacaatgctcaggtaatttttttatttttggttttttgttttttgttttttttttttagagatggggtctcactatggtgcccaggctggtctcaaacttcttctccgttattatttactatttatttattttgagacggagtctcgctctgtcacctaggctggagtgcagcagcacgatcttggctcactgcaaacgtccatctcctgggttccagcgattctcttgcctcagcctcctgagtagctgggactacaggcatgcgccaccacaccaggctaactttttcatatttttagtagagacagggtttcgccatgttggtcaggctggtcttgaactcctgacctcaaatgatccaccctcctcggcctcccaaagtgctgggattacaggtgtgagccactgtgcccagcctctattctttcatctgttgactgacacctgcatgctttccatccccagggctttgaggcatgagaagttctgcattgtctccagcagagggggcggttgggtcccagcctgttcttccagtaaagggaaagggtggcctccgggaggggtttgctggaacttttgcttggggcctaggaaccacttgggctgctgctgagggtgtgtgacggtgtgtgtgtgtgttttgattttaaaattacttctaggctgggcactgtggctcacgcctgtaatcccagcacttcggggagctgagttaggaggatcacttaagcccaggcgtctaaggctgcagtgagctaggattgcaataatgcactccagcatgggtcacagagcgagacccccatctcaaaaaatatataagtaaataaataaataatagaatcatgtaaccacactcagagaacaagggaaattgagggggaacatcaccaaaaaccccacttctctgttatattttagtttcgagatttaaaaacataatatggattggggatgctggaaatacttgttatctaattgtggcgatggcttcaaagtatacacagatgtcaacactcatcaaatcgcactccttatgcgcagtttatgacacttcaattatacttcaataaagttgtaaaaaaaaaaaaagctgagtgtggtggctcacgcctgtaatcccagtactttgggaggctgaggcaggtggatcccctgaggttgggagttcgcaaccagcctgaccaacatggagaaaccccgtttctactaaaaatacaaaattagccaggaatggtggtgcatgcctgtaatcccagctactcgggaggctgaggcaggagaattgcttgaaccgggaagcggaggttgtggtgagctgagatcacgccattgcactgcagcctgggcaacaagagcaaaactccgtctcaaaaaaaaagaaaaaaagattgtaaaaaaaaaattttttttttttttcagacagagtctcgctctgtcacccaggctggagtgcagtgacgcaatcttggctcactacaagctccgcctcctgggttcacgccattctcctgcctcagcctccgagtagctgggactacagacgcccaccaccacacccggctaatttgtttttgtatttttagtagagtcggggtttcaccgtgttagccagaatggtctcgatatcctgacctcatgatctgcccgcctcggcctcccaaagtgctgggattacaggcgtcagccacggcacttggcaaaaaatctatttttttttaaattacaaaagataggtgggttggcttgtttgtttgttttttcttgagacagagtctcactccatcacccaggctggagtgcagtggcgtaatctcccctcactgcaacctccgcctactggatccaagcaattctccagcctccgcctctggagtcaccatgcccagctaatttttatatttttggtagagacagggtttcaccatattggccagtctgatcttaaactcctgacctcaagtgacccgcccgcctagcctcccaaagtgctgggattacaggcgtgagccatagataggcgttttattatgaagaatttagaaaagcatgatgatttagaaaataaatgtcacccactgctcatagacagctgtggagcccttggtgaagccccctcctcctgctgaacccctcagaaggctcctggggtagcgctcagggcccatccagcctccagcttctgcagccaagttccagggcccacctctgccctgccggcctcatgatgccagactcagctagcatccttcccactgagggaacagcagctatcagcatgaggctctgccttcttcactgagtcttctccgctcagactccagggtccccatcatctccctggccagtcccttctcagtccctctgcctctacttcccccctagtccagtaactgtcccttctccacccagcctcacgcaggcagggggagagtctccagccccgtggcaacaaacaacatcgattcactggcaacactccactttctctctgaggtcttcattgctccttggtgcaacagggtcaccctctgcctgatgcctgctcatggatgggctatgcggacctgaagccctgtgcaggcacctctgcttgcctgttgcagtcaccatcccaaagtcatccccatgagctggcctccctctgttggggaaaagctgggtgtggggagagaagctgaggcagggcttgcatgtctgctagacttgctggctccttccttctagcactctcattatctcaagtagccatatgtttcaaagaaaatgctaaactgtcacagctgtagctcatttgcttgatacaccgcttcctttcaatccccacatcctcaccacctgtttctttgtttgatcaccaataaatagcataggctcctagggctagaggcctttgcagcctctatactagcgttggccccctggtcccactttctctcttgccttttctcactcctttgactccgccagactttgtcgcccccacggcctggtgttgggtctgatcaccccaacatccctcattccccacacccactccatctacaagtcccatgagttttacttccagaatgctcctgaattctaaccccttctctggggtaccttgcttctgccctattctgggtcaccaatgccttcctcataaacaattgccacaatccccaaccactccccctactcccacctcccacgcccaaccttccatgcaacagaccccagcaagtcaccccgcttcctgtgcggttgagtacagcagccacggtggccattgaaactcactaacacgaaaccaaacattcagttcttcagctgccccagccacgtttcagatgctcagtaatcacacggggcagctcgtggctgccacattgtgcagcacagattacagaacatgcccatggtactggcaagttctatcggacagtgcaggtctagaacctttgagcagcttttccttgcatttagaataaaacccaaactttgtgcaggcctacaaggccctgcctcacctctgatcccacttcctactgcctacaccagcctcatctcccaacctggctgctcctcaaacagaactttgaagcctccttgtcctttgcctacctggtccttgtccttaggaccagctcaggcatcacctcccctggcaagcctttccccgaactgtgccttctcccacaggacacacacacctttgctatagccgggctgtgaatgccttatcacttcctcccccatacacaggcatcgctctcggtgacctatctgccctccaggccatgcacacatctggttcctcattccaccagacctggttgagcacttactctgagctcactatatgagagacataggggaacaagacaaacaggtctgtgaccttgcagagtttagatctagttggaacagacactgagtgggggattacagagtgttatgtgtgtctaaaccccatgcccatgcccatgccctgctgcattcctccctagggagggatggatgataagaaaactctacaggaaaggcccagaggctcaggataggggtgctttcagggaagtcctgaggagagaacagtgtccttggggccagaagaggctgtcccacaagggagaaagccactatctggacgtgtccttgtgcctaacaaaaagccatttgctatgccaagagaacagagcatgcaaactcaaactaaacagcttcagagtttacttagagacagggtcttgctctgttacccaggctggagtgcagtggcgtgatcctagctcactgaagcctcaaattcccaggctcagtgcaatcctcccaccccagcctcctgagcaggtagaactacaggcacgaggcaccatgccaggctaatttttaaatttttttgtagagatggagtctcactatgttgcccaggctggtcttgaactcctgggctcaagcgatactcctgcctcggcctcccaaaacaccaggattacaggcatgggccactgtgcctgcctttatcatacccattttaaagaagaggccattgagggctgggtgcagtggctcacacctgtaattccagcactacaggaggccaaggcgggcagatcacgaggtcaggagttcaagaccagcctggccaacacagtgaaaccccgtctctactaaaaatacaaaaaactagctgggcgtgatggcaggcgcctgtaattccagctacttgggaggctgaggcagcagaatcacttgaacccaggaggcagaggttgcggtgagcagagatcactccactgcactccagcctgggcaacagtgtgagactccgtctcaaaaaaaaaaaaaaataggccactgaggatgagagcactgctcagtatggcactactgggattccagcccctttagtggccagggcatcatttgcatctcagtttcctcacatgcaaaatgggctatttgcagcctgatgggaaggggatgagaaggtccgctgggtccaagggaccaggatggcaggaggttagcaaggcctgcagagggcagcagtgagctgcgcaccgcccacccagcctagaaactggggcccatgggttttccagggcaggaatgttctccaggggcactaatattaacaggcaatcacgaaatcgacccctacacaccatttatcaggttgtgttttatgtttgccccatctgggcattttatgcaggatgctctcaacattttgtaccgtggcccacaggactgggtggaagacaggacagctcagagcagggagtgaaacaaaatctttgatggttctctagggaagcctggaaatctgagacagggcaaagagcagggagtctgatgagcacaaaattaaaatacccaaaccagcctgccgggtcaggggaaaaggaagcaggattgggcacatgaagaacagatgacaaaactgaggctcagagaggctgagagagacactgctgaggtcacacagccaggagtcggcaggaagccctgaacccaagcagggctggcctggctactagcctgggctcagtcctttagattggacttcaaagtatctgctccagatgacgctggcattgggaggagggcatgataatccctaacatccacacagggacaacagcacttggaggcagatgtgcttctcacttcaaggaaactgaggcagagagggagaggtggtcaggactcaagcccagtaattcatttgccaaatcctgtttccttttcccccaacccagcgggctggtttgggtattttcagtttgtgcccatcagagtccctgcagagtgctctccactgtgtctcagatctctgtgtccccagagaaccatcaaaggttttgtttcactccctgctctgggctgtcttccacccagccctgtgaacctcagtgcaggttggccgcccccttagagggaggctaatcagggaagttctgagtcaggtcgtcctggaaaaactacattgacctctggagctcaagagaggccaggggacaaacacatggctcagcacacaggaaggcaggtgtgggtattgagtgacctgagggagaaatccctatttatcatccatcatgtggtcctgctgtgacaaacccgtgtggcagccacccacagcagatccacaacgtgagaggcccgctgaaacaagggtgctggcattggttactcagcctggccctccctgccttgcggggtgacctgcctggtcctggcctctctgtgagttgggccctgctgggtggtccctagtgtgcccagccctgaggctggtgagaggccaggctgtgaggtgtgaggaacttacctgcgtctccatggaaggtgccctccgcatcgttgggccagatctgcctggtcttgcagatgcccacgatggtggcctctgacacgacgactgggcagtgccggtgacgcttatggcactgcggcgtggtaggggcagaggggggaggttgcttctgtcggaggactgctgcgagttctgccagagagagcagctcttgtcccggaacatgaggtaggtggtggggcttggggacacgcggctggactggccggagaagtcctcctggccggaggggagccaagtgttcctgttccaggactgcagaactggcccagacctctgtattggaaaggtctttatggaccagggagtccggtgtcttttttacgggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaagaggcccgcctggctccgtcatccgcgccgcggccacctccccccggccctccccttcctgcggcgcagagtgcgggccgggcgggagtgcggcgagagccggctggctgagcttagcgtccgaggaggcggcggcggcggcggcggcacggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcgggccatgggggccgcccggcgcccggggccgggctggcgaggcgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcaggtgagttcctcacgccacgtgcgtgggcacacctgcacgggggaggaaaaccatagacgagtaggggatacaaaacagaagttgggagggaggagtggatagttttgagtgtatcaggtgcacttgtggttcacgcggatcctgcacccgaacaaactccatcccctcctccttcctgaatgcatactgttagtgtttggaatggaattgggttgaggatggtcttgtgagggatgggaggtggtttgttcctttggttctagagcaatgtgtttgtgaagtacagcttgtgagttgaaggaagatgcttcaggcagtaacctccttgctatgtgctctctccatgccgggcagtgaggatggcataaaagccggagtcatctctagcgcccacatcggatgctgttagcagggactgatttatgtcttgggcattccccgccaccccactgatcctgttctggaggggttatatgacacgtttgtgaaacctgagatatgctagctgctcctaggccatagaagtgtcaggtttgcttgctaaccagcagtcctgaacacaagtcacagcaggtgagaataggaattagaaggaagtgaggcgacaggcagttgtgactcagtgggccaccgaaaatcaactgcatggagattttatctgggggtgaagcagagccacacccgttctgatctgcctggctttgatgggaggcttcacccatgattattcaccaccaggctcctccatggtggtaacccagccccatttgctgaccctccagtgtgctcctgctgcctcatcttgccaaggataagcacccacaggtgcttatttggggctcccaatctgtggtcagattctagcactaagattaaaactatgggattgtacgcctaacttctgtgctagatgcaaataccatcaggcattttgggtcatgggactatgttttgagatccagacacagtttgccattggggtaaggaaagggtgggctggggtgtgtgtgtgaggctgtcgggaatcttttggagtcctggtccctgttaagctcatctggttttctgcttcattgatttttctttttctgctgatggaggagttgaatgtgcttggtttgtcaaaatcctcttcaaacgagtgaggctatttttggctcttagagctgctgcctttttgtggtgggcactctgtcctgtttgtgttaggtacttccagttactgatcttccatttgcagctggggtttcctgtggtgcacggctccgacctgccgtctggccgggctgcattccctaagtccctatgtgggggcggggtggaaggctgtactattcagaagcctgctttgcaggcacatcagctcgttcggggtctggaggattgccttgtggttactgggcaccagccttgtctggccagctgttggtcaggcgagccagcttgaactggccctcagtgccatggtgcaggagagttattaataaagaagaaaatgagaggtttttagggagatgtgcaaattgaaattgatagtctttgctggtggagaattctgggtttccagaaccttgggcccagcctttcctacagctcctgtagacttggccatgttggccacatcactagacgccgaatgcaagtcagtaaatgaatataggaattattatagagggatggaaagcccagtgccttgagtcagacagggcaggtcctcaggaaatggctgaggaggtaattttaccacttggacccacttttaggacttgctggattcttctccgaatgtcctcaaggtcccacagtctctttcccattaggttttattttttcccccttaaatgttttgtttgttttttgtttttaagagacagcgtctggctctgccatccaggttggaatgcagtagtatgatcatagctcactgcaacctcaaaactcttgggctcaggtgatccaccacagccttttcagcagctgggactgcaggctcaaaccactatactgggctaatttttaattttttttttttgtaaatacagggtcttgctgtgttgcccaggctggtatcaaactcctgggctcaagcattcctctagcttcagcctcctgagtagctggggttacagggatgagacacctcaccaggcctcttagacgtttttagtaactaaggtcacttaaacatttttaaaagggattattttccctcagacagtttttcttttttaagacttaatttttttagagctattaggttcacagcaaaattgatcgggaaatatagcaatttcccacatactccctacccctacacccccacagcctccccagttaacatctcccaccagaggggcatgtttgttacagtccatgaacctacctgcattggtgcctcattattacccaaagtccagagtttacatttgggttcactcttggtgttgtacagtctatgagtttggatcctgttatgttttaaaactcctgcttcttttagccctgggcaccttgacactctgcctagcagtttcccctgacgtgggtccatgtatggcaggcatggaaagaggaatcctcactggctcagccatctgtctctgcctgtttactgatgttctttagagggctgtggagcctgctggtctgaaaaggaacaatgaggaaaatcactcatgggggtgggtggggggaggaagtcaccctaatgctccgcagtggcagatgtggtgacccagatctaataacctcggaatcagtctgtttggatgaatggaccgtcccatttccaagttgagggcccctcaagggagggggctgaagccatccctgggcacggtgacaaagtgcttcccatagggcccctcatgggctcatctgtcgccctggggtggggctgcccatttacaggtaaagacacaactgggaagcggcaaggctgggattctgggtctctgtgtgaatgcagagctgttccgtttggcacgtggtggccctgcggtgttcttcccactaccccacactgctacctgcaaagcacaactggggaggttcagggcgtccttccagtctttgcaccctgggcccgcctgtgggggtaatgatagacggctgtgagccctgctgtaaaactatgcagaacccggccgggcgcggtggctcaagcctgtaatcccagcacttagggagtccaaggcgggtggatcacaagggcaggagatggagaccatcctggctaacacggtgaaaccccgtctctactaaaaatacaaaaaattagccgggtgtggtggccggcgcctgtagtcccagctactcgggaggctgaggcaggagaatggcgtgaactaggggaggcggagcttgcagtgagccgagatcgctgggctgcactccagcctgggcgacagagcgagacacagtctcaaaaaacaaacaaaaaactatgcggaactcacagaaggagagtgtggttctctctgttttttttgttgttgttgtttttttgaggcggagcctcgctctgtcgcccaggctggagtgcagcccagcgatctcggctcactgcaagctccgcctctcggcttcacaccattctcctgcctcagcctcctgggtagctgggaccacaggcgcccaccaccacacccagctaatttttttgtatttttagtagagacggggtttcactgtgttagccagtatggcctcgatcttctgacctcgggttccgcccgcctcagcctccgaaagtgctgggattacaggcgtgagccacccgcgcaaggcggatagtgtggttcttgcgatctgggaacttacaagttaccggaagagagggagaggcacacatgtatgtgctcaagggaagtgagatcagagaagcttccggaaatggcaggactgaagaggacttgatcagtcaccagaagttggagggcagagagtagccgtttgccctaaggaaaaatggcagcaaaggcctggggccacccacgtctgccttgtgattctaggctgtgtgcttttctttaaatggtaaaatatgcttaacttaaaatttaccatttttgtaacttttaaaaagtttggtaaaatgcacataacaaaagttactgtcttaacccttttaaattgtttctttgggtaaggccagtcaagtgaagcaggggaacattttaaccatttttatccatacagttctgtggtgttgactacattcacattgttgtacgaccatcactactgtccatcttgaactttttcatcttcccgactgaagctctgtacccagtgaataataactccccattccctgcccccagcccctggcactgccattctccatctgtgtctctgaattcagctattatagatacctcatgtaagtccagtcctgtggcattcgtctttttgtgattggcttatttcactgagtgtaatgttaccaatgttcatccatgtgatggcagaaattgtgtggattttttttttaatggagtttcactctaggctggagtgcagtggcgtgatctctgcttactgcagcctctgcctccccagttcaagcttcaagagtctcctgcttcaggagttcaggattctcctgcttcagcctcccgagtagctgggattacaggtgtgcaccaccacacccagctaatttttgtattttcagtagagacggggtttcgccatgttggccaggctggtctggaactcctgacctcaagtgatccacccgtcttggcctcccagagtgctgggattataggcatgagccactgctctgggccaactgtgctttttgaaggcaggaataactggttcatttctgggtgtcccagggagcctggttctgagctttacacatagcacatactggaagagcccttcctccttttcatagcccatggggtcaggactggggacttttactgatcattggaaagtgacttatcaattactcggtctttttctcatttcatccctgtagtttactttctgaggatcttttttttttaagtggcttaaaatactttttttttttttttttttcacagttctctggttggctaggcagttttcctgttgtgggcccactgggctgaaataggacggtctagttagcctcacccacacattctgtgattgcaggctgattgacattggggaggaggggctgtcttatttgtgttgcagctggctcgatatcagttgggacagcagacgtttctccttctctttctctctctctctcttttttttttttttaatagagattggatctccctatgttgcccaggctggcctcgaactcctgggcttaagcaatctacccacctcagcctcccaaagtgctggaattacaggcgtgagccaccacacccagcctcctcctttttctttttttcccccattgagacataataattgtacctatttagagggtgtgatattttgatacatatctgcaatgcataatgatcagattgaagtgattagcatattcatcacctcaaacacatttattatttgtttatgctgggaggtctgaggaattcttgattcaaacacccagcccaatgtgcctgtcaactttcttccaggtgtcagttgtgagacgggacagatcttgtgtttcttcatggacttcatgtgagtggctgccctgtgttttcacatttttattaagcagcttaatttgccctttgaattccggtgatgagttggcgccagagtgaccactgcattgtttttcccttgggtgatgggctggactggcaaccagtttgagtgagtaactgtggggcagagaaaggtcacctgggcctggagttggctccatcgtcatctcttaaggccagagcctcgtggccacctctcagttgagtacaggctcctttccatggatggagacagagtgggcagatctgggtggagtctgaggccgctaaaggcatcagcagcacagaagcagagtctagatcaaattttacaagcgttctctggttcaggaaggctgacttgttttgggaacagaatggagcattctgaaacatttcactgaagaaggagctgggagtgctgttgatttgactgggttcaggggagcatgccttatccatgactcccttttgcttagtttgttgcttctagctttatagcctccttccttccttggttggaagtcctgtggctgggagggcttgtgtttgtgactgctaacctcaccaggacaaagagcccaggtgagctatgtgcttgagcacacttgggagaggacacagcagtgcatgaggcccaggctgcagctcacccctgtggtttgagagggtcccctgtttagagtgaatgaatgggcatcttggaagctttctcaggttaccaaagagtaggtctgagttttggctgaggctgctgctttttgggtcaagactcggggtggtggtggattaaattaactatgaaccccagggaatatcttgaccctgactggaatacaactgttgtggctcaagtaggttttttttttccccttttgaaaagtgtagttattttaattaaaatacaatatccatgtaacatgttagaagtttgttatttttattattgtaaaattcatgttatattttttattttttcaagacggggtctcactctgtcacctaggctggagtgcagtggcacgatctaggctcactacaacccccgccacccaggttcaagcgattcttctgccacagcctcccgagtagctgggattacagctaattagcctagctaatttttgtatttttagtagagacagggtttcaccatgttggccaggctggtcttgaactcctgacctcaggtgatctgcccccctcagcctcccaaaatgttgggattacaggcctgagccactgcgcccggctaaaatttatattataagatgcaccattttctccatttttaagtgtacagttcagtggcattaagtacatcaccttgttttgcaaccatcaccacttgtcaatttctagaactttttcatcttcccaaactgaaacttcatatccatcagactttaactccccattccccctcatccccagctcccggaagccaccgttctactctgtctccatgattttgcctctcctagatgcctcgtgtaagtggagtcttataatatttgtcctgtgtctggctgatttcactcaagcagggctttgaagttccccagggcgacactctcagtcttttcttttttttctttctttcttttcttgagacggagtttcgctcttattttgcccaggctggagtgcaatggcacgatctcggctcactgcaacctctccctcccaggttcaagtaattctcctgcctcagccacccaagtagctgggattacaggcgcctgccatcacacccggctaattttttgtatttttagtagagatggggtttcaccatgttggccaggctggtctcaatcgtttgaccccgtgatccacccgcctcggcctcccaaagtgctgggattataggcatgagccaccgctcctagcctagccctctcagtcttaagactgagttaactcccagctctgatccgtcacaagggtgttctcttccggaaaacacccgttagcaatggcgatcttccctgggccttcacgcccttagctttgaagtggcccagagtattagtttgccaaggctgtcccataacaagataccaagactgggtggcttaaataacagaaatatattttctcacacttctggatgccaaaagtccaagatcaaggtgccagcagggttggttccctggagggctctcattggcttgcaggtgccatggtcttgctgcctctgcacatggtctttttctctgtgcatgaactcccctggcatctctctgtgtccaaatttcccttctttttttgtttttgagacggagtttcactcttgtcacccagactggagtgcaatggcacagtctcagctcactgcaacctccacctcccaggttcaggcaattctcccgcctcagccttccgagtagctgggattacaggtgcctgccaacacacctgggtaatttttgtatttttagtagagacggggtttcaccatgttagccagcctggtctcgaacttctgaccttaggtgatccgccctcctcggcctccaaaagtgctgggattataggcatgagccactgcacccggcccaaatttcccttcttaaaaggacaccagtaagactggattaaggtgggcagtaaagacccctgctttaacttaatcagttcttgaaaggccttatttccaaatacagtcacattctgaggtactgggagttagaacgtcaacatatggggagtgaggcatggtttagttcgtaacacttggtgagtccgttactgggcagcagaggaaagggctgccaggcagagggagatggtgtttgtgccggctccctcagacgtgttaggaggagtgtgagccaagcgtcatgtggttttaggcagcctagaggggcctagaggacactgagccaggcatcaggagggctgcgtgctaaaacttcgtgtgctgccatctctctccacatccaaaaagtaggggtgggaacaggtcattgctaaggttctttcgttagcttctttaatttttttctttaaatttaaaatttattacctttttttttaatagataaagggtctcgctctgttgcccaggctggagtatagtggcatgatcatagctcactgtagccacaaactctcgggctcaagcgatcctctctcctcagcctcctgaatacctggtactacaggcgcgtgccaccatgcctggctaatttttaatttttgttgagacagggtcttgctttgttgcccaggctggtctcaaactcctggcctcaaacgatccttcccgcctcggcctcccgaagtgctgggaataattatagatgtgagttactgcacacagcctgaatgtattattaacacaactttttccatctcttttctgtttatcttggtttatgtctcccttattaaaaacgaaggcaaccacctctccctatccaatcgctcaaaggtatttattgagcatctactttgtgcctggcactatcttcatggaaatcctttcttccttattcattgatttatggaaaggctgatctccaagggccttgtctttaaaacaacaacaaacaaacaaaacctttctaatgtcaaagcattttcccctgcgtatctttctttaacggtatatttgcagctgtttcctgttaatcctttgtctatctggcttcctttttagggtgatgggatccttaagcacagagtatgccctgctgtagtgtcctgcaggatgggccacactctggccctttaacagtgtttgatgtgacgatgcacctgagcccatggaggtctgtgtctcgggccccgtgggtgtttgcagattgaagatggaatgatacacaccatctctgagatttttatttgctcagaccttcccctgttctggcccaaccccgcttaatcatgtctaataagtggtggtgggtttttgggggcctagtgatacaggtggcccggcgatgaaacgttggctttggagattatcccgctggttctgtttccttctttgctggtgattggtactccctggctcacccttagagaacttcccgaatcctcagactggggcctgctaattagctgtcttgggttctagctctcactgccacgactttgcaaaatgactatagatgtggatggtggctggtgcccatgggcagagcaatcagcacattcatagacccaccttcctggggctggggtgtgaagaccggacaccccactgaagtagtaaatatgactttcatggaggctgcttcatgggccctcgaaagtttcttgtaaagtggctggagcaggattataattatactccctccactgattgagtctgagggggtatgagacactctggcctggagtaacctgcccaaggtcaagtggttggtggaggggctggcgctgcctctctcctcagactgagtggttgtgttaatcacatgagagcagacacagaatgactttgcggaggtggaggagacctggatcatttgctcagcaaaccggttttgggcacctgctgtgttgggcacagatggtgctcagtacagtcaggcaggccttccagcaggtcggctttggtctggtgggaagacagcctcattaacctaagtgccatgatagaaatcaactgaccccagcctttagtctgggtcttgaaggtgtcagctgtctaggaacatgtttcccctctcattttgcaaatctccaagatagggatttcctgactcttgatagctccttctgggacactttggtaaggcttctccagcaagttgtgtggcaaggggcccaagaagacagaactgttggaagggcgctgcccatccatctgcttttcccaccaacagtcaagggctgtgaatgctgacctgctgctgacagtggtctgttgtgcaggttctgggaggggcagagggacgaggtctggctgggaagatgtagcggagatacacagaggtagccggctgtgtgtgcacagggccaggtgcagggcccagagagccaggtgagtgaccagggagcactgggaaggaaccatctccaggcaaagccaggacacagccaaggggaccccagaagaagagaggggagccttgtgcagcagccacagagagagagagccaggcagagcaaggaattgagcagcccggggagatcctctactcaagtgccactgttggctcaagaagagtttttgaagattcacttcactttaaaggcctgacatgcttccgtgtttaaagtgctgctggggtcagtttgtatgcccgtagagtagggagagattttctgcacatgacgaggtattgatgagcattcgaagcaacctacaggcaacatatgttgacagtgcagactttgaagggaaaagatctggacttgcccagagacctggcacttgccactgtgtggtcttgcacagggacttaattctcccttgacttctgtcagctggagagggtgacccttccccttgggggcttcgtgggagtagcgggtgcagaccatctggcctcctgtctggtctcatagagtctcctgttcatgtatctgatgtcagttgattgaacatcacttagcaaaaaatcttaagaagaaatgcataatttagtatggacatttcactcacttggctcagccattgtataaccagtatgagctccggggggaccctggggtgtgtcagggccctcattctcctcctataatcctcctgggctgagtggagttcttacattttgaaggttatgcaatggactgcatgtttggatccatctgcaaattccccttttggggagaggctgagttgccctgtgcttgagggagctgggcagatggtactttgtgtagcctgctgcattttgcagaatgtcttctctcacaggggtccctgtggaggagtgacaggaaccctcttagctgagtgttgggaggttttaggtggagggctcaggtcacccgcaggggtcatttgactcctaccttatctgggtagataggatcatctttgtcccacagtccttcccagtattgtgaagtgatgcattggcgtgagcccaggggtgccaagggtgggctggcaatgcccacatccagttctctgtccctgaggcacggaggtggttgtgctgggctcagagccgccgtctgactggttggaagccctgctctgattttgtgaatcaccctagttaagtggaagctcagcgtagcctgttccctctgtgggggtgtgcagaagcactgtttatttttgcccacatcttagagtgataaatggaactcatttatgaattttgacttccaaaagctttccactttctcccttaggaacatggataaaaattgtccacatttgtttttggagacatggattgttacctgaaacctacttttcagatggtcttgatgtgaaaactgttgccaggctgggcgtggtggctcatgcttgtaattccagcatcttgggaggctgaggtgggtgggtctccattttttttttctttttttttttctttcttttttctttgagatggggtctcgctctgtcgcccaggctggagtgcagtggagcaatctcggctcactgcaaactccgcctcccaggttcacgccattctcctgcctcagcctcccgagtagctggaactgcaggcgcctgccacaacgcccagctaattttttttgtatttttagtagagacggggtttcaccgtgttagccaggatggtctcgatctcctgacctcgtgatccacccacctcggcctcccaaagtgctgggattacaggcatgagccactgtgcccggccgggtggatctcttattcccaggaatttgagatcagcctgggcaacatagcaagaccccatctctacaaaaaatttaaaagtgagctgggcatggtggcatgtgcccgtaatctcagctcttctgggggctgaggcgataggatggcttgagcccaggaattcagggctggagcaaactatgattgcaccactgcactccatccagcctgggcgacagagcaagcaagaccctatctctaaaaaggaaataaataaatacacataaaaaccattgcttttttttggccgggagtggtggctcatgcctgtaatcccaacactttgggaggccgaggcaggcagaacatctgaggtcaggagttcaagaccagcctggccaacatggtgaaatgtcgtctctaccaaaaatacaaaaatgagctgagcaggctgagagcagtggttcacgcctgtaatcctagcactttgggaggccgaggcaggcggatcacctgaggtcgggagtttgagaccagcctgaccaacatggagaaaccccgtctctactaaaaatacaaaattagctgggcatggtggcacatgcctgtaatcccagctacttgggaggctgaggcgggaaaatcgcttgaactcaggaggcagaggttgcaatcatccaagatcgcgccattgcacttgagcctgggctacaagagcgaaactccgtctcaaaaaaaaaaaaaaaaaaaatatcagctgggcatgttggtgcacgcctgtaatcccagctactcaaggaggctgtggcaggagaattgtttgaacccgagaggcaggggttgcagtgagccaagatcttgccactgcactccagcctgggtgacagagcgagactgtctcaaaaaataaaaaccggccgggcgcggtggctcgcgcctgtaatcccagcactttgggaggccgaggtgggtggatcacctaaggtcaggagttcaagaccagcctggccaacatggtgacactccatctctactaaaaatacaaaaaattaattgggcattgtggcaggcgcctgtaatcccagctactcgggaggctgaggtaggagaatggcttgaacccgggaggcggaggttgcagtgaaccgagatcgtgccattgcactctggcctgggcaacaagagtgaaactctcaaaattaaaaacaaattaaataaataaataaataccactgcttttttaataacaggtacaaattttaaagagaaataaaaaaacattgccatcttcaaatctccacaaaaatggaaagacaggacagtgccagtcagccactttctgcagtcaccatgatcccttctctctccttcatttttaatgtgtgtttttttaaattgtagtaaaatacacatactctaaaatgtaccatctcaaccacttctcagtgtgcagtttagtagtgttaagcctctagtgttttataagtggcagagttgatgggaaaacactgatcttcaggaggggttttttcagtgccagcgtccctctggatgtgtaggcagataagaaggtggctcggacacagtccttaaataagtgccaggagccagcaggccagggtgggagccgggacaagcaggcacctaaagtaacggtaacataaggcaggtggcgagactctgtggatggatcagtgccaggggctgtgcgggaagggaaaccttacatctgtcctgtttcttaggggacgaggttgtggaggggagggtattccaggcagggaatgtgggcaagaactcggaggcttgaagcattcagtatagtcgtctctcgatatccgcaggaaattggttccaggattcccttgggcagcagtccccagcctcctttttgacaccagtgaccagtttcatggaagaaatttttccacagactgggggttaggggatggtttcaggatgggactgttaacagctcagatcatcaggtattagattctcatgaggagcctgcacagcctagatccctcgcatacataagccacaatagggcttctgctcctatgagaatctaatactgctgccggcctgacaggaggtagagcttaggcagtaatggagcaatgaggagcagctgtaaatacagatgaagcgtcactctccgcctaccgctcacctccagctctgcggcccagttcctaacaggccacggactgataccagttcatggcccgggggttggggacccctgcccttggggatcccagaatccttggatgctcaagtccttatgtaaaatgccatagctagcttttgcatataacctatacacatcttcctgtacactttaaatcatcttgagattacttataatacagtcatgcaccacataacgacattttggttattgatggtggtcccataagattataatactgtgtttttactgtaccttttctacatttggtatgtttagaaacagataccactgtgtcacaattgcttacggtattcagtacggtaacatgctgcacaggtttgtagcctaggagcaataggctgtgccacgtagcctaggtgtgtagtaggctctgtcgtgtaggtttgtgtaggtacactctatgatgtttgcatgaagatgacattgcctaatgatgcatttctcaacatatccccttttaagcaaggtatggctttatctaataaaatataaatgctttgtaaatagttgttacagtgtattgttattacatttatattattcttattgttggttatttctttccaaatagtttcattctgaggttgcttgaatctgcagatgtggaacttgaggctgtggagggccaactgtatgctcagaaagtagcaggctctggttggagagttggtataaaatgtggacaacagggaaggtgagggataggagagttggggtcatcctatgtgggtctccgaagccaggctgagggtgttgtgctttctttgaggatgatagggagccactgaaggttgttaagctggagaggggatgcctttggagctttgccttgggaaggtgagtttggcaaaagtgtgtgtgatggtccagtgggagtcaggtacctggagctgttgtcttgaggggcggtggggaggaatggggagggatggagaggacaaggaatatgagctgattctggggagggggtgacagaaagggaggctgtatgagcctggggatggtgagcgctgtgctggcaggtttcagggcctttcggagagaggaccaggccaggaatgaagaggaaggacagaagcgtgggttgcggagggtgtgtggagtggagggccggagcaggcccttgggccttgcgtcctgggggaggtcacgtgagagaaagaagtgggggagtttatgttgcggaaaggctaaaaggaagtgactgttaggaggttatgggataaaggacagaagccaggctccaagtgagtataggagagaccagagcactaaattggaccacagtgtccagcattctggcagcagggaggaggtgggtggggattcaggattagggtccgagtgctccccgagtgtccaccgtcggcctgctctgttccggggcagggccacatctttgtccgtgtgccgaggaggggactggtgggctggagtcccagggggagattattccaagtaggggctccagaaaggtgagtgatgtgtttgggtctatgggaaggttggtgacccccaaagagaggtggctgggttactgctgaacagctatcagggtgatatggctttgcaggggtccagtccatgggcctgacatgttgtagctatgctttgaaggcattttcctggtgggaggccaccgcaggtaaggggagtgaaagggtggctgtggcggctgttccctgtggctggtggccatggataagtgaagaggaacgtgatgctgggcaccatgctggtggtgcctggggcagagcctggccttgtggggctgtggagcagggtgaggatctgggatctaggactgctatgcaccgggccgaatcgtgatacccaagggaggcatcttgtcgtggagcagttgcatgggcccgcccttgttccctggagcagctggtgaggtactgttagaatttggccctaacaggactgggcacagtaggtcacacctgtaatcccagcactttgggaggccgaggctggtgtatcacctgaggtcaggagttcaagaccaggctggccaacatggcgaaacccggtctctattacaaatacacaaaaattagctggacgtgggggtgcacacctgtgatcccagctactcaggaggctgaggctaaagaatcacttgaacctgggaggcagaggttgcagtaagccaagatcacaccattgcacgccagccaaggcgacaagaacgaaactccgtctcaaaaaaaaaaaaaagaatttggccctaacaaatgcaggttgtgattattaacataagtctggtttcctctctcatggcatttctttagtggccagatggtgtgagtggctccagaagactcttctcttctctgtgcaagagccaggaaggctctagaaaggaatgtctgaggaagcatcggagactgggtcccgccatgcctgtgtcatctcctggcttccccggcccttgtgagccccgcggttgcttatttatcctgctaaggccacagtctcaggttccagaaactctggcaaggaagtctgggaaggttgatggggatgggctggcgggctgggagaggtgctttgttttcactcctcaggaagcttgaggcttcttgtggaagcgtctgctgctttgggctgggcagctgcgcccccagaaagccagctaggggtctgccgcctaataccatgggtggaaactattgcagtcagctgttgggatgcaggggaaggtattggtaggactggggtgccctgtctcctttgtccccatgagtgcaggggatagatctgaaaggagaggggaaaatggatgttttcttctttgtctctcctttctccctgctttcaagtctgtgaattaattggagtcattcccaagggaggagggtcactttattgaattttaagacaaggcggggccaggcgcgatggctcacgcctgtaatcccagcactttgggaggccaaggcgggcagatcatgaggtcaagagaccatcctggctaacacagtgaaaccccgtctctactaaaaatacaaaaaaaaaattagccgggcgtggtggcgggcgcctgtagtcccagccactcaggaggctgaggcatgagaatggcatgaactcgggaggcagagcttgcagtgagccaagatccaccactgcactccagcctgggtgacagagcaagactgcgtctcaaaaaaaaaaaaaaagcaagacaaggcatatgacagggcatgatactgacgagaccttggacatcaaaggctggagcaggacttcctcctagggaacatcctcagatatgtagatgtcaccgtgtgggctcagacatccagggtggaccagagccggtggcttaggtctggtggtctgtccctgactgcacttttttcagagctgttttggtttgaagctcaaagcgggctttttatttatttatttagagacagggtcttactccgctgcccaggctggtgcagtggcacactcacaactcactgcagcctcaacctcctgggctcaaacagtcccctcatctcagcatctcaagtagctgggactacaggcatgcaccaccatccccccaggtaatttttaaattttttgtagagacaaggtttcactatgttgcccaggctacaagaggactttaacttttttttaattaaaaaaaaattttttttgaaacaaggtctcactctgtcgcccaggctggagtgcagtggtgcgatcatggctcaccgcagccttgacctctccaggctcaggcgattctcccacctcagccttctgagtagctgggacggcaggcacatgccaccatgcccagctaatttttgtatttttttgtagagatgaggtgtcttcatgttgcccgtgccagtctcaaactcctgggctcaagcgatccacccgccttggcctcccaaagtgctgggactccaggcatgagccaccatgcctggccaagggggcttttcaaaggctgggctgggctgttcatttggaaaaaaggttggggatgttttcacttcaccaggacttctgccagtcagcaggctggtacattaggagcccaagttttgcctggtgctggtggacgggtctaggcctgagaagccgtagtctcctagtgcttggtgctgctaagcccaaagaacagagtggttacaggaaatggaacatttagtctggcagaggccaagggcagcaggtccctactctggctgcccatgtagttaaaaagtcacacacgtgcgcagctggtctgattaatgagtttgttttttgatgtcacagtttctgggcacagcagagctggctcctctgcttggggtctcctcaggctgcagttgaggtgttggccggggctgcattccctgctggggcttggggttctcttctaagctcacctgggttgctggcagtgcttacctcctggcagttgtaggactgagtccccatttccttgctggcattggctggaggccccttctagagcccaccctgttcataggcagttcacacacagctgtttgcttttctcttctcagtgaatctggtttttttgttttttcgtttttgagacggagtcttgctctgttccccaggctggagtgcagtggggcgatcttggctcactgcaagctccgcctcctgggttcatgccattctcctgcctccgcctcctgagtagctgggactacaggcacccaccaccatgcccggctaattttttgtatttttagtagaggtggtttcaccatgttagccaggatggtctcgatctcctgaccttgtgatccgccctcctcggcctcccaaagtgctgggattacaggtgtgagccaccgcgcccggccaagtctgggttttttgaaaagctccctgggtgacttgactctagccctcagggttcagacccttcggtttctgggagtccgtggacattggctgcaggttttgaaaggctggcatctcaagaggggagcagatgaagagtcatggggaaggttcctgtgcagtatgaggaaggtttaattttcttgccaacttttgagataattatgtgtaaatcttttttatatagttaagatgttgctgtgtagttgggtgtccggccttagttaatgtgaacgtttccatgtattagtaaatcttgtgtaaatattatttttaagggccatattattactttgtagtggagttatggtttaatttatctaattttaatgaatttttgttggacatttcgagtggttctttatgcagctggttagtataatgtttcagtgaacttctctctctttttttaaatagcttcactgaggtaattcatgtaccatacaattcaaccctttaaagcagccaatttaatgggttttggtatattacattattactttttaaaaattatggtgaaatatatatacaaatttgacattttaaccactaaaaattaaaattatggtaaaataacataaaatttaccatttttagccgcacagctaaatggtgttaagtatattcctgtcatgcacccatcactatcatccatctccagaactctttccaccttgcaaaactgaaaatctgtactcatttccacccattaaagaacagtgcttcttcccccacgcccagtccctgtaaccaccattctactttctatctctaggaatctgacgactctagaaactttatttaagtggaatcatgcagtatttgtctttttgtgacttatttcacatcatgtcctcaaagttcatctgtgttttactgtgtttcagaaccccttcctttttaagcttgagtaataattcaattgtttgtgtgtgtgtgtgtgtgtgtgtgtgtatatatatatatatttaatctatcattcattgatgggcacttgggtcattttaaccatttttaaatgtacagttcagtggcattaattacattcagtgaatttttttgtggggttttttttttgtttgtttttgaaacaggatctcgctctgccatctcactctgcatctgcactggtgcagtaagagctcactgcagccttgacctcctgtgatcctcccacctcagcctcctgagtagctgggactacagatgcacatcactacactcatctgtcgttttttttctttttgtagagacagggtcttgctgtgttgcccaggctggtcttaaactcctgggctcaaatgatctgcccgccttggcttctcctgaagtgctgggattacaggtgtgagccaccatacttggccaagtgaatacctttttatatgagtttctgcccatgatggggtgggcctctgtcactggatttaccaggtcagagaggtggatggtcttaagacccttgatggctgctgccaggtcaccttccagaaatcctgccccagtttacccttggctttatggttaactgcctgctcttttttgacttttttcttgcctccttctgttcacaggattgtactgaagcagttccatcaggtgctaaaacgtctgagctgtgtggggccttaccctccaaaaatccaaaattgtgatgtgggattttcattccagagaagcagaatctgagattaaggtttgctttgggtcagaggagtctgtgctagactgggctccacggtaattcccgattccttgatgaccctcgaaacagtccagctttgatagggaggagccctgagctggggtcacactggtccactctctcattcaggaagtttcctgaggccactggctgtgtgacactcagttctttgtcagcgctgtggttcttggtagggaaagaacttactgtccccttgtctgttgtgaagtttgctagtttattgctgttgtgggctacttgtaactgaatctgaaaagcattttggcttctcttctgtgcatcgtgagttaggtctgccagatagcattgtccagttaattctggctcatggagttcctgcttggctttcattgaagctccaaggaagcagaaggccatggcagaaaaggatttctacaaagggaaagggacttgcatggctgcacttggctggcagaagctgggctgggacgggaggacaaacacctccctgtgcaggcagtgggttcagatggtcttggctggaaggagggcagataatggtgagaccacgtttggagggagggcagcatggtgtcatgggcttggggaggaaaggagaggaatggccccttcttcagcactgactagtcgtcctgcaccgtggagggtgttccgtcttattttccagcgctcacaactaggagccagcagttcagttttagccatcccagctcatggattatggagctgggacccacgcttgctcctcctcttgctctgcgttgcccatcttagctgtgcccttggccgccactctgactccagtgaatcacgtagactccttgggcctctgaattcctgtccgtaaatgatgaagctgaatggcagcatttttaagatccgttagttttgtgattctaaataaaattaagtcatgttgctctgagttcccagaaaattattttaagatccgttagttttgtgattctaaataaaattaagtcatgttgctctgagttcccagcaaattatttggaaatccctcttggtggatgtcccaaagcagccttcctgtaggatcctggttgtgtctggcttcctgcagtaatgtggattggggtggattggcctctgtgtgcacccttaatgggaaccaggacactgctttgctggctgatttgttgtcctcccttactgcccactggccagtctacaggtcaccaccaggactggaacagatttcagaggccgtgcaggtttcatctggggcaacgtgccaaagtgcagagcgtgggcagcgggaggccctgccgtccgcgtggatgggggagacggcagcatgggggtgtctgccagggcggaggtgatgatgtgcaagcaggtggttggcagcaggaggcctggtagtgccagctggtgtcttgccagccagagcacagccccgcttggtcaggaatgcatgtgctgaggccagcactgagatgagcaggcatgcgtgtgtggccacccctatttctgtgctatagtgggaggagcacattaggtactttgaggccataatttacctttgttacagatgaccaattccccaacagcctcccagccttttgcaggccccacctgggatcagaaggcaaggtatccttcctgcagggaaagcctgttagtctttcctgagcattcttagtgccagttggagtaggggctgtcttggtactgagctggccggtgctggagatgggctggtcagtctggagggcataaggacaggaaggataccggcactgaacgttgtcactcctgtgggggtacagatgcctcagtggaagccacgctttccttcagaatattgcatttggtgggcctgtctcaaggtgcactttgactcctgaagaccctccttctcctcctctcacggatctgccggtgttccctctctggaaggcttgcaggagagacaggatccctccctttactggaactttgcacttgggtttggctttgtgctttgtaaggggatcccattcagcgtccaggatccgagccttgctctatttctgcaaggagctggtggttgctgctcgccaaggggatactcagacagccaaagcctaggcaggatcagaagctcaggcagcagagccaagatttgaaccaataatttttttttttttttttttactttactctacagtattgggattggctgaactttccttaaatgaccagatagtaactaattttatgtttgtggctgagaggcaaaatcgatgctactttgtggatacttacataaccatttggaatgtgagcatgtgaaactataaagagcattcttaaggcctaggtcacatgaaaacaggtggcagtgggctggatttggcctgtgggctgcagtttgccaacctgtgtttcacagcgagctgcctccaaatgcctggtggtgatgcaatcgatgacagagccaggtgtgggcgtctcacatctgtgctcaggagctcacaggagcttctctcctatagaacctgtgaggcaggtagggtagtcttccaaaccccatgaggattctttcctcagagaagttgccggaggaggaaaagctggatgagagatggtcacttggtttctaacttccctttctcttccctgtttcctgctgcttcccagggctgaatgaatattccctgaaacaaggctggccatgagctaataatcgttgaagccaaatgatggggtaatgggcattcatgatgctgtgctcttacttttgtatttgtttgaaattttccaggataaaaagctaagaaaataggctgggggcggtggctcacgcctgtaatcccagcactttgggaggccaaggtgggcggatcacgaggtcaggagatcgggaccatcctggcttacacggtgaaaccatgtctctactaaaaatacaaaaaaaaagtagccgggcgtggtggcgggcacctgtaatcccagctactcgggaggctgaggcaggagaatggcatgaacccaggaggcggagcttgcagtgagccgagattgtgccactgcactccagcctgggcaacatagcgagactccgtctcaaaaaaaaaaaaaaaagttaagaaaatagtcattcattgattaaagttaccaaaaaacccttccacattgagagaacagggtgttaaaactcagaaaccttttcaagccccaagatgagcaaacttgctcctcttatttcctagcagcagatgttcctgagaaaggggtagctgtgcttgagccattccatcattcatccaagccatccatctatccatctattcatcatcaatccaagatccaaacatttatctatttatctatccacccatccatccaaccagtcatacaaccatccatttaactattctttattcatcatccatccaactaaatctattcatccctctgtcatccattcattcctccctccctccctccctccctccctccctccatccatccatccatcatctgtctaacatccagccaaccatccatccattcaacattgaactatccattattcactcatccatccaaacatgcatccattcagtcatcacctattcatccatccattcatcctccaaccattcatctgttcatttgaagttgatgtgacacctactggggtccaagcacaatgcttaggccttgactttgtccttgacctcaaggaacccatagacatatattaaaaacagctgataaaggggtgctgggatggaagtgagtaccaaccaggcactgagaagtgactgactctgctgggttagcagaaggaagacattaaggagaggatggcccattagttggatcttgaatggactcaaaaggagtatattgtaatcccagtactttgggaggctgagttgggagggtcgcttgagcccaggagttcaaaaccagcctaagcaacatagcaagacgctgtctttacaaaaaattaaaaattagccaggtgttttggtgcacacctgtagttccagctactctggaggctgagttgggaggatcgcttgagcccaggagtttgaggctacattgagctgtgattgcaccactgcactctagcctgggcgacagagacagaccctgtctctgaaaaacaaaacaaacaaaaggagtatgttaggccattgtaggggaggaggagaggccttctaagcagggactgtcacaaaggaatgaaagagcctaacagcctggcctgccacaggtttctcagacacttgggatagctggcatatggtgttggggtgagagaccagctagtgatgatgtggggtggtctggtgttgacccccagaggccagagaagacttctgcatggaggatggagtgagcatggagtgtgcgactgccataggccctgctcagtgccctacaccccgtgtgtgcctgtgacacctgatggcctatgcaccccatacacacagctggacagcagaccccggctgccctggctgaggcaggtgtgcccatctgtacccacctttgctttggctcattggctcctggtctcctgttgccgagcacctgtctagacagaatgatgttttgtgtctgtgcaaaacagacacgctggagcttcgtgtttgcagagcttcatgcttcagttggtaccccgtgaggcttgtgtgggcagctgttcagaaacctcaattgggccctctggcatttgtgagaaccttgggctggaacccacccggctggcagtgcaggagagcagcccttccccctcgagggccttgtccctttcacctgtgccgtgtctgtgtgacactgaagctctgtctggtgcgggttgaagtttgtgacccccacttaccaggcccagagcatgcatggtggactgtgggagatagtcattgggatttttcatttgattttatgttttttttttaatcaaggtaaaatacatgtaacatttaccatcttaaccatttaaaaataacacagttcagtggtgttgagtatgttcatgttgttcagccatcaccatctgtcactgaatgtttttgtcttgtacaacaaaaactctggactcagccaggcactgtggctcatgcctataatcccagcactttgggagttcgaggcgggcagaccacctgaagtcaggagttcaagaccagtctggccaacgtggtgaaaccccgtctctactaaaaatacaaaataattagccaggcatggtagcgggcgcctgtaatcccagctcctcaggaggctgaggcaggagaatcgcttgaacccgggaggcggaggttgcagcgaactgagatcggtccactgcactccagcctgggcaacagagcgagactccgtctaaaaacaaaccaaaaaaagcttctggactcattaaatataggctttccatttcccctccccgcggcaaccactgttctactttctgtatggatttggctaatcgaggtacttcatatgagtggattcatatagccttcgtcttttgttcctggcttatttcacgtaacgtcatgtcctcaaggttcatcggtgttgtagcatgcattagaatctcctttcttttagccgggcgcggtggctcacgcctgtaatcccagcactttggtaggccgaagtgtggatcacctgagctcaggagttcaagaccacccaggacaacatcatgagaccccatctctactaaaaatacaaaaaaatgaaccgggtgtggtggcacacgcctctagtctcagctacttgggaggctgaggcaggagaatcgcttgagccccagaggtgaaggttgcagtgagccgagatcacgccactgcactccagcttgggctacagagtgagactctgtctcaaaaaaaaagaatctcttttctttttaaagctgaataatattccattggtagacacacattttgtttatccatctctctgccagtagacacttgggttgcctccaccttttggctgttgtgaataatgttggcaggaacatgggtgtacaaatttcgtggcttgtttgctaatttatttattcatttttattttatttttttgagatggagtctcgctctgttgcccaggctggagtgcagtggcgcgatctcggctcactgcaacctcccctgcctcccgggttcacaccattctgcctcagcctcccaagtagctgggactacaggcacccgccaccacacctggctaattttttgtattttcagtagaaacggggtttcaccgtgttagccaggatggtcttgatctcctgaccttgtgatccgcgcccagcctattttttaatttttttagagatggggtcttgctgtgttgcccaggctggtctcaacctcctggcctcaggccatcctcctgccttagccccctgagtaactgtgattacagacatgcaccactgcgcccctactcaatggtatttttcacatatcagatttttacattatttgcccctcacccacttaacagctatttgtttttcaactaacttcctttactgtttcaacaaatttccaattatagtaatttttaccctagaaaaaagaaattatgggttgaaggtaaaacaaaaatacatatcttgtgaattatctgttctttttcaaacatcttaaagacttaggctgggcacagcagctcacacctgtattaccgggaggctgaggcaggaggattgcttgagcccaggaatttgagagcagcctgggcaacaaagtgagaccccatctctacaaaaaaatttgaaaattagctgggcatggtggcatggacctatagtcctggccgcttgagaaactgaggtgggaagatagcttgagcccgggaggtcgaggttgcggtgagccacaattgtgccactgtactccagcctgggtgacagagtaagaccctgtctcaaaaagaaaaaaaaaaaaaaaattaaaggcttgaaagatgtcatgatgtcatttgatggttgtatatgtgcacgtatgtgcattcaggtgtaatttacagacaatgaaagtcactcttggtatactgttctgtgaggtgtgacagcgttctgtagccattaccttcatcaagatacacagcaggcctatcaccccagaaacttgcattaccccttgttccttgtaggcatttctcctacttgcagcccacgacaccactgatgtgctttctccccttacagtttagcacttttccgaatgtcatataaatagaattgtacagtgtgtaaccttttggctctggcttttttcactttgataatgcatttgaaattcatgcaagttgtgtgtaccaatagggcattcctttttattaccgaggattatttcatcccacagatgggtcagtactgttcttcccctttctatcccactaacatctttattcagatgtaacatacataccatagagttcacccgtttaaaatggaccattcagtggtggttagtattatctcagagttgtgcagtcatcatcactgtctgattgcagatcattttcatcacccccaaaagaaaccctatacctattagcactctctccccatccccttcttctgttagtcctggcaaccaccagtctgctttctgcctctgtggatttgtcttttctgggcttttcataaatgggatcacatggtacatagcttttggtgacagagttcttagagcttctttttttatttgtttgttttttgttgagacggagtcttgctctgtcgcccaggctggagtgcagtggcgcgatctcggctcactgcaagctccgcctcccgggttcacaccattctcctgcctcagcctcccaagtagctgggactacaggcgcccgccactacacccagctaatttttttgtatttttagtaaagacagggtttcactgtgttagccaggatggtctcgatttcctgacctcgtgatccgcctgccttggcctcctaaagtgctgggattacagacgtgaccactgcgcccggcccttttttttgagacagtctcactctgttgcccaggctggagtgcagtggtacaatcttggctcactgcagcctccgcctgccgggttcaaggattctcctgcctcagcctcccgagcagctgggattacaggcgcccaccaccacgcctggctagttttttttgttttgttttgttttgttttttgtatttttaatagagacagggtttcatcatgttgtccaggctggttgtaaactcctaacctcaggtgatccacccgccttggcctcccagagtgctgggattatcttagagcttctcaatagaagtcctatcttccaggccacatctcaccctccaggggtaggggctggtggagctgttctcactcagtttgtcctcagttccttcttgagcctggacccttccctctagatttggggctgctcctctcagagtgccccagaacaaaaccccctccctgttcccacttcccactgtctgcaggactcccctaccccataaccagggtcctgccagccctaccctcagcctcccataagggtctgaagtggcaggtggatgggaaactgcactctctgacctctgcaaggggactgctgctttcccatgagcttctcctctttccgttgctggtttcttctttgttatctttgctgctggagtggccagaccctgggaagcgggctggagagaggagagaagccatcgagccacatggacccctacagcccggaatctgagctgtggtaggattggctgcgattgggattggcagacacactgggtttgtacaggaggggaccctgaaggatgggctgtggtcaaagtgggatcccttcactgtccatagtccttggatctgaaactgctgacaggtgcccctgggaactgctgtggtatttggagtctatagagacacccattgctcaggaccccagggccttaacagggagtacactggcttctgggaagcttgatggagttgttgctgcataggtgcagaaaatcccagcagtggagtaaggcctgaagtaagcccccactgggctctgtggggcctggggcagcctcctctgttgcagggccgccagcatctccagcagaagtgcagtgcttgctctggggacacaggggccttttggaatgagcatgtggacttggcttatggattgtgcctaccccagagcgttgctgtgtctctcaacacacacagcttccatgggctgctcactccaattctgatggagagggcatttatgactctgtccgttggtttgttttctcactgaagaggaacatagatgcacctgctctctgggcaagagatgtggcagctgcaagctgcacaccctgttctgaatattgcccagaccagaatatgaattacttggtcataaatcagtgtcttgtctgcagaaaacttggcaatgtgagggacggcagctttaacttgattcctgggaggctgccggcctcaaaaaggacaaggactggcaatcagatgggcattctctctaatttgggaggctttcgggcttcctcacggagtgctgctcctggggacgtaccacaagaacctcccttgtctagttttgttctgacgcttgggctcattcacctgactgtctccttgcttgtctggctctcaggaaagccttcccggagaggatgtggctgacccctgcagccatctctccacagacaatcatggccctgagcttggctgtccttggttgggtacatccaaggctctgcctgccagggtaggcactggccaggctgtgggatggcagcgttgctgacttgtgctcctgagtcctgggggccctgagtgagcctccgtgcaggagtcgggctgggctgagaggtgtggagagtcgttcccttaatggatggtcaggcacagcagctatgggctcaaattccggagggacgctgagccaggtcccagcctgtgcactgagcatgtcattcactttgagatcccctctagggtaaggcacaccgtgagtggatgtgccactaagaaggaggcagcaggctgagcgtggtggctcacgcctgtaatcccagctctttgggaggccaaggtgggaagattgcttgaagccagaagtttgagaccagcctgggcaagaaagtgagagctcgtctctccaaaaaaacgtaaaaatattaattgctggggcgtggtggtgcatgcctgtagtcctagctactcaggaggctgaggcaggagaatcgcctgaatgacccaggagttcaaggctatagtgagctatgattgcaccactgtacttcagcctgggcaacagagcaagacccctgtctcttaaaaaaaaaaaaaaagaagaagaaggaggaggaagacagtactcccagttatcattgcgagaggcagagatgcgagattccactttgaattatgttgaaatttggggaaaatgcatgcctgataatgggtaaaatacagtaagtttcctcatctgtgaaatagaaatcccactagtcgttgactcaggaacttgctgtgaagattagagatgaggtgtgcaaaaaaaagcacctagcgtggctgctggcatgccctgagtgcttaataacatttgttattctcattttattgttgttatcgtagttgctgttatgacagatagcgggagaggatgttggctgctttatcagctggctggatgtttggtttgtttttttttttttgtgagggttaaagtgggagatgggaagctgtctttttccatcagagttggaaaggcccggagtgttcatttctcagcaataattgttttcaaatggttttattttagggatagatcccttctttgccaatggtatttcagatgaccccccagtatatgaaaaagatgaaagaggagccacaggtcctgaaggctgcccagctcagcctccccacccaacctgggctctgaggacctggcttgggaggtgctgctcttggcagccccagccttccacctctgtggcctgtgccatggccaggaggacctgcatttccttcggactgtctctctgctcaggcggattatttcgtgcttcgtgtgccctcccagggtagggacggggaagctgtgaggatgctctgtggggatcggctccctgtgttgtccatgtcttcttttaggtggagttggctaggcagggaacctggcaccatttccttctcagagcagagaaacagagtcggcgtttgtgagcgtgcattgtccaaacctgcatttggaaggggtcaaagtaggctgggctttgtttttactttttctttttaaattatgatgaactatacataatgtaaaatttaccacttcagccatttttaagcatacgatcgatgcatgacattaactacattgatggtgttgggcaaccatcaccactatccatctccagaactttttcatcttccccagactgaaggtctgtacccatttatagccagtaaacaactctctactccctcctccctcagcccctggccaccaccatcctactctatgtctatgaatttgactactctagagacctcatatgagtggagtcctacagcgtttgtccatttgcatctggtttatttcacttaacataatgtcctcaagtttcatccttgccttggcatgtattagaattttcttcctttttaaggctgaataatattccattatatgtctgcaccgcattttgcttatgcatccattggtggatggacacctggcttgtttctgccttttgtaaagcatgctgctgtgaacacgggtatacatgcttttactcttgaccccttgcaaacaggtctgtcttgcacatgtgccccaggtaccactcagccatctgctcattaatgggagaggggagaaccttcccggttctcttgagtaactaccatgatcacagctttctggaatgtagcaggttacttgataaagagggcgggaattcttagaaaggagggtttctggctgcaagccccatacctgttttctgccaccttctctgccaagggagcttgagccagccatttctgggaagtggtgagcctcagatatggttcagggaagatgggaagtgttacagtgtaattccatctgctgatggggacaggcacaaacctggtggcttgttgtccttggaacagtcagtgatgaaggcagagtggcggtaggacagggaccccgcttagttatgacactgcctcctaagtggaactaagtggaaggtctagtggggccttcttcgtgggttgggacagtggttctgcacccccactcagcagctcaggaactgaagttagagcctgccttcaggggatgggcatgtgtacaagggataggggaccagttaatccaggagttagatggtgactgagactccaggaatttcccctttcctgtaaacatgggtcattttctagaattaccacgttccctttaattttgccatgtttaggaaatctggctgagctggtaattaccaagtctaactgagaaatgtcttatatgtaaccttctgtttcccttgagtgtttcggaggaagctgtgggcacgttttatggataggtgctccgagttctttccgctttggtccagtctgagtggctctgataagcgttggcaacaccaccgatttttgtggggcctggcttcagaacatgaatgtctgtgtttctgcaaaaccaagtgtactcactgcctccttttaaaatcatgctacaaggatgtctttcactttgaattctgcgcttacattgttcaagaggcatcaccatgtttataacctcagacgcagtaattccaccctagggcattttcctaaggaaaattgcttcccccttttcttttatggtagtattatgtgaaattattcattgtattcataacagtggaaagctggaaacaaactgagcatcctgtaatacaaaaggggttccattagcttggtagacgattctgtcatcatccgatggtaaggatgaaaatgaattagcaacgtggaacattgtcataagtggaaaaagtgagatgcccaaagtgtgatgatttgtatcagtcatctcttgttcggtaacaaaccatcccaaagtttagaggcttaaaacaatgcgatttaatcgcagtgccatctggcttggtatgaggtggttctgctgtcacacaggcttggtcatgtgactgtattcagtttgtggtttgactgccgctggcatccgaggtggcctaaccgttgtagctaaggacttggtagggacaccggaaggctgagacctctctctccttgtggtccgtcattgttctgcagtgaagcctgagttgcttctcatggaggctaggttccaagagcaaaggtggatgctgcagggcttcctgaggcctgggctatggaacttctcagctgaacttccaccggattctgttggtacagtgtgtcgcaagtcttgcccagatctaagcgggggtagaaagctggactctacctcttgatgggaggagcagcagtgtcatgtggacacacggcgtggacacaaggcatgattctcaggggctctggtgattgctcccaccacaggattttagttacacagtcacaggacaaggactggaagtgattgtgggaaaatgatcctagaccattggtagaggaggtgaggttgtggatgacttttttagatttttgctgttgccatgttatatagtaggttcaaagtaaaaaatccttagcatgttatccactggactcctagttcaagattgctggggtgtcagatccactgttaggtcccataaacttgcaggctcggccagtgcagaacctctgcagcctggccttcgggaagaagacatccagagatagtgaccacaccatggggtaccttcaagctctggtgctctctcttcgccttgctgaccttgatggagtggataggccttgggttcaacatgaattgacccaggccatgggggcattggttggcctcctctgtaaggtaggcgtggggctcagcctgcaagagctgaccatacttatgtaggattagggggcatcggtgggaaccctggtgtccaaggacagtattgtctggttgactgaagttagggaagtgggtggggaacatggaattgtcaatccttcaggctccttttgaaggtcattgttttcctaaacagatggttatttggactcttacaagttctctgtaagtttgtaaatgtttgaaaataaatagtggaataaataaatacatgggaaaccgcactttgcctacgtgtgggatgctcgtgagacctggagggagggcactcccatgaaggcggggatcccgggtaggcggtgatctgcagctgtggccgcctgctcggacaggaaaggccttgacgtccagatcctgctggtgggagagccgtggcccaggctcctacattgccttggggaggagagtcaggccctgcagggaagggttgtgaacctgctctgggcaaatgggcctggctcctgggaaacttcgggcctgcagtaaccctactctgaccagaggaatccttcccctgtcgcattggcatccctcccctcactgttctcttcattctggacccccttgtcatcacgatgccagtgctgtccctttggtgtggggtttgtgctctgacctgaccctcaggccctgccagtgccctggcttccaggcagatctgggcaggcaggtctgagcccccggagctgggtaagcatctggggcatgtgaggattgcaggaggtgacccgggacagtgcctcacgcccagggtgaccagaaactgtgttcccttccctaacccaccgggtttaaactttttacttgctagccatagagctcttaatcagacaatatccaggggaacccccattatgtaaggcaggtaaagctggtggaagctctcccacccactagttgtccctgctcagccttggcacggggccactgtgggaccggagagctgggaagccaccacctcagtccctgccagtctctggtctgatggtgaggaggggtctggcctgctcagtggcagggtgcggaggtgaggctggtggctgttcttcagctgtgggactcgtgtggggacaagctgaacagtgtgctgatctctgatcaccactcaagccacaagtgactggacaggcatggacctgtgtcctcatagtgaggacccatggggcttcacccaggacagcctggttcgcctgccctccgatgctggtggaggggaggcaaggcagaggggactcctgtaaagggctgtttttttctgtcctggaatgagcacattctgagggtgagtggctgtcagcagttaggaaaaattgcctgttgacttgtttcattaagaggccccttgccgagggtgaggtcgcagcccggccctgctcagggaggaagcggtgtttacagagcggccagctggtgccgggtgaggaggtggctgatccctcgttatggagctgagaaggcctgcgcttccagcccattcctgccatgccgctgccctaatggctgtgacaatggatggatggatggacggagggccaggccaaccaggcagtgaaaacaggaaacctaatcttttaaaaataatccagggggaggggagaaagtgaagcagcaaagcccttaagccgacagatggccctggtggggtgtgtcttccaactgggtaggtgcttctcaaggctgaaaattccagtgagtcggtgaaagctgagcgtgcccaccaaagacacttgaatgggcggctggcattttcaagctctgttccttatgttagacgatgttgttttagcacaaagcctccccccggatcccaagcctctccccaccatggctccagagtcatccctatgtggaacccagcggggcagtctgaccttgtccctttggctgtgaccctgtcccacccttggcctctgtccctggttcttgcccaggtccactattgcatggccagattcatcctcacagggacctgaccgctgttcccttctcacaaacctctgagttgcccatgggctgaaggtcaaggtcacgcatctcaggcaggcaggtgtgcaggaccctccacgctcgtgggcactggcggtgcgggagcacagctccctcctctctgctagctctgagagtcccccgccacccctctgtgtgcttcctgcaccccctctccttgcctagaatgtcccccacaatgtctccacttgcccagctctgtcctctgtgtccagctttgaggctactttctgcagtcaccactattatcccaccccatgtagttctctgtccccgacctgcatgtaacctgtttccctcctccggccgctctcagccgctccttcatgcctccttcctgggctccctttggtacttgtgtgtgcaccgccttctcgcctccaagtctgcagttcctggagcattgagtcatcctgttaccattgcttctgactcgaaggacacggccccttggggctggctggtgtcatgtgtggctgcacagaggggaggggctgttctgccacctgccctttgaggctgtgtgggcacggttccctctagagctccatgtctagcagagcatgcgggggtcctgctgtgcccccactcccatagtgcttgaaccacttcaccccttgcatggggaccaacaggatctacctccctctgtcgaatgtacttctgaaaggaggaaggttacactgaagtttcacctaccgtccatgggattttgaccctgctgtagtgacagctgcatgtttggttctaggggaggaggggtgaatgacttatcttggagaagccagagccaggtgtcagggaatggcctctgtgtctgccacctcctgctgcctctctgcctgggtcatttggttcagtggctataactgtcttggagcagcatttgcttccaggttgggttcaggtatgaagtgctgaaaacatgggaatccctgagcccagccccacccaggcttggtctgctaggggaggtggaagcagggcttctgaggccctgaggctgcctggggagtgcgtttcttctccacccacttgcaagctcagctcacttcctcttactgtatacttggtgtttcattcacactccttgcagcatgcttctgggatatgatgaaaatcagctgtgggtgttgatttcggagctgggcaacgatcctctctggacccgcattcccatctgtaagatgggggtagtaacctccaccctcactgcttcctggaattgttgatgcatcagagagagcagccagtttgcactgtgggcttccagggagatttatttcatgccatggttccccttttggataaggggctagatttgctttcttcatcagattgtccccggggacacacacaggagttgctctcacgtcgttgcctcttggtatctttgaagcctgtctgttagaacccgcctctttgatggtagggcaggatttggagaggtgatggcctctttgggttgaatttctcactctaatgggctcacagtaccttctgattacctcctggttcagcttccttgacaacaaactagaattgcttcagatgcaatacttcattcttcctagtgcatgagtaattcatatccactatttgctccctcttttacaaattggaggatggcgatgcagatggaagatgacctgctcatgcatcaggccgagacttcaggcttccgaggcacatgtttgaggttgagactccctagggagagtggagtcacctttgctttgcagaggagccatgggggaccatgtctcagcacctctgaaaggttttctgccccatccagtctgctgcttctctcccctccctccttcaccctgttccccttcatcaggggtgtaaatgatggtcttcctgtcttcccatgcacctcccttaggaccagagcaggtgggagatgtcttcacaggagggttccaggatgataggtttggagcaaagggctgggggcttctggggagccccattcctgcacctccatgctgaatgaagaggccacacgaggatgctcacactgctcagtgcttcttagagaaagctgctggctctgattaggtctggtagggggcagggtccttatttctcaggactcaagacagatcctcaatcaatggcaagagtcatttttgttttcccgccaggctcactagagtttctgtctcttcccacttttctttgtgggacagctttcgggagggtggggttgtctttgttatgagaagtgacagccagatggactcagtggctcacacctgtaatcccagcactttgcggggccgaggcaggcagaatctgaggtcaggagttcgagaccagcctggctaacatgttgaaaccctgtttttactgaaaagacaaaaaattagctgggcgtggtggcaggcgcctgtaattccagctacttgggaggctgaggcaggagaatcacttgaacccaggaggcggaggttgcagtgagctgagatcatgccactgcactccagcttgggcaacagagtgagactctgtctcaaaaaacaaaaaaaagagagagaagtgatagccctccccgtcttctcacctgtcactcctcttggtctccctgtggagcaagtttcctgcagtcactatgtgctttgttcacttctacatccacagtgcctaaaacaatgccagcacgtagtaggtgctcagttaatgcttgcagagtgaacaggtgacacacctgcctggcgcgtcttgggccccttattaggcacagtaaggcatagaaaactgtctgattccggccgagtttccaggctaagtgggaaggtggaacacagcatatgaagattaaaatgagaagtaaagtgatagttcacagtatgttggtgggaaaaggttgatacgattgtcagataaattgcacaagtgctaagtgctgagaaagttcagagcaggggaagtggttcccgaggaaggaggcagaggagtgtagattttgtagagaaggctaagagagggtgggatgtggcaaagggcgaagggtagaaggagacatgacctgggagaggggagcgtggcaggggcccatgggcttcagggctgtgaccaacagcatgctggtgaacagaccagacgtgggctatgttgtctgggcctgtgaagctgagttcaagagcccaagccttcctccctcatgcccatgctgttggaaccttgaggtggttacctgggcagaattcctgtcctggtctctgggcagcatctctcctgcttctgataaagactaacaaggtgtcttagtctgttcaggctgccataacaaaatgccaggctgggctgtttataaacaagagagatttagtgcgcacagttctggatttggggaagtttgagatcaaggcacctacagattacatgttagataagggctccctgcttcatagatggcatcttcctgctgtttttcatgtggcagaagggccaaagaagctctcttgggcttcttattgtaaaggcattaatttcattcatgagggttccacccttacgacctcatcacctcccagcagccccacctcttagtattatcacattgggggttagactttaacataagagctttggtggggggtacagtattaagtccatagcacaaggggtgacaccttggagtgggtggagggtgaccacctagcagtgtgacaagaactccactaagggaattggggtgtgagtgtgagcatgtgtgagtatttgtatgtgcacacttgtgtgtgtacatgcatatctccaagtgtccatgtatggctgtgtgagtgcatgtgcctgtgtgtggcccattgggggacaggagcaggggccttgaggctgggctttgggctttgtgtacatttcttagcatcttgtagatgcggatgctgactccctcctatggtgcctctcaagatgaaatgagagcatatccaaagccctgtgtgcacagtcgctcccttcttccctcttctcctggtatcagcccccctattctggctggctgagccctaggctgccggtgcagggggtactcagggaggagggctcaggcaggcagcagaggcctggagggcctggctctgtgggatctgtgaccttctccactccagttggcaagggtccaggtgagtctcccaccctcccagtgcacagcgagatttcaggttttgtttctagaccctgattgccatgtggttttcacaccgcctctcctcctgccattgacagtggggggctttgattgctgtcccccctgtaatgggaacactttgctgaccttttccttcctttccccgctaaatgattcctggccaaagccctgcctccccatggggagccgcctcttcctgcctttcccaaaggcacaggccctgatgcccaggaccccgtgtaggacacacagggacagacaggagtgcccttatctcacccgctggtttggagggacagtttatctctcttttccacatggtctaaaggaagctggtgctgaaatggcagagacagggactgactccacaacaggaagacaggctcgggcgcagatctctcgactgtggccgccacacagtggtcactgctgttgtcctgggccacctctctgatccccagggctctcctgtcccaagtggctgcctgaattggttttttgcactggcatttatacctttacttggttaatgattcttagagttctttatggactgtagggggaggaccgaggtccaggtggtggtgatggctgctttctaactggcagtcctgggcagtgccttgaggggaggcatttcttctaaagctcagctctcacttgtgcctccaggagagtcaaactgccgccttgctctgagccatctcaaagtgaggtgagccacattctctcagcagggtggtgggttggcagatgacttgaaggaagagcccactccctgcttacccactctcgttttaatacgccaagtctgcccagagacgctggcctcctcaaaggaggaaagacaccctccaaaacctgctgagaggccgggggctgtagctcacgcctgtaatcccaacactttgggaggccaaggtgggcggatcacttgaggtcaggagttccagaccagcctggcccacacagtgaaaccctgtctctactaagaatacaaaaatcagccaggcatggtggcacacgcctgtgatcccagctacttgggaggctgagtcaggataatcgcttgaacccagaaggtagaggttgcagtaagccgagatcacgccactgcactccatcctgggcgacagagcaagactccatcccccccaaaaaaacaaaacctggacagagtggccccctgcaggccccccgcttcttggggctggagcaagtgttcttatagatgtctctggtcgtcttggccactggctcggagacagccaccgagacccggcatttggagcagctggctgggatgctgcagggaggggtgtccaagcaggaggcagccaagcctgcctggagcaggataagatgagctcccctctgagactcagtattttctgttcaatgaaaggaacagtccagtatttgagacaggagaaccggaattgacttgactggtctgtggtgctttttttttttttttcctgtgccttgattcttccatttaaatacagaggacacctgaccctaaggcgcatggaccagagacatcatctgaacccagagtagcgtgcatggtgattattttgagatttcctctctgtccccatctgggctcattttcactggatggaccccaccatgcttcttagaccctgcggcaggctggccagcccaggtggagggcatgcgctttgccaaaggcgagaccgctggctggagactggactgcggggccatcctccaggctcttgcacggggacctggaggatgtggcccaagctcagtctccttcagtctgcattggtggctaatcaggacacgggtatgggggaaatccctgtaggtctggaggtggctgggatggcccagggcttgtttctcaccctttacctctagtttatatcccactgacaccgaggtttattcgcaatgcacttcagcagatagggtgatggggtagaatcacagagctgaggagtccacggtaaagaattccaggtccctgtgcttctcctgcatcccagctcttctgtcattggaaggcagtcatccaagactcctcccttttctggcctttgctgtcagggagcctgggggccagttcactattcatttcgcacagtcagtgcatcccagggcctgaaacacgctttgagccttcatttttgttttcttcccagtggccttatttttacactgtttgatttcttaaggctgctttggatccttttaaaagtaggcgagtgaaaagctacacaaacaaactcctgggcttggcaccctcctgtgcccacatccggcgccctttctttgggacctgccggagcctgggtcccctggcagggtggggcaggatagggtggggtgttgcctgagaaatggtgcaaaccttcttgcactccgtaaatgattcatttccttcaaatgtcctatgctgttttccagcagaatctccattatgtatgaatcaagatcctggctgacattttctgccttggctgttgtgagctttcccgtcagaaatatccttcccatggggcctgaagtaattattttatatttattggcattaagtgtatgagagagagagagagagagagagtgtgtgtgtgtgtgtgtgtgtgtgtgtcagaagtggtgtatcagctgccacatagtaagagagcaaaggatcttcttttgtcttatggtgttttacctgtgctgattggttcttggcagcctttaaatgcctaggcagagaggaagagagaggttcctaagcttcatggtgaatttctaagtctgtgttgactgcaggaaatgtatgaggaaaggatggtggttgaggcctctccctcacatttaggccaggggttggcaaattgcagcttagtcctgtctgctgcctgtttttgtaaataaaattttattggaacacagcttgctcattggcttatgtataacatttggctgctttcatgctatgatgacaaggttgagtagttgagacagatgccatgtggcttgcaaagctgaagatattcattagctggctctttccaggaaaagtttgacccctgctttaggataaaacagagaaatggagagacatggaatagcagagtatcttttcaactaggttcaatatgaatgaacaggtcccctcagttgcacctgaaaggggccagaagtcctataggtttgggtttgggggagattgaagttagacttgcttggttcagagaccaggccaggatcgagcatttgccattggtgacctggaggtgtctggagcaggatccttttaaataggcaagctgcttgctgggaacacagttcaccttaagctttaaaaaaaattccttcaaagccaaaaaccatgcaaatatggagctgcctgacaagccgaatgattgatagggtagaaaatagggtctgtcataaaatatttgaggaggtggatttttacagcagggagaagcaggctgacaagtgccacttgttaatggtgactaccaccttccgtacctactgtgtgccaggcatagcaatagacactttgttattgtgttccgtctagaaacaaccctgctaagtagctcccagtattccccagttaccagtggaggctccaaagatatatcttttgtgtgaattgcacagcccacgatcagggaggaagccatcccctgtggtccagccctctgcacaggtaatgggggaattagctggaattgcagccatcctgtaggacataaggaagaacatcttgactgtaagcatggttaaacactgggatgagctgtcagggaagcgtgagagatccccatctgggaggagctttggaaaggagaaacatttgtaagtctattttcagctttcagctgcatggtgacacagggcattggccttgatggcctctaggagatcttgtgacctttctgatttcagcattctctctcctgtcacatcagaccctttgctggtttagatcacaatagtactgccagtgctgcacccttttagaacttctaaggccatgagttattggagattcagtttccagggtggttcttgaacctaagaaatcttctagaagcctgggtcatgttgtgaggtccttgtgcctgttgggtcgtggttctgtctgcctcaggttactgttggccccagggctctttttcctgcaggccttagttagcaccatgaatggttaggggtatgggggtcagggtgagtggtcaccagtgggtttcaagggattggcctatttcatctaagttgccaaacttatgtgcacagagttgttcgcagtatttccctagcatcttcttaatgtgtgtgggatcagtagtgatatcccctctttcatttctgattttggtcatttgtgcctttctttttttgtttgttagtctgctagaagtctgttacttctttttgttgggtttactttgttcatcttttaaaaaaaattttagagacctttcctcttttctgatataagcatttgatgctgtgaatttgcctccaagcactgctttagctgcatcctacaaatttttatatattgcatttttattttcagtcattccaaaccagtttctaattttcctcgagacttcctttttcatctgtggatcatttagtagtgtttaatagtaatgtttcatttctaagtatttggaggtttttccaggtgtcattctgttactgatttttagtcaaaaataaatgtattagtttcctattgcagctgcaataaattgccacaaacttagtgacttcaaacaacaaaacatactaccttatagttctggccagaagcttaaaagaggccttatagggctaagtcttagttttccttcatctgagaaggtctttattttgccttcattcctgaaggatattttcattggatataacattctgggttgacagttcctttcttttaggactttaagatgtttcatccccttctggcctctatagtttctgatgggaaatctacagttacgtgaatccttattctcctgtatgtaatatgttgtttttctctgactgctttcaagacttttttctttaactttggttttctgtgcttttattatgatatgtctggctgtagttttctttctttatcctgtttggggttcactgcatttctcgggtctgtaaatttatgttcttcccctaatttgggaagtgttcagctattgtattttccgatactgttttctgcttccatctctcctctctttctgggacacctgggacatgaaattagacatcaacatcttttgatgttgttccatagatgcttgaggttttattccatttttctccatttttgttttctctctcttatttagattggataatttctattgatctatctttaagttcactgactccattgtcatctccattctgctgttgaacccctccaggtaattgtttattttttggttctaaaattcctatttggttcttttttatagcttctattttttttggctgagaaggcctgtctttttatttgtttcaagagtctttgtcctttcttcttagagcatggttataatagctgctttaaagtcttagtctgataattcaaacatttgggtcatcttggggttgatgttagttgattgccttttcctttcacagtttatgttgcttagttctctgtcaagtaattttgggttatatcctggacatcttgagtgtaatattatgagactccggaccctgtttaaatgttctgaaaatgttgactgatttttttttttttaaacaggcagtcaacccagttagattcagatggcatatcctggctcactttctcagctctgtggttccggtatccaccctgctgttgaccactgagggatcagtttgaaactgggcagtgatctgtgctgtgctgattctaagtgttttcacacatgtgcagtttaggggtgagcccagggcttcttatgaagatttaaaggatcccttctccagctccctcttctccatgatcttccctatactctctacttccccatgtcccccctttcaggtgttctgattagaaggcagttcccccctgagggtccactgttgctgtgctggtgaagggggcaggggcttcacctatttggtggcgcttggttagtgtagagtggaaagagtccacgggtctccaccccagggaggccgctgcttgcatctgtggggagaggaatggacacgttgtttgtgctggggaaaggtggataaagccaaaagagttcaatctacaggatttctccttcctgggcttttggttagagagagcaagcttttctgtttggttcttttttttttttcctcttgtctgtgcctgttggtagtttcaagctactctagtgcccatgctgggaggcaaaattccaaaaactggaaaaccagaaaaatcactgccaaggtgtccttaaagtcctgcaatctctgctcagtcctcctgcccttatctacctttttgagtcccatgatagaggtttcatgcagaatttgtacctgtggatagtgggaaaggctgtagtgtgctttttccatcttgcctggaattggaagttccaacttctacatttagacgtccttctctctgtgtgtggtgatgttccctgggatagaccactactgcccttagacagcattctgagggtggtggcccatactgatcacctcagcccacccagtaactttcctgcggcccctcccaagacccccgccccaacagggctaagctgatacacacactgcggatgcaggcctgcctgctgggccttcctggtgtttgttttttccaggcaaagcacctctctctgcctcctgctggtttattcagcagtgtcccagggtttgctcattgtctgctttgcttcagacccttctatcaaattccattgtctctgtcttaatggtctttgcagggtaggcatggccatctgcatgttcactgaagggcctgcctgcatttccagggagagaaagccttcaggccactggtgcataaagatctttggaaatgtccagaagatcccaaacattgcctgtcctgcatgccaggcctcacttgccaccagcctgctccccagccgcacatccagctgtcatttcctagagaacccatcccacgcagttgttttggacacatagcgttccttcagggaatgtggccccggggccacaggtggagtagagggcacagtatcccgaaccatctaacggggcccgactcaccctcaccatgcaccaggccagttatggtttctttctgtgtcttatttccccctccatcaaatgagagttattgtagaaaccttatagtgctgtgttgggattagcagtaaacagtttggcatgtggtagatgctcgggaaatggaagctgcccttttttcctaatgggaaagaagggattttgtttttgagacaattcccttcctctgctgctgcatagggacacctgggtgcctttctaaaattagaccagggcatggtggcttgctcgtaatcccagtgttttgagaggccaaggcgggaagatcacttgaggccaggagtttgagaccagcctgggcaacctagtgagactccgtctctataaaaaaataaaattagctggatgtggtagtgcacgcctgtagtcccagctattcaggaggctgagtcaggaagattgcttgagccccaggagtttgaggcaatggtgagccatgttcatgccactgcactccagcctagccaacagagcaagaccccgtctcataaaataaaataaaataaaataaaataaaataaaataaaataaataaaataccaacagcctgtgctggctggagccatggtgttaaaaggcccatggacttgggccatgcctgagctggctgtgctctgcctgccacttaggctgcccctccctgacccagcttgtgtggaggaggcatggaatcctacaggaatgtgaagttcatccttccctggatacttgggcaccatctggccaggctcatggagcaaatgggcctgtgagttatgtccccacccgtgcctacgcccaacctttatgccccgtttttagtgggagaattttgtttggagctgcaggtgttggggggtggcacgtctcaggctttggggtcttcctgttctctttcttggccctgctccactccttggttcccctggccctgtcttgcctgcctgttaactttgggtaccctcagcctgtcccaaggcagctcatccctcaggccctgccctgtcttgtctctccagcctcccagcccaggggcttgctctccatgtagtaactaataccttagtgtgatcctctaattttctgttgctttcttgcttccatggttgttggaagcctggagacccagtgtttggccaaggacagggcctgctggttttagagctcctggcccagtagggatgataggacccaggaccccaagtgctctaggcaggcactgttctgggtgctgtaaagcacggtgcctagcacctcacagggactcggggtgtcctggctgaccagccgaatccactttttattgacaagaagcctgggtcccagagacattaagtaacgtgctaaggtcacccacctgggcagtggtagggctgggtttgaaccaaggtctgcactgcccagctcatgaattctgctgcttgggagccagcagcactactggcacaagggtagggggacctcaggcctgtcagagagggtgcctggctctttgggagtggggggtgcaccagagtgggttggagacaggacccagagcaccaccctttacctgaccagcatcttggtggggttccccacctggaaaggcaggaccctggggtccaacagagcctattgcagatccaggttctggcccagctgggatgctcactggcttctgtggcttatcagcgagcctacctgctgcacccgtgagcatgggcggccccatctgcctcctccttcaggtgagatggcaggatcagagagatggaatgaatgctgccgtgtcgcattcatgtaggaaggccttatttacaaaccatctgtagcagtcagaaggcctgatgtggtcaggccagaccatggagcccctgttctggatccatttggcaaagatgagagagaagctgggttaggctttgttgggtaaatgcaaatgccacatctgtgtgtgcacacacataggctgagacatttttctgcgaggtgggggatcgcattgagggaagaaaaggtgctctaatagcttcagcctggacttgggtccagagctttggatagaagcatctttccagacaattgggatcctgtagaaaatctgccctctgaggctcttctatgccttctgttgtgtcctgggaccccttggcatctccaggcagagcctatacagagcatccacatcagagtcccctgtgggccccagtgcctgtagttccatctcctgcctggatgctcggttcttggagcgagcttcctgagcagcctctgcaggctccaggctctggcagcatctccacgccactcctgccggcctttctcctggtggaagcagcctgcgttgcttctctgcccggtggtgacaggctgttctcgtttggaaacagaagagacaccactgcttccccacaccgacttcctaaaacatgaggctcccttctgtggtgtatgtgtaaaatgcctggctctgtatatgcacgtggtgcacgcctggccctggggtcttcacattcttcagaagaggccaggcatggaggctcgtgcctgtaatcccagcactttgagaggctgaggcaaatgaatcatttgaggtcaagagttcgagaccagcctggctaacatggtgaaaccccgtctttgctaaaaatataaaaattagccaggtgtgggggcttacactcttgtagtcccagctattcaggaggctgaggcacaagaatcgcttgaacccaggagtcgggggttgttgtgagctgagatcacaccactgcacgccagcctgggtgacagagcgagaccctgtctcaaaaaaaaaaaaaagaaaaaaaagaaaaaaaaaaagaagaacatggtgacttcacctgcccagggaggcgtgccagccaggggcccatggagaatcagatattcagccagggacaagggcatgtcagtgggcagagtgccagggtgtgggaggctctctgggtggtcgctgaccaaaaacatcacttctgggttttgtgactcagaaatgagctcagcctgtataccctgcagatgtgatgagccccaggccgagtcctctgggggtgtcattaatggcgtgtgcatgagcattttcttctggcatttttacagagaccatgtgcagctggactctccggagacagcaaacagaaattctattatgtgtcctatcagctagtaaaggaggggagcttgccttgagttgtgtttttctgcgaccctgtgtgtttgatccttgtctgcacccagtttggccaccctgacctctgtcactcccaagtccgaggaaccagtggttatgtgaatgtgaagttatttacttcatctgtttatttagatctgggccctggggtggccccatgcgttgaataagtgtgttctacagaacccatggtccctgggttctgggtgatcagtggcctgaggagggaccagactccagcccgtcctaaggagcttatgagaagttttgaggggactggtgcctggacatgggctgtagcgtaggtggagtgtcgaggaggaccctacacacggtgagtgggagaaagcacctgggagagcatcccgcagcccaggagggtggtcaggttaagtcacagcagggatggggctatcagaatggtgggctgtgaagaactgggagggccaagactcagggaggccatctggatggggaaggtgtgagccgaggcccagaatggagcacccaggggacccaggctgatcaggtcgcagcgagcatgaggggactgtgcgaagccatgagctccagactccccagtcgtgggccctgatgcgggggtgtgtgtgagctggagccgtgggaccagggccgaacccgtgtgctggacagtcttcggggcccagacaccaagggccacccggagcctacaggaaagttggggagtagaggggcatgtgttgtatggacagagccctaccatgcttagaggagtcaggctcctcccccgactctgtggccacacattgtccctcacactcttgatttctcagccacagtgagggtgaaaaccagggtcagctcgagactatgacccagttcccatttcacctcctgggtcttctccaggttctgtggggttttttgttttgttttgtttttttgagatggagtctctcgctctgtcacccaggctggagtgcagtggtacgatcttggctcctaggttcaagtgattctcctgcctcagcctcccaagtagctgggattacaggcatgcacccagctaatttttgtatttttagtagagacggggtttcaccatgctggccagactggtctcgaactcctgacctcaagtgatccgcctgccttggcatcccaaagtgctgagattactagtgtgagccaccatgcccggccttctccaagttccgaattccctgaaagcagctgtgctgttgccctgccctctggggcacaatgttaggagtaagcagcgtttaagtgcctccctgattaagagaaagatgtatattcccactgggtggcgaggacatagatgtccaggcccatgtgttccacggcataatgtggggactgcagagaggaagggacatgtttatgtcccaggtgagtcatggaatctcagaatatgagggtgtgcatgtcagattttttcaaggaggggtgtcttagtcacttcaggctgctataacaaaaatgccataaactgggtaccttaaacaacaaacacttactcctcacagtgctggaggcaggaagtcagtatcaaggagctggaacatttggagtctgccaagggcccacttcctggttcttagccatcttcttgctgtgttctcacctggtgtggaaaggatgggggctgtctctggggtttcaaaagggcactaatccccttcatgagggttccgtcctcctgacctaatcacccccaaaggccccacctctaaataccatcacattgggggttagatttcaacataggaattttgcagagatgtgaacatttattctgtgtgctgtaaggggcatctcagagtgccacccccacatctccaaagctgctggaccttgcatatgggagctgactctcttggggctggtgtgactcatggctggaggcctggcttgttaacccagctctgaggtcctctgggtgccacctcctgcacaccagccagccaggtggcctccacgtaccttctgtttcatggagaagagctacttgcttaagacaggttcctcaaacccctggcatctggtctcaggtgactctgagcatctcatggctacctcctccccacctgcagcctcatctccaccctgccgcactctatgactgagcagcacagggcgccaggggatgtttgtctgcactgctgctgtgttgctgacttatgagacctctttggaaggggctcaacaggtgaggagagtggtgtgaatccacttgtcctaatagaccactccaactttctgaacatcccaggctttcctggtacagtccccatcttccagccaagaggagagcatggctcaggtgggattcaggcgagaacagggcaacgcacacctactagccaagatacaaagcacttaatacagggaggagtcatgtgggcagagcccagtgggtctgggttcccctcatgaggaccgagaggggaccaacacctgttagatgtctgctgtgttcctgacgttggcctgggtgtgggatgtgactgggtgtctgttgctctccttggcaggtgcctgccctggaggtaaagaggctgggacagtaactttaggcagtcagctggggtctgtctgttaagcaaggagcaggaatcagccttgttctctactggcctgtctgggaagcgtgaacaaattctgtgtcttgaatagtacccgagtcagttgccagccctgtgctggctctggcagggggtagctgtggaggcaagagtgttgggcagggtgacctgattgagccaagctgttattcttccacctgaggattttccagaagaagtgccaggctcagaaccggcgtcagatacctctgagagcctttccggttgccacggttctcccaggatcgtggagttcttgaaggaaggccttttcctggcgtgtctgcagtggcatggtgatatagccacgccgcccctgtttgtgagttgaatctctgcagaactcacttttcccaggaggtgctttcagaatgcagcataccacagtcctcatcaggatctgctcatttggctgggctggcaggtggctgagttggctcccggagcgggtgtctagcagctgtgctcatggaggcaggctgggcgtgtgaatctcacctcctcccacggccccctggggaagcaggataggagctgggcctggttcccgagcctggccgattgggagtaacaggtgggatctggaccaggttgtcacacccacaatgacagctgggattatcaccgtgggtggtaattcccacatgacagtttcgagtttcaggtcaagagctgggtcctctctctcctcttgcatctggacagagagatccttgccggctggttttctggctcgttcctcagctgttttctgtggcctgcagagtttgcagccccaggggagtaaggaaagctctgctctggcctgatttttgctggagaagagaaatgtggaagtcagggtggtggcctttgcagtgggtcagctttgggctgctgagacgggcggcgtgaaggccggcttccagagccctggctggcctttgtagtggatgagacggaccagattgccatgctagggtcacccgctgacctgcagtggcctgagcagatacatggctctgccagatttcctgaagtggagccctcagcctcacactgcatcccccagaagccaggcaagaggaggtcataaggtttttctggaaaggagcgaaagagtgcgctgctaaatgttgcaggtgggagtgcgtgaacaggtgaggcttccggtaattatgacaagtgatgcttgtgcttctcagtgccgtttcctccctctgatggggcctgcttgacacctcgcagggagcgtgggtggagagtgtcattatccccatttcattggtgggaacattgagagatgaaacgaggagtttcatctgcaggcccctgggccctctggtcatcccggtcatcctggttggtttattgtcttgttttttaagggggatgatcgaagaaagccttggaggtagggtgggggaagctgggaacagagggaattatatttccttttccaaatacttgtttaagaatggaagagttcctggccacataatccatgtgcacagattttccgggggaaaatccatttgagtttagacttggagaccgtgccacctcccggtctgttcctcaggcttttgacatctgcccacacctggaacatcttaaattctggtggagaatacaaaacgtcactcccctgccccagctcacccctagttcagccccccaggatacctgaagttggggatcctccttcttagctgtggagctcagggtatgttggttccacgtccaaaccttcaaccttcatctgtaaaatggggtactgatggctcccttgcagaggcctggggattcgaggcagcacttctggcccgtacctgttgccatttctgcatgttgtacccctggccctgactcaggctggcgtcctgaacacctgtgcatccacaaccccataagccttccaggagcactatagatcagggtgacccaggattaggccgggggtgggaattacagactacccccaggactgacccagagctatacccctccagggccggtgggaacacgagtggtttttgtgtgtgtatgtggcttgcagcttgcaaggggggtggggggcaggtggcggggttggttcgagtctcaaactgtcctctgtcgggtcgggtcaggcctcaaactctcctctgggccatttccttctttttctcaacagaaagaacccaggctatggaatcatgtgtgggcccagcagggttcataggcaccttctcagtctgtctccagcgttgggctcttctggtcctgcccagcttgtcgctttagtacctcagtttccttatctgcatggaagcccacctgtcagcttggatgaggggaggaaagcaaagcccctcaggccctgtgtgggaaggagagtctgaaagtgcaggggctgtgctcaggaaggagcgcagcttcaggaggggctggttggctggcagtgttgtgcaggacattcagaacgtgactgggtttctattctgatttgtacaagcataggatactcaggtggctctggtctgttctctagcaggagagtctggggtcaatctgtaataatttagcttctgagcaggtgcccggcactggaagaggagagcccaagagagcacggatacattgtgtggctgaagggggcaaggccctgggctgcctcctactctgaccttgtgggccttggtgtctgctcttcccctctgtctgccactctgagtctggaatgtggcagtgatatgggtgttgtgggcactcctggcatgtgggcagctcctcagtgctggtgtctgagctccacaatgacttcattcatgtaatagtatgttatggctgcgtaacaaagaaccacaaactgtgcagcccaaatcatagaaatttatcatctcacagttctgacgactggaaatatgagattgagatgttggctgggttggatccttataggtggcagttttcaagttcacatgacattctccctatatgccagtctgtatccaaattccacccacccacccccacttttttttaagagacagcgtctccctctggctccagtcccaggctgcagtgcagtggcgcagtcatagctcactgtagcctcagcctcctgggctcaagtgatcctcccacctcagcctcccaagtagctgaaaactacacttgaccaccatacctggctaatttttatatttttttgtagagacacgttcttgttatgttgtccaggctagtctcgaactcctggcctgaagtgatcctgcctcccaaagtgctgggattacaggcatgagccaccacgccaggccacctcttttttaaaggacacagtcacattggattaggacctaacctaatgacctcattttaacttggtaaagaccctattttcaaataagtttagaggttaggacttcagcatatgaatttaggagggaacacaatttagcccctaaaactgtacttctattcttttgttttaaatttcagagcctggctgatcgtgtgtgtgtgtgtgtgtgtgtgtgtgtgtgtgtgtgtgtgtctgtctatgtgtgaaaatatacataggccgggcgcggtggctcacgcctgtaatcccagcactttgggaggctgaggcgggtggatcacgaggtcaggagatcgagaccatcctgactaacacggtgaaaccccgtctctactaaaaatacaaaaaatcagccgggcgtggtggcgggcgcctgtagttccagctaatcgggaggctgaggcaggagaatggcgtgaacccaggaggcggagcttgcagtgagccgagatagtgccacttgcactccagcctgggtgacagagcgagactgtctcaaaaagaaaaaaaaaagaaaaagaaaaaaagaaaatatacataacatgtactgttttagccatttttaagtgtgcggttcagtggtattcagtacatccacattatcatacacctgtcactactgtccatctccagaactttttcatattctccacactgaaactccactaaacgctaactccctcctcccctcctgtccagcacctcacaaccccctttctactttctgtctctatgaatttgactactctaggaacctcatatacgtggaatcttacggtatttgtttgtttgtgcctggctgatttcacttagcataatgtcctcaaggcctatctcagtcagcgtgtgtcagagtttccttcctttttgaggctgaataatactcctttacatgtatgtggcacgttctggttttccactcatgcattgatggatgctagggttgctgccacctcttggccattgtggatggcgctgctgggaatgtggtgaatgtgcacctcctctcctaacctgccccaggcatccttcagaagcggggcagcccaagaccgagatgggggaagaaggtggtttgcctgccctcccaggcttgctgggtgtctgcccgtggctgggccctggccccgggctcagggtggtgaccgccagcagggggaagtccctcttcctgccattcccccccgaccaaccctctgtatttcctctttggaggggcagtgagtgggaagggaggacccacaggtgtgcagcggccatggcccgcatcctggctgagcacctttgctggtgtggagggactccctccagtcactttcagacctcactccccatgctgctcccacaccagggcactgttcccacgccatcctcctttgaagggcactacccatcttccctgtcttgccccttcccaccctcttcccagggacttttctggtcagttccctgctgccaggtctatacctcagggactagaagctcagcatcccctctgctcttcctccttttgcctttgtcctcttagccagacccaggctcactgtgcgtcagtgcccctgcctgcgtttttctaccaacaccaggcctacctggagtgaccatcgcagaagcccccagccctgccccacctccagtgccacactcagatgtgctgccagaacgtcacctgtctccctgcagcctctaggctcccctcttgttccagacccagacatctcctaaatggagcccaagtccttggcctgaagcctgaggctccccacaaaatcaccctcttcctctctctcctctcactgccagcctgtatcccctttcccagctgtaccccctttcccagagaccacttccagccccccttagctcttagtggcctctggctggatctagaaaccaaactgacaccaggtacattaacaagagaaaagcacacaaatgtcattagttttacaggtgcatgggaaacttcaccagagtcaagtccagacaagtggccgaagcaagatgctttatcctttttcgataaagaacaataagtttgagaagtggcaggacaagggggatctggctaggggcagtaaattcttgagcagtcactgggagatatatgaggggtgtaaacctggtggaagataagggttactttgttaaagcatatttattcaggcccactgcagcccccgattccatctcaggtgataagggctattttctcccctggttcaaggaagacacccctcccagaggaatctttatggcttgctgagtatagcaagaaacaggtcagctagccctttctgaagctgcagctcgaagtcagtgtagccatccggtgtattttgggatggcacgtccttcactctttcccagcctttctgcatttgtaagccccaggaaagccggcagctgagtcagcctgaatccctccatggggcgtctttgcagctccctgcccctgctggttgaaggctctgttggtcgcattcttctctctcacagactctgcccctccaaagcccttccagccctctcctgggggctgggttatctctgtcctcagactccatggcaccgagttcaggccatgtcttagtgtcctgtggcttccttaacagaatgccacaagcttagtggcttacaacaacaaacatttattctctcccagttctgaagactgaagtcccacatcaaggtgtccgcagggccaggctgtctctggaggctctaggggaggatccttcctttctgttcccagcatctgatggcccacggcattcctcgacctggtgacaacatctctccagtccctgcctccgccttcaaatggcctcctgtatgcctgtgtcttctgtctctttaaagatatttgtcattggatttagggtccatcagtgtgatattgtgatataagaaacctgtatgtggtcttccttctggtttctggcacaagctcctaaaatcattgtaattttctgaacgatggggtgataggagcatcttttgttattcatacaagcccttttctgtgggacctgaggttatgctaatgaggtgatgcttgaggggcccctagatagctgtgggacggggctggttgccagaggaaccagccacgtgattagagggttggaactttagctccacccctgaactctggggatggggagaggggtggagattgaattgatcacccgtgtctacagccatgccagcctgatctcggctgaactgatcatcagtggccaatgatttagtcttgcctacctagtggaacctccatgaaaacactacacagtgaggttcagagagctttcacgttggtgaacacatgaaggtgctgggagggcagtgccccaagaggccatggaagctcccccacaatacacaccctgttacccagccctcttccgtttggctttcgtgagtggtatcctttacaataaactggtaaatgtgagtaaaaggttttcccgaattctgtgagctgttctagcaattttttttttttttttttaagatggagcctcgctctgttgcccaggctggagtgcagtggcgagatctcggctcactgcaacctcccgggttcaaatgattctcttgccttagcctcccgagtagctgggactataggcgcctgccaccacgcccagctaatttttgtgtttttagtagagacgcgatttcatcatattggccagactggtcttgaactcctgaccttgtgatccgcctgcctcagcctcccaaagttgctgggattacaggcatgagccaccgtgcccggctctagcaaattattgaacctgaggagggggttgtgggaacaccccatctccactcccagctttagagtcagtaggtcagaagtacaggtggcccagacttcccccagtgccttaagtgggaacagtcttgtggtactgagcccttaacctgtgaagtctgacacttattccacatacttactggcagaatggaattaaattataggacacccggctggtgtccagagactgggaggattgcctggtgaaaggagaaaacccacacgtgtgttgtcaggagagttctgggggaatagaaacacatcatagtagtagtaattggacaatctagggtgatctcatctcaaagcctttaacttcattacatctgcaaaaagactctttccaggtaaggtcgcattcgcagattctagggttaggatatgaacgtgttcctttgggggcccactacagtgggcttctcaccttggtgtcctcaggggagccagtgtctgcctccctctcctccgttaggtcctggctccgtggtcatttcctcagggagaggccctgctgtccttcctgggtctgtcttcctccctcctgcatgtgctccggtgccacctgcctctctcccgtggccttgtcatggttgctgtgatgcccacgtcacgtgactccatggattccgctggctcccatgggcaggggctgggtgtgcggtgctcaccattccatacccagcacagtgtcctgcacgtattagatactcagtaagtacatttgtctggggctaaaccttcagggtctccaggaagtctttctgagccccagagtcctaaaaagcccaggtgctgctgaggaataataactgtatcatcctggggcggagggctgctgcctcttcccagctggggtttcagcctctgccctgcccccgcaccagccggcccccaacctgaagcctagagcatcaaattattattgcctccgggaatgactgggagccttaggcacaggtgggtccttggagacaggggatggtcctttaacagtgttctggatcctgatggagaagagagggggttctcctctgcccacactgaggcacactcggcttgtggaggaaaacggctgactagtgcccccagaaaatcgccagcaaagttgaccttctggtgattcagtctccaaccagctcaaccttcaagcaggcagagctgtcagggctggtcgtgtgggttggactttctcctccaagaaagctcagagttgtaaatacctgtttctcatctgcggtgtctagggttgcctggggagtcaaggcatcagggagcaggacaggctcaggcccttcccgactgacattttccagcctatggggggccttggctagcctggtggctttctctgtggcatacgctgattcatgaccctgacctctctctacccgggcagctgcggctttccattcttgggtgctggcctggtgatgtcattgttggggtacggcatgagggctgggaggccacaggatcctggggtgctctctgtgtacccttccaccacagaaccaaggaccctggtggcaggcctttagccagggtgcggtggctaactggatggggcacgtctcatttataaagaattttgaggcacttggcgtggatgcaagaaggggcagctgccagcctggcagaggaggagaaagtagagaaaccaccagaaccaaccacacatctccgaaagcactcactgcatgtgggtggcctgaggttatggccaggcggtactgatgtccatccggaaggatactctcagccctcgggaaacagtggaattatgttccgggttccctgcttaggagaggaaaacaggtcagccttaaaaaaaaaaaaaaattgaggtaaaattcacataacataaaatgaatcattttaaagtgaacaattccgtggcttttagtgccttcacagtgttgtgcaaccaccatctccgtttagttccgaaacattttcgtcaccccagaaggaaacccctgcccattaagcagtcaccgacctcctttctgtctttatgggtttacgtattgtggggatttaatatcaatggagtcatacaacatgtggcactttgtgactggcatatttcccgtagcatcatgttttcaaggttcatccgtgttgtagcatgtgacagaatttccttccctttgaaggcagaggccgggtgtagtggctcacacctgcaatcccagcactttgggaggcctaggcgagaggaccacttgaagccaggagttcaagaccagcctaggcaacatagcgagacccctgtctctacaaaaagaaaaaaaaaattattttagctggacataatggcacacacctgtaatgccagttacttagggggctcaggcaggagatcacgtgagcccaggagttcgagactatggtgagcaatgctattccattgaatctgatggacatttggattgtttctacctcttgtgaataatgcttctgtgaacattctggtacaagtttttgtttgaacactagttttcaattgttttgattatacacctaggaggggagttgctaagtcgtaaggttatcaatgccacatcttagaaatgccttctctttggaatgaaagttgacccagcaggcaggtcacacaggtgcagctgggcacagtcaagctctgcctgagactcagtttttcctgtctgaaaaatagcaatctaaaagttcatgcccactcaggtgcgtattccaagagatgatacgtgggttttcagcaccatatgtgacctggaggaagtaccccgtaaagggtggtgggttttttttgcccactacttcaaagatttgggtcttttttgctgtcagaggaacttacctccctgaagcactacgggtattccctgaccttacctgaggttctgctacgatagccagcttcggagcccccaagatccacagcccttctcgagggtagagtctgctcttggtgggtgcatggtggtaagaaggtgccaggctatggatgagcgtggggtgcagagccagctccgactgtggactctgcacccttcatgagacccgaacctctgtcccagccatggttttccaagcctctctggaggacagtgcctgcctgacaatccctccaaaagacgtgtgctgctgtttgtagaagtcgctggcaccatgctgccatggcctgcctaggacctgggagaagatgggaggccaagaggagggcaggagccgggaaggaggacagctgcagccatgacagggtgggggtttgatgtccgcctctgtgaaaacctccaccacagctggccgagccaccggatgtttgatctccttttacctttgtaaataaatactgcctagtctttggctgccagtgtaaacaaggatggagaccactctgctgatgatctctgtgctccctggagttcctgcctcctccacccaaattcctcccagtgcccctttcttctcttgactccagtacatgttgatcggagggccctttacagccgctctcattgttctgggtagggagggcccagagcatgacctctgatcccctgagggcttgctcccatctcaccctggggcacattggcagaggttgggtcaggggctgggttcctggaaccccacacctctggcagccacaccacggatggaggatctggggtctctctaggcatatctggcctgggagagcctctcctgcctggctgtacccaggcatcacatggccgatggtctgagctcagttctgcatgcatttcctgggagcccaccgttccaccttctgtctctatgaatctgactactgtaggtacctcatatgagtggaatcataacaatatttgtccttttgtgtctggcttattccactaagcagaacatcaaggttcatccatgagattgcatgtgtcaaaatgtccttcctttttaaggctgaatgatgttccattgcgtgtatacattacattgtgcttctcccttcttctgtcagtggacattgggttctttccacctcttccttcccatgttgtgatgaatatgggtgtgcaaatatgtcttcaagttcctgctttcagttcttttagaggctgggcgcagtggctcacgcttgtaatcccagcactttgggagactgaggctggtggattacttgaggtcaggagttccagaccagcctgggcaacatggtgaaaccccatctatacttaaaatacgaaaattagctgggtgtggtggcgcacgcttgtaatcacagctacttgggaggccaaggcaggagaatcacttgaacccaggaggtggaggttgcagtgagccaagatcgcgccattatactccagcagtgtccgggcaacagagtgagactccatctcaaaaaaaaaaaaaaatcagttattttgggtacataactaggagtagaattgctggatcatgtggtaattctgtttaattttttgaaagatttttttttttgaaccagtgtagtctaggggatgtgaccgcagcacctacctgggcctgggctgactgggacctaaccaggcattattcttttcgctatattatttttattttttggctgccctttttccttttatgaaagaatagatttgcagagttctggggttgggttgctaagcaaactgcctggagagaagagggtttcagatttcactaggccctccctcttccacaccaaccctgggctgtctgcactggacttcctctccccagccccactcctagtctggttcctggttcaggtgagcagcagccagattccatgcccccaccttctaccttctagtgtttgggttctgccttggataaagctttgcaggaaggatgtggctgatgagaccatcaacctcagtcctgccaagggtgaggcggcccagagaggtttttccactgggtattcctggtacgggggcaggagccaggcctcccaattggttctggctcttgggagatggtggctttcaaaatgccaaataatgtactttatcctcaagaggaaagggccttggctgggcatggtggctcaagcctataatcccagcactttgggaggccgaggcaggagggttgcttgaggccagagtttaagatcagcctggacaacatagcaagactttttctcaaaaaatgtttttaaaaattagctgggcaggccaggcacggtggctcacgcctgtaatcccagcactttgggaggccaaggtgggtggatcacaaggtcaggagatggagaccatcctggctaacatggtgaaactccgtctctactaaaaatacaaaaaaaaattagccaggcgtggtggcgcacgcctgtagtcccagctactccggaggctgaggcaggagaatggcgtgaacccggaaggtggagcttacagtgagccgaaatcgcgccactgcactccagcctggacgacagagcaagactctgtctcaaaaaaaaaaaaaaaaaaattagctgggcatagtggcatgcacctgtagtcccagctacttagaaggatcccttgagcccaggagttcacagctgcagtgagctgtgatcactccactgcacttcagcctgggtgacagaaagatcatgtcgctgaaaataaaatcacgggtggggggtggtgctttgtgtacttaggggagctcaggtgtgaaaaactgcgttttgaaaaagcaggttcctgtgtgctggttagaatggggggatgaggaaattgaggggcagtcctccccacaccatcatttgccttggagcagactggaagagtcagcagaatgaggggcaacaagtatggattggagtgatctgggtgagctgaggcaggggctgaagccctcatatggaacgtggcagggatgagcaggccatctggaatccagacttaaaagcatcagtcacccagacattgatttgagatctctgcagagggggaaacggctggggtttcagccacttggagtgtcctaattccccagcagagtctggccgtgagacctagtctctctgtctcacctggcggggtgatgtgtccacttcaaagtctcactggacacaggcaggcaaaccctcaccgggcacttgattcttgcaccaggttttagcgtggacgttgctaagccagcatgtggcttcgcacatgtggagtcttacagttactctgaagcaagccctgggaccccgaatctgaccccgaagttcttgctgggctgactccctactcggtgttgacttgaccttacacgggagtcagtgtagtcatgggctcggaaagcactcagataaaaggtgctccacccagtgatgaagaatgtgttgatgtcttaagatcgtcttcagataaacagcaaaaccgttggttaaaagctggtctaacccaccttattttgttgttgtttgttttgttttagacgtttcgcagcctgaagctgtggttttagtctctttctctagtgataagtggaaaagagggatgaggaaggggctttgctggcccgaccaaaaacaaaactaagaacccatgagtgtattctctcccttgggcacttggacacctctgctagaacatttagtagacgctgacaattccaagctaatgtaaaagccaagtctggagggtcatggggtgggagactagggtgaggaagttgttaaaggaggccaaggggatggcacggccttcatctaatagtgacagtagcattttagagctagagggtctttatccattgtctagttcacatgcatgattttaaaaaaggaagctgaggcaggaggattgcttgagcccaggagttggagactagcctaggcaccttagcgagtcaacgtctctgttaaaattaataaatgaagtcaagaaaggtgaggcatgggcggcctcagtgacctggactaactcacagagaggtagcaatggggagggccagagcctcgcttctgagggattacaccacagctcacttcccccacccaaaggccaaaggaactgagcgttaataaccaacatagcgatcttggtacctggagccccctcgatgtcccatggattaaggagaccagattcctccatacagcttgttgagggacttggtgggtgccccttgctcttggggtcttcctactttggctgctatgctcaacccagacccagcctcttcctggaattctcctttcaacacgcacagagacagaacccggcccggactttgcagccagtagttgtgtgcaatcacctgggacagtgctgcaggtcagcagccggcaatgctagacaccgggttggggtcgctcagcaggtctaagccctggctgccagctagattcccccaggaagcccctatagcttcggattcagcaggtctgtgtggatcccggtgaaatcgttttcaaagcctcccaggtgttgccgacgtgcagccagggctgaggacacctgttagagggtgctgagtcctgtgggacgagaagtggagaacctgggagagggagaggcagaggtgtgcaaggaagccggaacttcggccacctgcacccacagctagtggcagatcactccagacacacggctctccccggccttccacgtggaaaggactgacaacagtctccacttcaggattgctgggtcagttgctctgagtgcctgagggcagccctgtgcccacccagcctgggtgtgtgtggtggcagttgtaaactcctgaatgaacaccaaggtcacctctgctggtaacctttgggcagggctgcttacaggtgactcatggtgagagtgacgtcaccccatcagggtgagctctcagaagtcccatgggcctcaaagtccccctttggaaggagtggagaagggatcctcacatgagccatggattgggccagaagatccttgtgggttgacagtggtcatgatgagtccactggcttagaaaactcaggctgagaacaggccatggaggagctccagatggctaaggccttggaaacacgtgttgagctttgtcattcagcctgggaggaagggagtgattatctccaggtgcctctgggaggaatgaattactctgtataaccagatagtcccaacaggcagggggcctcttgtaggataagccactctgtcctcctgcgggtactcacattggggtaagggtggtctgggatttcgacagacctgctggaaggtggtctatgactcagccagaagctgggccagactgggggatgggggaacctgtagccccagttccctgggctggcatcggaatagcatggtaggactcgctgctcatggtggacagaacttgcaccccagccagcatgctggcctgtgctcctcaccccatcagaccccatgggcaggtgtgcaaggtgcaaggaccgttcctgacatcaagacggtaacggtaacattttgggtttccctttctttttcttttcttttcttttttttttttttttgagacagagtcttgctctgtcacctaggctggagtgcagtggtgcaatcttggctcactgcaacctccacctcccaggttcaagcgattctcctgcctcagcctcctgagtagctgggattacaggcacctgccaccatgcccacctaattttttatagttttagtagagatggggttcaccatattggccaggctggtctcgaactcctgacctcaagtgatccacccacctcggcctcccaaagtgctgggattacaggcatgagccactgtgcccagccagggtccccctttctatagcaacccaacccccctgtatgggggagaaccaactgttttctctgtacacaagctcaacgcagaacacttatgtgaccaaatgtaggggtttttcccacaccaagcagttctctgcagacaccagctgggtgtcctacaatttcaactcagttttgacattgtctacctggagttagcatcagatcccactgttaagggctcagctccagaagactgcccctaacgtcaggtgtcagtagcaagtccaggttatctattggccgtaaattggaggttcctacagccccctccttgagtttgatcacttgctggaacggctcagagaactcaggaaaataacttactagctgactggtttttaatacaaagatacaactcaggaacagccatatggaggaggtgcacagaggaaggtctgtgggaaggggtgcagagcttccatgccctctcggggcactgccacattttcagcaacctggaagctctcctaaccctggccttttggacagccctcattgtgtaggcatgattgattacgtcactggccattggtgatcaactcaaccttcaactgtgggtcttccccagagagttgggggtgccaactctctaatcgtgtggttggttctcccggcaaccagcccccttcctgaggctatccaggagccccagccacctgtcatttactagcacacataaagacatgtattactttggagattccaagggttttaggacctgcatgccaggaaagtagagggtgggatatgcaaagatcaaatatacatttcttaagtcacaaccccctgccaggggcagacgtatctcagaaagccccttgtattgtctagggagtgagctcatgttcatcccccctcaccttgtggtctttgaccagtcagttgtgaaggggacgtcagcatacccgaggtcgttgtgagatgcctgttggggacagagatggtgtcagctgggtgcttgctgggatgggttgagtatggatgctcccttctctgtctctaacacaggatgcttctttgcacacacagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcggtgagtccccatggtgtacgtgtggcaggagggccaggtgaggctccctgaagcgcagccccatgctcaggggtatgtagcaggtaggtggtggagcagccaatggtttggaagcgagtgggtcaccaaaaactccttcctcatctctacatgtggtacacagacagcctgccagatgtgttgatcagggagatcgggggatgctttgaactgagcgtggaggaggcaggcagcatgtggtcttgaggctgagaatgtcagcaccagaggccaccaccaagacctgcgtggtggcgccggcaacactcctgagccaggtggtgtctgggcttgggtccctttgcttcatagccttcttgctcccttttaccaaagcgtgtgctgaggatggctccatccatgtgaccagagcctttcctgtgaattttcacttgaccctcattaataattcttggcctttctgtcacttccactttacaaaggtgaaactgaagtccagtggtggcttccccaaggtctcatggctagtgagtagcggcacattcagtagatgctctgccatgccctccaagaaagcagtggacccacgccccccctcacatgagaacgtagcccgggctggttgcaggctggatggtgctggaccgcccggccctgcatgaagttctgattcctcttgctggtcccacagctcagggggctgcttcagcaatgctctggggcccagatgctcaccccttgccattggtgcatgtccccccacttgacctcttgggttccttacttcttgggctgagaaaatcactgccccagggcagttgctcctttttgtctttttggtccctgatgacagattacttccgcactctgcttagcttatttctagatggtttccaccatagcctggcatggtggctcacacctataatcccagcgactcaggaggctgaggtgggagaattgcttgagtccaggagctcgagactgcagtgagctgtgattctcaccactgcactccagcctgggcaacagagcaagaccctatctttaaaaataataataaaaaaataaataaaaagagcaagagagagatggacttttccccatttctgtaaggaagctccagaagtgtatcttctcactgagctgcttttttctggggctgacatgttagctgcacgcctgggactgctgcttacgtatatacttttgtgatttctgaaggccttggtgctgggcaggcttctcattctgaaccgagaggatgggagaggaagccagtgggtaacatgtacctgctccgtgcagcacacacaggctgctgccttaggtagcttcctatcccacgtcgagtgtcagctttttacagactaggaggccgaggttcagagaggtgaagtaacttgcttgggccacacagctccagggtttgaagccttcctgattcttcaatgggcacactttccctccctcaactgtcttgtctttcttggtgcacccctttcttgctgcattgtgagcgtggtttggtacaaagaaggaccaagttcaggtaggctaagtgctgaacttgagaaaggcaatttctttccatcattcttgagggctatctgcacccagccagtccttgatgcagttcctggccccgaaaggaagctgatctgcccactcagtgccccagtccctgtccgggggtgggggcctcccacccacacctggctctgacttggagtacagccttcacctttcagtccagggcttctcctctgtgaagccactccagatcctggtcccccgacccctgctccctgcttctgccctcacaggagctgtagatgtttctcgtggtgcacatcctgcaggaggttgcacgtctctgcctgtcaggtccagagtttccaatcccaagcacgccccttggcccagagctggtctgaagaggaggggatttgattggaggagaactgtgtgtagctcctttccagaaaccttctggtgctcttcccagtggttggggccccaggacgggtacccttcactgctctggagacaagcatagccttgacttcctggtttccctgccagccatgcaacaagccatgcaaatgtcatctttcatttctgatctttggtttgaagacatggctgtcgcttcctaggacacctgacttcccccagggagcatggtgatcttgaggccagaggcaccctgatcctgaccatccagtgggaaatgggcatcaggctgctcatccctctcctcctgcacgccacccacccctcatttggtcccagatgctgatcttgagtctttggggtgtcagtggactcctgtggcatgggtcttctctgtgaatacccactcgtagtgcagacagaggctggacagaggccaggcacccccttgcccggggtgctgtgggaaggattcacacaggctggcctgttgcgacaacctgcagccccaggaccctgtacagaggccagccccttgccctctggtatgccttgagggccaggttcttggggtgttcgccggctgggccgcaggacaatgtccagtctgttggtaatgaaaacctgcccttgcccagagcaagagggtcctttctccagcagctgtgctagctacacactcccagcccagagcagcctgcccctcgcagtaagggttttgcaccctgatcaccactgggctcccccagattagggggactaggaggagggactagaaggggcctctttgcactctgccctgtcctgaagctcagttccagctcccgccctcagttcacccgtgggcctggtagccagctgacaacagttttattcacctgttctctgttggcttttcctgcttggttgtcacaagcccagtttgttttgtgggttctttattggcttttatttagcctcaagttttgtgtttgtacccacctaggtagggtcatggtaggagggccttccttccatgtcactgacttctttttccaatttccctttacctccggcttcctacccgccccagcctccttgcctgcctccatggccctccctgcattcacgtcctttcccataactggcacaagcacagccctgagttataaatagccccaggccaggccctgccctttgctctctcgttttctctgcatggacttggctgatttctgagccatccctgtctgatgccatcagcactattcaggactctagaagattcttagtctaaggagaagtgcctcatcctgagtcttgtctccaccccaccccgtccatgccctgagccagatgttccctgagcggccccgcccttcagaacacggagggagagccagattctgccttcctgcctgtgctgtttttcctcctggctttccaaaccatgtggacagaacgagacacagtgctcccacccacgccggcacaagcatctcacactgggtggggctgtcatgggccctgctgccctagcagcctccctgggccctacaggccgcctggtactcatagtagcaagattgtccttagaacatgagcacggctggcaggctgggtggatgggtggcgctgcccaagggacccaccattcccttcacctcttctcctcttgtggagcagggagcggcatctgcacacagtaggaggcacctgcaggggcagctggggtgctttccccaaagactccaccattcatgatgggcagagagggggtgtcataggtcgccccaccctacgtgtatgtgcaccatgggcagcagacttgctgaacttgggtagcatttcagggcaccaaggcaggctcaactgacagccctgggttccttggacccaactgtctccaagtgagagtacggagaccctgaaggagccctcagagattcataaaaacgcagccaacactaggatacaaccaggtgtttaagatccactcattgatttattaaatgaatcttaattgagcacctgggtgttctgggcactgtgctagacagggaagttcctagctcaggcacagccgtggcctggaggctcccacccgtggagtcactgcctaccctgccctggggggacaggtgtgcatggaacctgcgtgtccttttccttggagctgctctcagcccagatcttgatggctgtcccccccacacacatgtacgtgtgtataaatgcatatatatacacacatatacacaggcacccgggcatgctgacacctcatgcatacattcacacaagtgtgcacacacttaggagattcccagggcaaaaaggtggcccaggaaggctttttagatggtcccagtgggcaagtgaggatgtgtggtccaagccccagggactcaaatggggcacagggtggggctccctccccgggcagtggaggctcagggccggagggcatttgcctgagaccatggggcaggccaggccctgggcacttcgtgttgaacctgctgtctataccatgacatgcctccctcctagagggccagggaaataggacagcagggttgggagtaggcaggggctgtgctgggaccctgattccaaattctacagataccatgaggcctgagctgacctcagtcagatccttcctcaaacccatcagttctcactggaggtgattctgctcccagggcatgtgtggcagcgcctggagacattgtggctgccacacctcgggggagagggtgttactcacatacgataggtagaggcaaggatgctgcacagaatcctgcaaggcacaggatgccacccagcccctgacagagactcctccgggcctagatgtcagcggggccaacgagaagcctgcccgcagccagtgattttccccgaaagtgggaaagtgagtgatcagggaccaccgccccagttccacgcctgtgagcccagcaaccagtggagaagtggacggggctgtcacagacaccggacctggcaccacccccaccccccgcacccacacactttcctctgactgcaggcagggccattgggcacaggcggaacaaagggagcacggcctcagcccggtggagcactgaggtgctgccatgggcatggccagcctccaacattgccagtggccagggagtaggcgggagtggccaggaagtcaggtggcgatttctgtggcctttggcatcatcatctttggtgtcatgcctttgctgggactgttgtaacaaagcatcacagactggggggcttaaagaacaggagtttattttctcctagtcctggaggcctgaaatccaagatcaaggggtgggcagggttggtttcttctcgggcccctctcctgggcttgtcttctctatgtgtcttcacataatgttccctccatttgagtctgtgtcctgacctcttcttttacaagcaccccagtcctggtggggtaacatggctcatgcctgtaatcccaccactctgggagtttgaggtagaaggaccgcttgagctcaggagtttgagaccagcctgggcaacatgacaagaccttgtttctattaccaaaaaaaaaattttttttttttttttgagatggagtttcgctcttgttgcccaggctggagtgccacagcatggtctcggctcactgcaacctccccctcctgtgttcaggcaattctcctgcctctgcctcccaagtagtggggattataggtgcccgccaccacacccggctaatttttgtatttttagtagagacggggtttcaccatgttggccaaggctggtgatctcgaactcctggcctcaggtgatctgcccgcctcggcctcccaaactgctgggattacaggcgtgagacattgagcctggaccccccaaaaatgtttaagttagcagagcgaggtggtgggtgcatgaggtcccagctacttgggaggctcagatgggaggatgacttgagcctgggctctcaaggctgcagtaagctgtgactgtgccacagcgctccagcctgagcgacagagtgagacatcgtctcaaaaaaaacaaaaaagaatgtgacatatggaaccttttggcttcagtttaccttaaaggccctgccttcagatacggtaacgttctaaggtactgggggttagggcttccacgtgaatttgagtggggaggggagatgttatcataactaggactagaaggtggcctcccaggggcatgggctctgtcccctacatcaacatccaacaatgtgtcagcttcatcatttggagacaaaaacagtagagcttccctgaactttcagcagggacgctaatgagaaggggggactttgtcatagcccacatgtaagagggtccctgccagtccagtgatgtcagggtctaaaaagcagggtcaggggacacaggccttgagccccagggacagggttcttctggggcagatggtagcagtccctgtggctgggagggagggcatctggagaaggcggtgctgcctgggccccgtcaatcgaagggtcatgtggcggcagcagtcagagaatccaggtgaggcgggccccaggtgagcagtggggagtggagtttggctgcagcagaagccaggtggccatgctgtgggctctgacgccccctcaggtcagagcctccttctccttccctgactgtgtcaggcagctgcccttgggttgcatgcagaagcgtggagggaggcctggcccagcctgctccgcaccaaactctgtttcgtggtctggcaagagtaagggtggccctggtgttgccagatgacccccctccccgggattctcagtgactgtgagtgtgtggcttagtatgtgcggagggtcccctgcctccctttaattccatgtggagcctttgtgggggcaggggtttgtccagaggtcaacaagctggccctcctctctcagagggccctgatggaagaatccccctaccacccttccaggctgacttctgtctatttctcctgcagagtgagctggacttggaaaagggcttggagatgagaaaatgggtcctgtcgggaatcctggctagcgaggagacttacctgagccacctggaggcactgctgctggtgaggaggatttagggagctgagcagggcgggatggggcagggtgacagggttggggagcctctttgcccttaagtcccaggtcagctgtcagagcctgggtgcagctcgccatccctggagtggataccagtggaagactgagttgccaaaccaagctggttttaaaattgtatttgttatgtgatttaaaaataaaagtgcatatgtcaggtaaccatgactgtctactgccatacaatgcacctgacggatggcagcccctctcacctgtgctacctcacttgtgccctcttccagcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggtgagtaacccagggccggtgctgggactacaggcgtgtaccaccacgtccagctaattttttgcatttttagtagagacagggttttgctatgttggccaggctggtctcaaactcctaacctcaagtgatccacctgcctcagcctcccaaagtactgagattacaggcgtgagccgccatgcccagcctttttttttttttttctaatttatatttatttagatagttatttttaaaaagagatggggacttactacgttgtccaggctggagtgcagtggctattcacaggcgcaattccactgctcatcagcacgggagttttgacctccttcctttccaaccttggctgtttcactccttcttaggcaaactgatggttcccgactcctgggaggtcaccatattgatgccaaacttagtgtgtagtgcactacagcccagaactcctgactgaagccatcctccggcctcagccttccgcgtagctggggctataggtgcacgccaccacaccctgtgtgtggctgggactacaggtgcacgccatcacaccctgtgtgcgccatcacaccctgtgtgcaccatcacaccctgtgtgcacacactttccctaaagcaggcttcctccgctgggaaacaagtcctctaggggcaggtgtggccagaggccaggcccccctctaagtgtgaagagcatgtgattccttaaaagcccttcccccagcacttctggactaccgagacacacagctctggcctcgggcctccccttggctggtgctgggggctgagttttctgctctgaggtgtggctttcctgtagggggacccctccctctgccaccctgtgctgcagacccccagactccaggccagagctaaggcttgaggaacacagaaggcacttaatttgttccagttcttgctccctggggctctttcccccatggccagagagcaggaggctgtattttgatacatgctgccccctccatctttgaagcccccccacccccgtttctccgtgtgtgtgtcagcagttttaaacctagtggagggtggtggctcgggctgggctccgcgtcgggctgccccgcagctgctcttgggcagccagggccgctgggtgtggggccgccgggaatggcgggcccgggtgagggcgggcccgggtgagggcgggggcggagaggcgaagaagctgcaggaagggagggtgacgagggggaagcgaaggaaggggaagaggaagggaaaagcgagcgagaggggcaaggcggaagaggaagcagggcggaagggaagcccgggccgcagacggcgaaggaggcagcgggccgggggctgaggcgggagcgaggacacgcccaagagaggaagcagagggaggcggaagcgtggaggaaggggcgagaggcatcatcaaaggagatgaggggagcgtaggggccgggaaagaggcacaaggaagaaagtatgggaaggaggaatggagggtcagggctaggcggcgggagggcgccaggccgggaagagtacaaggacaaggaggtcaggtttgggcctacatcccggggacaggggcggccatggcggcggcagccagggaggaggaggaggaggcggctcgggagtcagccgcctgcccggctgcggggccagcgctctggcgcctgccggaagtgctgctgctgcacatgtgctcctacctcgacatgcgggccctcggccgcctggcccaggtgtaccgctggctgtggcacttcaccaactgcgacctgctccggcgccagatagcctgggcctcgctcaactccggcttcacgcggctcggcaccaacctgatgaccagtgtcccagtgaaggtgtctcagaactggatagtggggtgctgccgagaggggattctgctgaagtggagatgcagtcagatgccctggatgcagctagaggatgatgctttgtacatatcccaggctaatttcatcctggcctaccagttccgtccagatggtgccagcttgaaccgtcagcctctgggagtctgctgggcatgatgaggacgtttgccactttgtgctggccacctcgcatattgtcagtgcaggaggagatgggaagattggccttggtaagattcacagcaccttcgctgccaagtactgggctcatgaacaggaggtgaactgtgtggattgcaaagggggcatcatatcattgtgagtggctccagggacaggacggccaaggtgtggcctttggcctcaggccagctggggtagtgtttatacaccatccagactgaagaccaaatctggtctgttgctatcaggccattactcagctcttttgtgacagggacggcttgttgtgggcacttctcacccctgaaaatctgggacctcaacagtgggcagctgatgacacacttggacagagactttcccccaagggctggggtgctggatgtcatatatgagtcccctttcgcactgctctcctgtggctatgacacctatgttcgctactgggactgccgcaccagtgtccggaaatgtgtcatggagtgggaggagccccacaacagcaccctgtactgcctgcagacagatggcaaccacttgcttgccacaggttcctccttctatagcgttgtacggctgtgggaccggcaccaaagggcctgcccgcacaccttcccgctgacgtcgacccgcctcggcagccctgtgtactgcctgcatctcaccaccaagcatctctatgctgcgctgtcttacaacctccacgtcctggatattcaaaacccgtgaccgtcagggccacccctgcctgtgggccaaggagaccagtgagtcagggacctctcttgcatgaagggtgcagtgatagttcctccccactgccccactgtgctcctgggcctgtgaccccagtgctcaggcaccttgcagtagaggcttctgactcctggagctttgtggcttaccagagatgcagtccctcccaggaacctgttggagaggcaggacctgctgctttagaggagtgcagctgaacctcggccctgcgactctgtttggccagagcaaggatctggcctggagaggcccatcctacaccccttattagagccgtgatagcctacagagtgaggtgaggttctcccgccttcccaggtggtttctttctgccacttcctggaaagaaaggtgaggctgccaatagcccgctagcaccagccagacctcacgcttgaccaacctctcggggccagaggttcattcctggggcactgtggcctggttttgttttgaaaccaagagagggcaaagggaacccagcagttctgagtgagttctagccagccctacctcaggctggctgttgagagattttacaattttcatttttgtaaaaataaagcttgattgttcacagaaaaaaaaagaaaaaaaacctagtggacgtgacttggcctgccgccctcctgagaaatggagaatcgtgttgttggggggaaaaaaacacacatccagagctctttgccagataatattccgaaatcactcagagacttttttaaaactttaatatctgaggaacactggaatttaactttggaaggtttccgctggctgccctggaggccttgagctaccttcatgcgtcagatgatgcagccggaagactcggaggagaggctggcgttgcagtgggaagttgttccccataacgacgagctgagtactcacgtgtgttcaacctgggctgggtgctggggactccccaaggacagataggcccggtgcctgcccttgtccccatgaccagctcagtagggttggcccagcatcgctctgtcaggtttccgggttggacaagtcttaggaccaaaggagcttgcagtgcccttcccagctccggtgcctcttccaagcccaggaactcgtgatccacgtccagtggttcagaaagccagactcagatgcggcttctgccacctcctcctgtggggctgcacgggctgacttccctgctctgggttgtggttctggctgaagttttatcaactcagaatttttatttttctaattatttcaaacttacaggagaactgtaagaatggggcaaagagctctagtatagccttcatccagatacactgatgggaactttttgccacatttgctttatctctttctgtgcacacgcaaacgcacatagacacatacacacacaagcacaagaagttttccccctgaatacttcatttgctaagaacaaggacattcctataactcacagtagaatttgtcaaattcaggaaatttcacattcatgagatactattatttaatatgtagttcatataaacttcccccaagttaacaattacattcttcacagctgttttcattctctgattcaggacccggtttaagatcatgttatgtacttggttgtcccatctctctagtctccttccatctgtaccagttccttagactttgcttgtcttccatgaccttgactttttttttttctttttccttgagatagagtctcactctgtcgcccaatctggagtacagtggtgcagtcttgtctcactgcaacctctgcctcctgggttcaggcgattctcctgcctcagcttccctgagtagctgggactacaggcacgtgccaccatgcccagctaaatttttttgtgtttttagtagagacaaggtttcaccatgttggccaggctggtctcaaactcctgacctcaggtgacccgcccgcctcagcctcccaaagtactgggattataggcatgagccaccgcaccctgcctttttttttttcccttttggagatggagtctcgctctgtcacccaggctggagtgcagtggcgtgatcttagctccttgcaacctctgcctcccaggttcaagcgattctcctgtctcagcctcccgagtggctgggattataggcatgcgccgtcacgcccgtctaatttttgtattttcagtagaaactgggtattgccatgttggccaggttggtcttgaactcctgacctcaggtgatctgcctgcctcggcctcccaaagtgctaggattacaggccgccgtgcccagacaaccttgacattttttgaagggcacaggcccactcgggtttgccagtttcctcaggaatagcctcacgttctgcgtaacagcaccacagcagcgaggctgtgtgcttctcagtgcatcagatccggaggcacatttttgattagtgaaaaatgtggaaaggaattgcttagaactttgcacaagccacctggaagatgtgagctcctggagcaggagggaggagaagtcttgaaaggagtcctcttcccaagacccctgagaccctgctgagctgtcacctcttctgagaggctgtcctggtcctgaccacattctcaaaagcagtctccttgctctcagtccctgtcctgcttataaccatctgccattactttgcttgtgtgtgttcatgcatgtgtttatcaggcactgtcctgttagaacaccagcttcagagggcagcgccgtgtctgaattgtttaccactgcggtgacaaggcctaaagcaggcccttggctgctttgtaccaaggctgggaggcactcagtgacttgcaaaggagggaggagggaaagaaggaagagctctgggcctcatcactgcacggatgaggaagaacctagaattggaggatgcaaggactcctccaggtggtcagcatggcaggggcctggcaggtgtcttccagctgctaccctttcctcgtacactctaagacccttcttgcagcccttgtagggagcagggccagaagatcagacagtgccaagggtgcctggtttatccagcatctgggattgtcatctgtagaaacataaaattcaatataaatgcaaatgcacatggaaataaaatttaggtttgacacaaaacaaacaccaggagccgtgaatgccttgggcttccagcttgcagtcagctacagtgggagtctccagccctgaccagtgcatctcctgggtctgcccttatactccccaggcctaggtttgctgatttttccctcgctgcccataaaggtgttgtggggcccagagatggcagtgtctgctgcactcacacaagttgttgctgaatcgagtgtgtgtctgagctggaggtgcagtgaggagatctattattgccattggtttaataaagaacaaacaacacctctcgccttacagccggtcggtctccccccaccaggtgtgtagcatgacacctgagcaccctcaccaggcccaggatgggcttgtgtctgtgcagtgggaggctctcttctgcaaagacggccggacttggcatttcttatgtgtctgaagggactggacatgcgtggaacaccatgggtgggaaagggggtgacctctgtgtccagggtacactcttgcagccagaatgggaaagtgctgagcacagacacttgtccagattcactgacaacctcaaacttcagctgccgctcatggcaccatttcagcgaatggggtgggaggaataagtagctctggaagggaactgttacctgcctggcgccgtgagtcacttctcagcatgtcattttgggagcgggaagtgtgctgggtgcgtggggaggggagcaggtgggagggagcagcacggaagcgccgaggcctctgcagcctgtgtgccgtctgctgtccctggagtttctgcagagctgtgcacgggagcctgctcttcagaaagatgggggagcagcagcacctgtcccactctctcttccttcctccccctcaggccagccagctgggtgtgtaccgggccttcgtggacaactacggagttgccatggaaatggctgagaagtgctgtcaggccaatgctcagtttgcagaaatctccgaggtaatgccttgatgccgttcagacaggtgcaccgctgactcccacctgtaccctccacctcccgaggagaacagagtgcaccagatcaagatctggtcgtgaaccccagctgtttccagattctgttgggttcgttgcgtcagccctgtgctggggatgctgttgtgcgcagaccgaaggagcagcccacagggcgtcctgcctccccgggggcgagggcctgattctgggggttgccgagttccggggacactctttgcactgtctgtctgcagtgaggggtgtctgtagttctgcctgtgagcagctctctccacaagagtcctgaggctgactttgtacctggcactggaggcgaggccggaggtggcccactcttccttttctagcctgccagagaccttgagagcattgaggaagcattgaggggctagcgccgtggggcgagggctcatggcacctgtgctctgtggacccatgtggggagcaaagcgacaggttggagctgcactaacccaggccccaggtctgagaggctgctgactccctgcctgcatttagccccaggaagctgaaacctcaaaccatgtggtgttagcgcccagggcctcgaaagagtcattcagaaacagagaccatgaatgggccattcagaaggctggtggcccagccagaaccagaacccagccacacccctgggtctgcactccagactggggttctttctgcccttctccagcctgtgtctgcctggtggtcactctgcgacattttcctctttggaggcccttgcctcttcatgagccccccatctcgctgtagctttgccttctgacttggctttcccccacccagcaagggttctgagcagaaagccctccgtgtgagaaccgcagggttagaaagaggcatgggcactagaaatagggagtgaatgcggtcacccttgctgggacaccctcagctgtcacccctgggctttgttgctgaggctttgtgccgtcttattgtttatcaccggatggagcatcacgggcttcgctctgatgtctccagtggtgacagtacctgccgctctgttcttccagagtctgtggggcaccctgctccgccaggtgctgctggtaacaggctctgcatgtatccggggctccagctccctccccactgccagcctccctctggaccattcaatctgttctcttttcctttttcattaaatgagcaaccctcctcccccacagctggaatggtggcatcgaatttcaagtgaccttgacaaatcagggacctgatcttttaagaacaggttacagttaagcgggcaagttcaagtccacccagacaggtttctgcagaggagggaggaaacaccatgggacgccacctggggatcacgtggtgccaccaaccatgcaccagtggattctgagccatggttgagatgcagggagtgggatggggctcaggaccagctgcaaaccgacccaccgtgaaagtttgtggcacctgcaccatcagggcgacatgcactttggttctctgtgtttcaaaaaagacccagaggaattggagccacccaaagaaagcagagtcaaacgcaaggaagagaaagcagcaagccctgcagaggtgttggggggtcagtgctcaggcgtgggagttcgaagatcaccctcaagtacaggaaggagtggagtagtgtccgtcttctcctgggacagtcctgagagatgggcagcatccagttagatctggttccatggaacaccagctctccagacggtaggaataggaattacatgaaaagggctttgggagtcaggccagtttgggaaatgcagggttaaaccaaactcacaagttttcttgaggcaggttttcctggagctcctagataactcccaagcatcacactgtccacggacacgtgggccgcctcccaggctcttgtgagcccagcacctggtttttgcagtcttttgtttggctctcccacccccttacaccctttgggaactgctgagtcagatatacagaagaacagtcactgcgagggctgttaaactctcaggaaaggtaccaaagtgcatggcagcgtttggccccagtgagctggaaaacactttcgtctggtcttgagatgtttcctgcagcacaagaggttggcagagcaacctcagaacctcttctgtctctgtttatgcttttgttcagaagcttagtaccaggaattaatctcagctccttcccagaggattttaggcacacagggatcttttattctgcacttctccagtgatgctttcaacacaattgtatcaaaacagcctaggctattcacttacaagccctgcttttgccctgggaatcttagcacctcattttttagtaagtacacttgcagatccggagagggcaggtggaggtataatccagtgtcagtctgcagtggtgggcctgccctggccgtctccaaagatgggtgctcttcggaactggcagccccctgcatgctgtctaattgccccaagaaaacagtgacgtgtgtttaggagcatgctcctgttggcctccatttacaggatcctctgtgtcagaggatctcagccaggcgtgattttgttcacaagggacacttggcaatgcctggagacattttggttgtcaaaacagcaggaaggcagacgtgctcctgtacctataggtagaggccagggcagctgctcagcaccctaaggtgcccaggacagctgctcagagaatctgtagcccaaaatgtcaacagtgacctggctgagaagccctgtcccaggtggaccgcagcatccagggcatcctgcgtgctcggcttgctcgtgggtccctgcacaccctgtgacttcattatcagctcagaatgcacctggggtttgttgtagtgagggaaagctgaaattgttgccaaagggggaactgtctgcatcatcaaagctgcttctgtcatctgtgtgaacatgcgcttttctctctgcagaacctgagagccagaagcaacaaagatgccaaggatccaacgaccaagaactctctggaaagtgagttctgcatgctgaggtctctgtgtgccctcgtcagggaggctgctgctggcagagggggcgttgtggaaaagcagacacagtgcccacttgggtcatcccttggtgccttccctgttctctcttcagatagagtgggcacgaggaaagaacagctcagggagggcagggaaggataccatcaggaccagtttgccaccaacattagcaacaaggtgctgcttaaattgacttaaatgttatcctgttgaccccagtggcctcataaggaggattttttttttttgaggcggagttttggctcactgcaacctccacttcccgggttcaagtgatcctcctgcctcagcctcccgagtagctgggattacaggcacacaccaccacagccagctaatttttgtatttttaatagagatggggtttccctccgtattggtcaggcttgtctgaactcctgacctaaagtgccttggcctcccaaagtgctgggattacaggtgtgagctaccgcacctggcagtaacaaggattttattttctgtttttgccaatgacaagtttggtcataaagtaatctgtgcagagcacaggctttaagtggctgggcaggaattgagtccagagttgctgggaaagtgctgtcaggaattgtcagtcacttcttattttcagttgttagggtgttgtgaatagttacacttgcaaagaacagcagcccccggagctttgtcctccaagcctcagtttccctatctgcaaaatgaaaatagcgatgagtgccttatgctggttgtgggagtcttgtgaagaacatacttggcatgtctcagaacacacctgagcgtctgtgcctgggacgggccacactcactgtcatcatggagaagcacgggtggctgaggctggccagggctcccaccatgccagggagttgctcccactgcagtggggctcatgtgcctctggagtccgggtgtcctcgggcaggtcgccagagaacctgtcaaaccaagagttgtattggcatctgagtaggtttctgcttgtctcagagtcaggtgtctgaaatgtcctgggatcgatggtaagagcagctaagaggtctgctcagcttaccctctgggctggggagcaggtctccctccagaattggggcccaccccagcccgtccttgccagggtgggttccctgacctcaggctagaggagcagcagtgctgagccttttcagctgttgccaccgagccagccatgcaggctcgggtctgacagccgctctggactctgcatgcagtgaatgtcctggacttaaagtgttcctgttgggtgctctagccttgcccttgtcactgcgcagaggggagatggggcctgtggaggctggggcagccccctccccactcacccttgcaccgagggtggtcaggcagctggtgtgcttctccatgtgcaacctctctcacctcccctctctctccacagctctgctctacaagcctgtggaccgtgtgacgaggagcacgctggtcctccatgtaagtcacagcgcccctctggaccgggaccaaaactgccccctcgggcacacacagcaacaatgttctgagacctttttttagttgtcatagctgcagccaagggggtgctactggcatctaatgggtagaggcctggggtggtgttggacattctgtagggaaaggacagctctctcttgtccctccacaaagagttactccacgcaaaatgtccacagtgctgaggttgagaaaccctgccctagatccttacagaggagtccttcttggccatgtgcatgcagcgtgagtttgctggaacacatgtaggacctgcttccaggatggtgctcacacaagctctgtccacaaagctggggcccaagtgagagagactgtggtgacactgagggagccggcgctctgggctccgtccacactttgtgtctgcactttgcacacagtggcaggtgccagtgctcctctgtgtctaactcaagtctttcttcctggggcaggacttgctgaagcacactcctgccagccaccctgaccaccccttgctgcaggacgccctccgcatctcacagaacttcctgtccagcatcaatgaggagatcacaccccgacggcagtccatgacggtgaagaagggagaggtgagtgtggcaggggatggcttgggtccacccatcctgctgagctgggggcatgcagggcccctcgatctgaggtctggagcccttcctggtcctcagcagaccttgccttctgggattggtgagattggccgcacactcagtcctgtgtggaaggtgtctgggtgcagtctcaggggtgaccctgcaagcaccatgccctccaggtggcagccatcaccatgcctcactcagccacctctttccttttctgtcattgtgggttgtgtccagggacccctttttttttatcccccacagtcttgccagctcaggctccccagccaaggagacttgtgcaaaggaggtgagtaggaggatggcattttgtctgcctggaatcctcctacttccccctgagtgctttcattaaaaaacagttaacatcgggtttaaggattagaaagtggggttcgtggtttgtgtctgtgacgtgagactggttgaagcacttcacgtcttcctccgggaagactctccttccccttcccccccgtcactgatgtactctgtgtgcacatcatcgatgagcaggcatggcctgtgcctgtgccgctctgagccttcctaggtgtggcctggcacataatgaggcagatgcattcccaggcaggtagcagctactgagaacagccaaggcgtgtaagctggggagccagtgtccagggggaacagcttttgtcagaagcagcactgaggcgaggggagctgacccccggcctcaggggtctcatgcagggacagaagctgtctggcccaggcaggacacaggctgggcgtgaacctgactgtagttgcctcagaaccacctcatggctgggtgcggtggctcacgcctgtaatcctagcactttgggaggcctaggcgggtggatcaggaggtcaagaattcgagaccagcctggccaacatggtgaaaccccgtctctactaaaaatacaaaaattaactgggcacggtggtgggtgcctgtaatcccagctactcgggaggctgaggcaggtgaatcgcttgaacccaggaggcggagtttgcagtgagccgagatctcaccactgcactccagcctgggtgacagagtgaaactccatctcaaaaaaaaaaaaaaaaaaaaaaaagagaaccacctccttctctttcttctggttcatgggccaggtggtcggcactgtaccaaggacacgggccctgtcctcagggcccccagggtggacctgcccaacacatggggcttgctttcctcctcctgccctgggccaccaggcaggcagctgtcagccccatctgccacacaccactttgggaatggtaccctgagtgtccagagtctaatccgagttgacctttagtgagggacttggtcaggtttctcctggtgggcctggcccaggaagggcatggaggaggagggagctgtcccttccattccgctctccggcttgtccaagccctggagctgggcagactcagagtcccatgccagcatcgtgaggaccgacccactgggtggcctagagcttctcccaactgggcccattccttgtctttgcagcagggtgggaacatggccccacctcatcgggcacctgggctgtcaaatgggcatgatttagtggcagtcctcgccatccgtgttggctccttggcagtctctgagcgcattgaaggcggaagtgggtccccggcaccttccagtggaggcgttgagcagtgcaagtgttccccagctgctcatcccatggctgggacctgggagtggtgggggatcagatcttgcttcttggagcaacaaccgggccctgcccttggttctcttccctggctcagggccccagaaggagagcaaacctgtgacaaacctgtgggcagtccacacagatctaagtggatgttggatttgcttctcctaagcctccacgtgctgggtgggttcctgccaggttcgccctaccctcctgagatgcctgctctttctcttctaccgactattcttttatgagcgctctgacctcctgggaagtgagtgtgggcgtcctttttcccatggcttctcctgtgcctagtctgctccctgcaactgcagctgccatttagcattcctagagacaaggaagggccttctcagtgctcggatcattggaatccactgctttggggaattaaggaaaacgcgatgttgtctagaagttgacacctaggccctcgttcctgcatccgtccccatgggggccaacttccacgcttacccatggtcatgtctcggggccaccaaggaggaagtgtaatttaagaagggctgggtgcggctgggcgcggtggctcacacctgtaatcctagtactttgggaggccgaggcaggcggatcaccaggtcagaagtttgagaccatcctggctaacacgataaaaccccatctctactaaaaatacaaaaaattagctgggcgtggtggtgggcacctgtagtcccagctactcaggaggctgaggcaggagaatctcgtgaacctgggaggcggaggttgcagtgagccgagattgtgccactgcactccagtctgggcaacagagcgagattctgtctcaaaaaaaagaaaaaaaaaaaaaaagggctggttgcttcacaaaggcaggggcctggatctgcatcctccccaggacctcgccctggtggaggggcacttgctcattgaggaggggtcacctgggtgccttagctgcaaagcaaggtggaggactaatgactctagaaaagtcaccgtgagtctgaccagcaccccttcactcagagctttctatccgaggcacgttaagggaggtggcttgatggtggctaaggcaggatgatagatgcctgtgctttgcccctgcccctgccattcctggggcagatgctgctgatcagttgggcactccaagcctggacatccacctcggtatcccctggcactgcccaacgggtttgcagtccttgatgcagaaagaaagatgccagatgggcgaagccccgtcagggtccgctctccctcactgctaccagtgtactgatttggggacacccttttgcttccctgggtgtccgtgctctctgagggcaatgatgcagggtccgtggcccctccactgggtgttgagactgaaaaggtttcacagcctgcgagggactttatgaaagtgaggggtggtggcctgcccgcatgctgccatctgtgtcggaggtgacgggcgagctcccctgacgacactagccaggaaaggggggcagaagctccaggctacttcctcttagaatttgcagccaggggcagggcctgaacttttctcagttctgcccatctcttagtttggtacatgacatggagtgtcaagttcccaaagggagaaagggactgtgcctctgcattctcatgacagttctgtggggtcagaggtgatctcccttttacagatgaggaaactgcgactcagagaggttgagtgtcttgcccagtcacacagccactaagtagctaagccaggatgcgagtgaggccatgggcccctggccgcctgtgtgcccctcgggtgtgttactctttggttcccttcctcctctgtgagccgataggacgtttccacccctcctcttgttcctgcactacctggaggtaggaaagaggaagagatgtcccttttagctccgcacactaccccatcccctgctgctgctgctgctgctgggagtgtgtcaaggggttggggctgtttctgtcttccctggcatttgatgtcaagaggaaagctgcttctgttggcctgggtgtttcgaggttctcctgcagtcactactgggcctcctgggaggtggcccattgctacctgctgagcctgggcaagtctggcatcgaggagaggcccaggtatgagccctctgcagggtcagccaccccagccccagacccccactgtggctcctataatctcattgcccttttcagccacatcccatggctccagggctgtgctctttggggaacagtgactttgggctgcattccaggtagctccctgatgctgaacggtggccggcaggtgctccagcttcctggcatcctggcccaagcacacctgggggccgtgagccacaggtgctgcccaagagaatgccctccttagccttcccaaaatgacaggatcaaaggatcccgcaggcacagtttctttccaggcctgggttctgagggctggtgggtggcgctcatttgtttaggtgaattaacttcacagttagataaccaatccccactgctgggtgacttcccacgtggttgcctctctgtctactcggagccttggcaccacgtgctgctcagcaccccctccgcctgggctcggaagcatagcggacgatccagtttggatgttctgtttcccaagagccagccaggcattgacctccaatacccgttctctgcctgggattgcagaggcccctcttttaggaagaacacagacagcagtccaaacaggagctgcaggaaggccctggaggagggaagtaccaccagtgcaggcttgaggctgagagatggtgaggctcgggcagaggagaaccaaggtctttcagttgatgattaaagagttggagaacaggctgggcatggtggctcacacctgtaatcccagcactttgggaggccgaggcgggtggatcacttgaggttaggactttgagaccagcctggccaacatggtgaaaccccgtctccactaaaaatgcaaaaattagccaggcatggtggcaggtgcctataatcccagctactccggaggcggaggcaggagaattgcttgaacctgggaggcggaggtggccatgagctgagatcacgccattgcactctgcactccagcctgggcaacagagtgaaattccgtctcaaaaaaaaagagttggaaaacagttggagaagccagaccctgttggcaaagtttgcaaggggtgctacggagagggaggtgcccaccccaggggtgaagacaggatgggtggggttctcagctccactggacaccaaacagaagctgtaagtgcaaggctagtgcccatgtcgagggctgggcctttctgggcccttcataaacattggcaaacaaagcttgggttctcggcttgtctgggccaagttctaattccttccaggagcgtgggcacgttgcttacctcttagctgtttcttctccaggaagtggtggagctggagcctgctgcatgggagggttctgtggagtgagatgagatgttttacgtcatgctcttttcacaccttcttggcacccagaaagagctcagcaaacattagctgctaccagccaccctgactgtggctgtcagccagcattgttcttcccaggccctgccctaccctcctcctggcatagtgtctctcagggcataggaaactttctcggccagattggccatgggaggctttcttggggaccagagagtctgcagggagggcaagtcaagagcaggtgagagggagggaagggcgagcaggacccttgacctcattctcggctgcagtgtatattggcctgcctggtgaccctccttgctcctggtcccactgccaaacctctggagtctgccacatccctgcatagacagggccactgacaggcagtggcagccagttcagtggcactcagccaggtctccaggggtgtgcgctttgctctgggggcagggtagcgggggctgaggccactggctgcctccagggcccccccaccagccagcagctggaagctccaccttggtcttcacttgggccgtcttccttctccacttcctcagctgctatgtgggcttctttggcaacttttccttgtctcaccagtcaaggccctgctgatttgttgatgatcagactgtagttcgtgtacctggggaagttttccagcatctccatggagccatggtctctgattcctggagcatgtcgtagtcggttcaggctgctgtaacaaagtatcatctgctgagaggctcacacacaggcctttacctctcacagtggtggaggctggagatccggcagggtgccagcagggtcaggttctgatgagggcagtgagaagcacggccaccctcccactgtaccctcacatggccttcctgggagtggacatggagagagaaaaggacctctctttttttccttcttatgaggacactcatcccatcacatggattccaccgcatgacctcatctacacctactcacctcgcaaaggccccacctccagataccagcccattggagttagggcctcagcataaattctgagggggacagaaactttcagccctaacagtatgcttcttccagactggccttcctgggaaggccctggataggctgtgcctggggttgggggtgatgttgcactggcaacagctggaggaggcagctggcctgggggaagtccccttagcaaggaggtgcccctcctcactcccaccagcctgatgcgaccccctcctcagaagacagggcacataatgtgacctcacagggcctcagtttccttgtgtgtagaaatcagggttatggtgcctgccttgtagagtcctggtgaggagtgagtggtgtgattcatgggaagctgtgactgtcacattcccacctgcagaggacatggcgaagggtgacagccccgtgtgaggccctgcaggtcgcagtttcatttaatcctcagaacataccaccagactggtctttctcaccccatcatgtttaaggaaacagaggctccaagaaatggaggagcatagccagcatcatcgtcacagagaaggagaagggtgggctcgggacagtgaagatgcaggctgtcctggccacccttgctttctgcgggctcctgtggggatgatgattttagttattcaagaagacaggtggcgtttcttccaactggtgtttcccacctgggatgtgggggggctccccaaagggagtgttgtcctgccaactggggcctgctgtcccactgccctgccccgctctgaagcacacacagggacccatgcccacacggggttacttgcaccaggacacacacaggcctgacacgcacaggacatgcccttgcatgggaacacacacacagaaacatggagatgcacacagtgagacacacgggcacacacctacccaggccacaggcctgtgtggggttccacgcacgagggcacgctcaggcactcacactcacacaagaatgaacacacctggaaacatggagacacacagggacacacagacgcagagcacataggatcttcccctgtgcccttttcatacacagactcccatggccccggggagccaaagtgtggtaccgtccctgtcccggggccactgaggccctggccctctctgtcccacagctccagctgggactgtttgccctagttgagatgctgagccttggggacagtggtttccagccacgtggccttatgccggctttgggatgcagtcaggattgtgaccccggcccacccttgccgtgtgccctggaggacgactcgggtgggctatgcaggaagcctgtgctgatctcaaggccaactgtcctgtactccaggccggggaccaggctgctgagcgcttccgagagggacatctcctgggcagggagtgacataggccacgccatgtgggcctcccagccatgtgctggtgctgtgtgggctgggagggcaggcaggggccgagtgacggggactgcagagcggggcctgagatgctgtgacatgctgggctgcctgtggctttcgggcttctctcagatgagagttgcacaggtgggtggggggttggggagtctgtggcagcatcaaaagagtagcccagaaaccgccgagtccactgttcgagcctcccgggcctgcagcccgcaccccagaggggccacttcctccccacagtcaggcctgtgtgtcctctcaacgtggcaagccggcatgtgggtgctacaggtccccagtgtgacactcagtagccttgctgaaggccgagggtgccccttaggtgggttgtgggcagcctctgctggagagggagctgcgtttcttgaccgcaggcagagtgggctgggtctgcagtttctgagctgagcatggggtgccctctgctggtgatggcgagaagctcactgcctttgtatggagaaggctgccatccagccccgccactgccccagaaggaaggcgcctgagacccctcctccttggccgggaggccctttgctgtgtccctgccaagaggacctactgcagtccttcccgaaggacctcagtgtcctgggaccctacccagatctggtccccactgcagacccagcagtttgggttacccggcttcagcgctccagctctacatgatgtttctccaggtgcacatgctgtttcttgcttcccgtgggtgccgtcaccaggcagccgtctgccctcggcaggcggggtgtgggtgagtgccgatgagtcatggccttggcacgccggcagccttcctacccttccacttatgggcaccagcagcccctgcgtaattcattggttccccttcgcaagagccggctgcctgtcgtgagccaagctgcttatgatggtgacatgaagcctccacctctgagagtgtcggaggactggcccaggctgttcttgcaaatggggagctctgttgcctccggccccagaatgggggaaaagttcagagagaccgaggctccccgagaagaacctcaggctgcaggtgacagcagggcaaggtgcctggtctggccccaggaccagcctggctccctgagagcacaaggcctcatcacttctcgagatgaggacaggtgcaccgcctgcggggagacactgggttttcacactctctgttgtatgtgcctcccctgccaacccttctgactctcagtgcagggcgggcgtcgtcctccctgtgagccttccctgagaccaggtgggctgggtgcccactaaacacttggcctctctgccacgaggttgtggactcctgagggtagaggcctgtgaatgttacccctctctttctgcgctgcctgggacagagggtggacctccctgaagctctgttttctcattaaggacctgcctacagcctgttgtggggattgggtcaaataattcaggcgatgtgctcgtgcagtgcgctggtcccagcgtggggaaggcttgctgcgacagcctctcctcctgtccctgtaccctcggcacagcgcccaaccctgtgaggtaccaggcaggggtgacttacctagacatgcccattcagcagccccttgagcaagaaggaccgacccttgcctttcagatgcagaccaagatgcagaaaggcacccttctcaggccgcaggtgtccaggcaggtgtcagaggtgcagcccgtgcacaccggggaccctatccatcctgtctagttgggaggactaggagttccacatgtgggaccctcagttcctgctgccttcagaaccaggcccaacccttgctgtgacctcgagggctgccacttttcagagtgcactgggcctgtctccacccatagaccatactgccacatctgtacctcgggcaccaatctctccccaccacaggggcctgtgcctgagatggtccctctacagaaatacctgctcctggcatggctggcttcttgccaattctggatctccagctgccaccccagagaggcactggcttccctgtttaaagagggtccccccatcacccatcttcacagcagactgtttgcttggctgtgtgccccttcagacccacacccattacctccccctctcccccatcctcccaccctcttccaaaggctgaacacacaggagggattgggaaatttgttgaacaaagaagttacacataagccctgatgtgttagcaggacagtgagatgaacaaaacgttctggaaagtgggtgtgagggtcagatgtggagggagtgaaatcttcccagggagagaatgtctctgggtcaacctgctcctgctgggctgggagggccgaacaccccccacccatcaccccaggctggccctgaccccagccttccctgtgcctgcagcaccggcagctgctgaaggacagcttcatggtggagctggtggagggggcccgcaagctgcgccacgtcttcctgttcaccgacctgcttctctgcaccaagctcaagaagcagagcggagggtgagtgacgatgtggcccctgtcccagcagtgaccccaccctgactctccaggtcatggagggtcttgtcatggcggaggtcagtggtgatgtagctcgttacattccgtttctacttgggcacaatgccaggctccaggttaaagattgtcactagcaatctggagacgtcatggggcatcagggtgaccagctttgactcctgtagtgaggggtaaacccgaccgtggcttccggcactattgcagaaaggtcacctcaggacccatccgggaagcgtgagatcaggggctgcaggcagtgctgggtggtggctgctccttgtctccccgagcctggtggtggctttccgagttatcctcggcataggcgtgcacacactcccctcctccctcctccctgggttcacccaggttgcaccaggttggaatggagcaaagagggccacactgggaaggaccagcacggggctctttcctgcatcctgccgttgccctgctgagtgggtttaatcagtcaactcagaggagagccttagttcccccatctgtcaggcgaggggatgacgccagctagatctgtagtccctcaaactttacggccctgggggtggatttcagtcctgtcctgtcattgtgcagccttgatgtgctcccacatgagccttcaaccttagagccagctcaggacaaggtggatctagactcctgagatgcctggggcctgcggtcacatgttcagagtgtctgttcccaggaatcctggcacctgccagtggcctcatcccagtctgtcccatggaacacgtgctgggttttaggtcaggtaaaccatgtatggccgagaacactggctcttgggctcttgacagcagtgacatcagccatagaaggcagtcggtgcatgtgaacgttcttctctccccatccccagcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagaatgacatccagagagagaaggtgcacaccaggggagcaagggccgggtttggtgtggtcagagtggcagcagtccccgcacacggccagtgggtgctttctccgtcaggcctctgggccccaggtctggtctctgggacccctgtaagctctcagctcttggagggctgggcatctgggcacaactaggtgtccagttgttctgagaacccccagctaaatggggagcaccataccagagcggctgccaacccaaccctccagaaaaatgaagggaactggtcgtggtctctacagtgcgcctttcacgggatacttcttagacctggtggactgcctcatgcttagttgtctgacctgtgaccaggggtccctcacgagagaaacttgtttaaactgtgtccagtttatgcccacctgaccattgctgtggcactgggagcctgattttgtgttttcactggcatccccggggaaaacttaacctaggcaaacacctcctagtttttcggaaacacagcaccacaataggaaacaagttcagagattttacctacaggttttggacaaggaggtgccatgagtagggagggcagtcttctgtccctgggtcatgcaaggcagaaatgaagagttagcgcatgacagctagcagtatttataagggaacagggtgtgatcactttaagttcacaggcaaatgcctggatggtccttttaaggaagcagcaggaatgcgggagctcagtcagccgggcgggagagaggcttccgggttctcacctctggccacaggcttgagctgttcaagtgtgtggtctcctgatacccaggctgcgtcctttgccgtgtggttccattacatgggtgaagtactgagtcaccagagagaaagtcacagccagacagtggagggcttggagtagtccaggatgcagggttgggggaggtgctggctgtcccccatacaagctaccctgatggggcccaggcccaggtggcagtgccacccctctaggtgttcaggactacctgcccttggttttttccagagatgtttgaagactgtaaaaatggtgaggacaagcccctcaatcaaaggttagccaggccagaggaggcgggtggcatcaaggttaggcctgggtccaggtatgcccaggtagggtggacgcagcaggacaggaggtcctcagcccttgcccagctgcccagcctgctgtacccaaacccagcacacttaggaacacagggagcttcaagactggggtgaacattctattgtcatccttgtgggactgtgacctccagggtagggtgtccccacacagagtgggagccagtgctcagggcagctgagccctattgactgttactgttgcattctccatgttcagctctttgggggatgggatggggtggggccctacctggtgacaggcagcacagttttctcctccccagggatagtggcttctagagtgaaacccatggctcagcataggaagggccttcccatccaggttctgttgacggtcgtctggtcttctgctggcatctccacaaacatgcccaggggcccgatgctgaaacctagttggattaggaagagggtgagggaccctgtaggtcacagcagcctcctagacattgtctgaatttgggaaaatgaaaggcagggatgttggtaaaagtttcttctctccgcccttgtgagaggaaagacttaattcctccaaaaaaggtttactgagcatgtcctgcagcttatgccatgccttgaccctgtaaaaaagctgtttctgtcctccagaggccaccagcaactgcggtctggggccctggtctgtgctgagtggagagatgggattcttgccctctgcaggctgaatgcagctggtggtggggatggatggaatgggagtgggttgtgtggagcgctggaatgggaaggtgaggctgtggcatctccccacagagggcgaacaagggcagcaaggctacggagaggctgaagaagaagctgtcggagcaggagtcactgctgctgcttatgtctcccagcatggccttcagggtgcacagccgcaacggcaaggtgagcgcctgctgttccggcccctcctgctctcctggcctgggatgggctcctggttgcctaatggcagtgcgttttcacttggatgcgccccactctgagagaggcatgtccggcatggtgcatgcaagcacgcacattcctttgtctggggctttgggctgtagcccccaggttgagtggcagctggctcagctcccacagctgggagtggacagggtctccagggagggtatagggcaggggagcctagcaggtttgtgcagatctggcccttggtacagggatgctgtcctggggccttgagggccagagacacaccttctgtcctgagtctggctcctgctgccatctgtaacctgggcctctccctcctgtcaatacatgtctgtcaatgtccagaatggcttgttttctagcctgaccaggagaggcagctggtgggctctgcagaagcctcacctctgggctagtgtggggcttgtgaattgaatgcaggaggtcaggtctggatcaacgttcacctctgcagatcccacctggttacctccatgtccctaagctgtgcccctctgccagcatcacaccctgacccatgtagttcgggtgagagatggtgtgccagaggtgctgtggcacccagctggcaggaagggtagggagtgccggaagcgacatgccaggccgtgagcacacctggccactgggctccagccggctggagatacgagttgtgtgctctaaggtgccccgggcctaccaggcatttgcgtagccagggcggagataactgggtgtgttcttcttgcccaccctagagttacacgttcctgatctcctctgactatgagcgtgcagagtggagggagaacatccgggagcagcagaagaagtgtgagtatcctctgtcctgagaggggctgggcttcaaaccattagggccaggctggcagctcctgtggttttaaaccttcttttttatttcgaggggttttatccaagtgaagtgttgcatggagggctaatttagaaaagaagttggcgacagccatcccgataggcccccagccctcttgttcccctgccagcctatcctgcccccatcacctgggcactcatttccccactgccctgtgatcccctgtgaatcccccttccccaggccctttccagattccacacctgcccctacacacacccctgccatctccccctagtctgctgcccatacaccgcacccccggcctgccccctagtcctttctgggaccctgccaccaccccattttcttggcctcccccatttctcctcatctactccccgccccctgggccttccctgccccagcaggtgctgatgctaaaggggcctttggctgggcccacttgggcattcacactgtgctggccccactgccctgttcatatggccggggttgcccgctctcagctcaggggcgctccctcctgtctggggcagccccttccttctctgggcacttccctctgtcagggcgctccttccttcgggtcctgcctggcagtgtcggtggggaaggcagacccggttccctccttggaggtttgggattcaccctgagctggggctctgcatgcctctggcctggcctgacctcccgcgccctcaggctcatcattctcacctatgcagagccacctctcggcccccaatgccaccgtggcctgggggatcaaggatctccgggcagccctgccagtgcttgtgtcccagggtttcctgtcataacataggagccccagccatttccagagtggcagcctctgttccctgttcagcattatgcccagaaataagccccttttcctcacctggtggagaaacgggggcctgtgttagcagaggacgggcagagccatgctgctgtctgtatggggagacctcacagggaggtgctcccagtccagccactcattctcagacctgccttgtggctgtgcttaggtagcgtgggatgtgtgtgtttgtaagtctcatgctaagactcctccaggcctgggctctccagggccacacctcactctgccgccagaccagcactgcacttgagagccaagtgccctctcctgagcccccaagccctggcaccagttcttgccgtgccccttccccagggtgtgtggtggaggtccagtgggaggggccagagggccaaggagcagattgaccaattggtgcacctcttttccaacctcccaggtttcagaagcttctccctgacatccgtggagctgcagatgctgaccaactcgtgtgtgaaactccagactgtccacagcattccgctgaccatcaataaggaaggtgggcccccccgtttccgtgtacagggcacctgcagggagggcaggcagctagcctgaaggctgatccccccttcctgttagcacttttgatgggactagtggactttggttcagaaggaagagctatgcttgttagggcctcttgtctcctcccaggagtggacaaggtgggttaggagcagtttctccctgagtggctgctgctgggtggttgaggagatgcacggcttctgttcctagtcacaaggctgcagcagacgctcctcagatgctctgtgccttggatctggccccactcccgtcctcccagccctcctctcctccagctacctgccagccggcacttttggtcaagctgttttgcattcactgttgcacatatgctcagtcacacacacagcatacgctatgcacatgtgtccacacacaccccacccacatcccacatcaccccgaccccctctgctgtccttggaaccttattacacttcgagtcactggtttgcctgtattgtgaaaccagctggatcctgagatccccaagacagaaatcatgatgagtatgtttttggcccatgacactggcttaccttgtgccaggcagatggcagccacacagtgtccaccggatggttgattttgaagcagagttagcttgtcacctgcctccctttcccgggacaacagaagctgacctctttgatctcttgcgcagatgatgagtctccggggctctatgggtttctgaatgtcatcgtccactcagccactggatttaagcagagttcaagtaagtactggtttggggaggagggttgcagcggccgagccagggtctccacccaggaaggactcatcgggcagggtgtggggaaacagggaggttgttcagatgaccacgggacacctttgaccctggccgctgtggagtgtttgtgctggttgatgccttctgggtgtggaattgtttttcccggagtggcctctgccctctcccctagcctgtctcagatcctgggagctggtgagctgccccctgcaggtggatcgagtaattgcaggggtttggcaaggactttgacagacatccccaggggtgcccgggagtgtggggtccaagccaggagggctgtcagcagtgcaccttcaccccacagcagagcagatttggctgctctgtcgagctggatggatactactttttttttcctttccctctaagtgggggtctcccccagctactggagctgtcagaacagtgaaggctggtaacacatgagttgcactgtgtaagtttctcgaggccgggcgcagtggctcatgcctgtaatcccagcactttgggaggctgaggcaggtggatcgcttgagctcaggagttggagaccagcctgaccaacatggtgaaaccctgtgtctactaaaaatacaaagattagccgggctaggcagtgggcacctgtaatcacaactgcttgggaggctgagggaagagaatcgcttgaacccaggaggcggaggttgcagtgagccgagcttgtgccactgcattccagcctgggcgacagagcaagactccgcctcaaaaaaaaaaaaaaaaagttcctagaaacagcaaaatgtggagacagaaagcttaccagggattgttggggaatggggttgggagagaggactaactgcagatgaacccaagggggactttttaggtgagagcagtgtcgtgaaaagactgtggtgctgtttgcgctcacatttacatttcctaaaattctttaaaccctacacttggaatggatgaattacatgacatgcagattgcaccttcataacataatctttctcctgggcccctgtctctggctgcctcataaacgctggtgtttccctcgtgggcctccctgcatccctgcatctcctcccgggtcctgtctgtgagcaatacagcgtgacaccctacgctgccccgtggtcccgggcttgtctctccttgcctccctgttacctttctttctatctcttccttgccccgtgcactcaaccttgcatccccaaaccaaacctattattcatggaccccaaacttgttcctcttatgtcctgtccctttgaggggcaccaccatccacccgcatggccaagccagaaaccgtggtctgctctccctccgttaaatgccattctccatcagtgaggcttcttagtcatctctggctgcctggccaggccctggctgtggcctcctccctggtctttgtagctctggatatccctgcagaaagggtccccactaccaggcctctccatccccagtctcaggtagtttttctaaaatgcaaaccccaccctgcaacttaccgcccacagcccagcccactcttctccaggcctcgcctccctcccttccccctgcaccccacgacttctccagcactgagctgcttcctgtgccccacagtggcctggagtcccctttgccttaactctttgccccatagtacagcggggtctgctctgattgtaggggcttcccacatcccccaggatggctgccctctgctgtggcatcactgtgtaacaatggcgtgtacacctctctgtccccaccagtgcagggcccttctcatcgtaggggctttagctggggtttgtggatcgactgagtgaacgaatgttgtgggaagtcccgtttcccagccgcacccagggaaattccacagagcgggcaggggcatcgcatgaggtgctggtgttcacgccagaccacaattaggtgtttaatttttaaaaagaaagttacaaccttttttttttatttttattttttctgattctgcaaataacacctgctcttacagaccatgtgggtgatgtggaaaagacctgtgaccttctccatgtccacttctccccacagatctgtactgcaccctggaggtggattcctttgggtattttgtgaataaagcaaagacgcgcgtctacagggacacagctgagccaaactggaacgaggtgaggaactgattccacaagggcccagcctgccaggtggggcacaggatattttccactggagataatctaaaccttcaggggctccctgagggcttcccccgaaggcagtgctgctgaattccaggaatctcctggggggccagtaggtgacgtgtccaagagattttatctccttgttcctgaaaaccttacccatccctgtcatcacaaagaagccacctattttgctggagaagtgtttggaaagagacttaaaaaggctttttgtctgcctttgttagcgcttatgtttacttggtaggtttccatagtgtttttccgcagaagttggaatgagctcccgtgaccctcttggcttccggaagcctggggctctgctggtggggctgggacagggactgtagggtcctgcttgcttgtctcggggtgttgggtttgtattgtgtgtcgccgtgccttcctccaccttggagagctgctgtgtgagtcacttagccatttggccctgcaccttcgggagtaggggaatgattgcagagaggcccgtattgactaagtcccagatccatgagaggtgccatttcccagcttctgcagcagctgtgacctcgaaggtctcattcttgatgctgcaggtagaggccagctgggcctgcagagagctgcctcccacccctgctcctgcgaaggaggaagccaagagcccccaggctgcttggtctacacgggtcacgaggctggtggatggagcagtggggctggaacccaggtctcctttctcagcatccactactctttgatcattttagacatgttgcttgaatagtacaagggcacaaggagctcagtaaaataacctggtcattgtagctctggacatccctgcagaaagggctgagtggcagctgtgatgagagggggtataagagccacaggggatccatcgaagaagcctttgcagagaccaagagtgccacgacccagcagagacaacaagagagggtgccaggcagtgtgcaaaaggttcaggtgccaggcagccacggaagctccggggaggcatgaagacatgagggttagattgtagcaggtcacgtccaccaccctcactgtccatgaagatctggacttggggacactcacatgttcctggcgcacacacacacccaccccctcccctattcaggttcagaaattcctgctgcttgcttcttcccgcaccctcctccatttccccgccaagaagccatgcgcgcacacgcctcggtgtgaagcgcagattcaccaacagcaccgtcagggtgatggaggagagagttaacaccacgcacccacggcagacaactggagagctcggggagcagtttttcctccaagtccctctccctcctgtatcaaccccaaggatcactcttttgtttccttttagatataattcattttttaaagagcggttttaggtttgcagcaaaatggagcagaaagaacagagttcccatgtacctcctgccccccatctcaattatggacatcccactccagggtgggacatgagttacagttgatgagcctgcattaacccatcattaccacccagagttcatagttgatgttaggtagggttcattcttggtgttacacatgttatgtgttctgacaaacgtggaatgacgtgtatccaccataataatatcttacagaatagtctcaccgccataaaagtgaacctgcatcgacagatcattatctttcagagtccatagaaatatctttttttgagggagagtctcacactgttggccagcctggaatgcagtggcatgatcttggcttactgcagcctccgcctcccggattcaagcaattctcgtgcctcagccttacaagtagctgggatcacaggcatgcaccaccacgccatactatttttcgtatttttagtaggatggggtttcgccatgttggctagttagtctcgtactcctggtctcaagtgatctgcccaccttggcctcccaaagtactgggattacaggtgtgagccaccgtgcccagcccatagaaatatcttaacaagtaccctggcgattgtgaggcaggtggtgtggggatcaccctttgagatgctggtgtaaggagtttggattaagtttgaaaggcagtcggagcttctggaagcatccgggctgggccacggtctcatgccaggggtgcttacaaggaatacttccatgtgtcccaggactaagggaggagggtctcaggcattggtccctctgggccagcaagggcagcagggagagccccggttcagaggacccttcagccataacattgacccgtttgttcacactggacttcccttctcccttggggctgcaggaatttgagatagagctggagggctcccagaccctgaggatactgtgctatgaaaagtgttacaacaagacgaagatccccaaggaggacggcgagagcacggacagactcatggggaagggccaggtccaggtgaggcagccatccctaccctcccctgcccgatgcatggcgtcctttttcatgcagcccctggggacactgagatggtcatggccttgcacccagggtggggtggggtgggcagctgtggctctgaaacatccatcgtgggagacctgagccggtgcctgcatgtatcttgatgggtcttgacgtaccaccctctgtctgcgtgtctgttgcgtcggctcattcccaaaggaatttccattcaacttggttttgcagctggggcctcagttcctgcccggccttaggagaacccaaggtggaacagttagatggtgtcctaggctgaaattggcccatcctgtgccagtcttcttagaaaagcacaggggtcccagaggctgcctgcaagcacaggggtcccagaggctgcctgcttggcatcccctatctgtggtctagacccaatttctagggtatagagctgtatctctgaacagggtgcacacagacaggtctcctcccaggctaatctggaagcccccaggtgagaccgagaatgtgtccatacaggaccagcaagggggccctggttcttaaggagactgcctgggccctctgtccttcagaagcttgtctagcccctgggagcacgccaccagggtttcctggaggatcatagctggcgccccaggccctgtttatcctgttcccaccctcacaattgcgcgggggtagctgagaggaagccctgatcgtgctttccttatagtgcattatatcagtgggttgtgggtacagctctctcttcccaggaccttccatcttcacaagaggcctctagagggagtgggtttggctttccacatgcccctagaagcacagggctcctcaggaagcccagtctccctccctaagcaggaagtaaaaatcctcttgtggttaaataccaagtgccaggctgggcgtggtgctcacgcctgtaatcccagcactttgggaggccgaggtgggcggatcacgaggtcaggagatcgagaccatcctggctaacaccgtgaaaccccgtctctactaaaaatacaaaaaattagccaggcgtggtggcgggtgcctgtagtcccagctactcgggaggccgaggcaggagaatggcatgaacctgggaggcggagcttgcaatgagtcaagatcacaccgctgatctctagcctgggtgacagagcgagagtccgtctcaaaaaaaaaaaaaaaaaaaaaaataccaagtgccaggaagaatgaagggagagggtggctcttccctgagtcacctgtcatctttgctgatggatcccacattctcattcagatcagcaaatctttaccaagtgctggcctcacccccttctgccaccctggcctggctggccacatcttcggaggtgcagctactgcctgtttttctgccttggaagcttataagggaactcagtggctcagagcctcctggggctccctatactttgagatcaggtttaaaagcaaaaagactcctctggcacatgcctgtattccagctactcaggacgctgaagcgagaggattgcttgagcccagctattcaagaccagcctgggcaacatagacccctgtctaaaacaaaataaattaactaaaaattgctctcagctctcctgtcgctgtcccactgcactgtcttgttcactctgccagcctttgtgtggattctcatggtgggagattgtaccacacagatgggccacaccactcttgatggagtacttagtgctggtctcctttgagatccgaagtattttagcatcagtcaaatgacggtcatagtttgggtgatggtcacggctcaggttcttttttacacgtgcttgctttggttgttgttgttgttctttgttttcttgaggcagtatctggctgtgtctcccaggctggcgtgcaatggcaggatcatagctcactgcaacctcaaactcctggctgaagcaatctttgtgccctagcctcccaagttgttgggattacagtcgtgccccaccatgcctggctaagttgttttttgttttttgttttttttttttttttcgagacagagttttgctcttgttgcccaggccggagtgcagtggtgtgatcttggctctctgcaacctcccgggttcaagcgattctcctgcctcagcctcccaaagtgatgggattacaggcctgagccactgtgcctggccacatgtgctttcccattcggtccttgcagcagatctttgagagagctcatttgacactcaggagatgcttctctaacctgctcagaatcagggccctgggtattcagggaggtagagggagcagactgcaaagccagtcgtgctcccatcgctcccacttctctctccctctccatgttttctgtctcccccacccagcctagggcattcctcccccacagtccagcctgcatctggcacagtgtcactgctcagcccagggatactcacagcctgggtgcctggctccttttttcagctcatcaaaccaggtaaagggaggttcagattctgccaaccattgactcaattcatccaaatcttcaatcactggaatcctgggagtggctggatttgaaccaggacctctgagtactattgctaagtaactgggggtctcagtgaaagagagaaaagagctgataggcctcttcctgtgttatcatgtcaggccatcttttgaaactcttttctgcaatgctactgaagtatttatgcacgtgacctgtgctcttctgtcagtctaggggtgctggctgagcaccccaccccatcccggggaagaggagagcagtaagtgtcgaagaaaaacccgagctggacagcagttaaagtggtaaaagcaggttttgtttagtaactattgtgatagggaaaagactagaaatggaaggcctagaaatgggctcaatgctgaagtcacttggatgagtggggacttgcagccaagaagcagggtaggggttgatggatggaaaatgatgaagtaacatcagggggaagagggattctggtgaaaccgacccgacaggattcttgctgaagacaggccaaagtgatcgatctcccccgggggatggcgtggggtgaggaatctgatcagatagcaagggcagggggttctggctaaacggacttagcaggattcttgcaaaatttgggctcctgagaacatgcccaaggatgggatctagctggaataaaaagctggagggaccagatgagttccgtcaaggagagtctttgtcacacccccaccacactcagtgtgacctgggtgaattactgtcccactggcccaaatgtgtttcctcacttttccttcccttccttccttcccttccttcccttccttccttttctttctttcttcctttcctttttcctttttcctttccttttgcctttccttcttcttcggagtctcactgtcttgcccaggctggagtgcagcggtgccatctcagcttactgcaacctctgcctcccgggttcaagcgattctgctgccgcagcctcctgaatagctgttattacaggcatgtgccaccacgcctggctaatttttttgtatttttagtagagacggggtttcaccatgttggccaggctggtctcgaactcctgacctccagtggtccacccgccttggcctcccaaagtgctgggattataggcgtgagctactgcacccagcctcctcacctttaaatcttccccaaatatttgttcaaaacaaacatcactcattttgtgttcctgctgcaacagaccccctggggcctgcccctctccaaggctgttttttgttttttgagacagagtctggctctgtcgcccaggctggagtgcagtggcatgatctcggctcactgcaagctccgcctcctgggttcacgccattctcctgcctcagcctcccgagtagccgggactacaggcgcccgccaccacacccagctaatttcttgtatttttagtagagatggggtttcaccgtggtctcgatctcctgacctcatgatccgccctcctcagcctcccaaagtgctgggattacaggcgtgagccaccacgcctagctccaagactgtttaggggctacgtaagtttctctcctatgggcgcctctgccacatggaccatgtctcattcgtctcggaatgccccccaggcacatcacagacccccctgcacgggtgaatggctgtgtggacgagacctacatggccctgagataatccttgaaatacaaatgaggattctcgatgccttcgtggccttacctgaccatacctcccccaactcccatcacgtcccccgtgacgtgatctttattttggcttatgtttgtctctgctgctggaaagtaaacgtggaggacagggctttgtccagttcattctctgtggtatctccagtatccagacagagacataaaacatacatctgtatctgtaagttatttaatacattgtttaatggatctagagtttatatatatatatatatatatatagtaaaatatatattggcacaaagcaagtactgttacatgcactggaaattgctgagccaggcacctgccctctcacagatgaaggtgctgaagttcccaggggtggctggggcgggagccagccaagcctggggcttctccaccacgctgtgcatgtgcccagtggtggtcggggccttcatggtgagggggtcggggagttcagagtttggactcccacgtgcatccctgcaccatgggcagcctttttatcttagccagaaggctgagaagtaattccttcctttttaaaaaaattgtaaaataagcacaatgtaaaatgtcccaggtgtttttaagtgtgcagttcagtggcatcaggcacattcacattgttgtgcagccatcaccaccatcatctccagaacttttttttcatcctctcaaactgaaactctacacccattaaacaataactcccaggggggcaggtgcaaaaagaataactccccattcctcctgcccccagctcctgttaacctctagtccactttctgcctctgtggatttgcctactctagctacctcatgtaagtggaatcatacagcatttgtcttttgggtctggtttatttcacttagcagcatgtcctcaaggctcacccatgttgtagaatgtgtcagaatgtccttcctcttgaaggctgagtaatattccattgtatggattaacagacattcaccagcaggtggacgcctgggttctttccagtctgaggctggcatggtcagtgctgttgtgcacatggacataagatccacccaacttggtgttatctttgcattcgcaagctgttgccaggcacatccatgggctctcggggggaacagctgctgcagagtgggcagtccaacagggagaccgcccgaaaatgggtggacctcactgcgtggtggggacttgagagcagctgccagggtgccaccaggagggccccagtcagacctgctggcttgtacctggtcaggtgcccacataacccaggctggcagagaagtctgggaaactccagccagccagccagagcaccagcttcaaatgaagcagaggctcacagtccaaatctcatccccgaggctcacataaaacattggcaacaacaaaaatgaactctgatgcccccactggaacatgagttgtgagcccagcaagacacataaatagagcaggagaaatgggagaagacaaaagtctatgacttgatagaatgttgccctctaaggagaatagacagggctaacatgatttagcaacctagaaaatttgcagatgaagagagatgcacctgtcatcctagcactttgtgaggctgaggagggcggatcatttgacatcaggagttcaagaccggcctgaccaacatggtgaaaccccgtctctactaaaaacacaaaaaaattagccaggcgcgatggcgcatgcctgtagtcccagctactcgggaagccaaggtaggagaattgcttgaaccagggaggcagggatttcagtgagccagggtcgtgccactgcactccagcctgggggacagagcgagactatctcaaaaaagacagaaaaaacctgaagaaattcctaatggcagcaaggctccaatttccccagctctgccaactgtggtgactccctctctggcccaggatgtgcaggagcactgggactgtgtctcagggcccccgtccctgttgcgctgcactcggctaggctgcagactagccctccagcaatgtgtcccataccccgtcccatgaatcttggatggatgttgatgccttcaccttgaaaaatccctccctgaagatacagattcaatgtcccctgctctgtgaaggcttctctgtcccgtgacctcacttcccaagtaaccgtgccatctgagccaccagtcaatctgggccaaagcctgccctggctcttggcacatttgccacatccttcctttccagcttctctgatctagaccatgaaggctggggagaggggtcttcttgttcttggggacccccccgccaggcatggcacacaggaagccttccatgactagggtggcacagcgggttcctggtgtctgaggatggaccaggatggcctcgctcactcaaatggctcattcaggctcggggctggcttggaagggacacccgacttgggtcctcttgcacctgcccacacacaaggacttcaatttgtgctgtcagtggctcttttctggactgtgggcaccaccacagctttgtccctgctgtactgtgtatccccttgcctttctggcttgtggctctgaacaaagcaggtcacccatcccaatttctagagcccccccaccgccacccccaccctcatggagcctctatcgtgcaagaagggaggtggggacctggcaagtcatccaggacaggcatttgaagagcaggagccaaaatctgagactcgggcaagtggttcctaaacccagctcatcagcaccattaaggggagcaaaaaaccagaccgggccaagcccccagcccagaagatcccgactcctgctgcccacagacaggcacatgagcagctttgctgaggactcctttccatcccagacccctgcccttggggcctgccagggacctctgccctcatggttggatctggacactcccgggatgctgcggcttctctacctgctgcaactgcctcacctcacgggagggtctctctacgcaacttctgagtcgaggtgcataagcagtgtgggggctgtaggcccctgtagctggctgcagagagccaagcgcctcccacacggtacagcacagaaggctcctggtgtcactgggaaaagcccagattcaaaaaggctgggctccggagtcatgcacatcctctctcaggtatccctgtgcagaaaacagtgtccacgggggagaaagaggccaggctggtgtcgcagagcgccaatggcatagtcaccaccactcctccgacttacttcctcctgggatcccacaaacaagccccccagctgggagcctggacctccagggaccagggcagccgccacctacttggcgtgagtcatgaatgcccttcacacagcaatcagattccttcctgtctagccatggttcccacccatcactcccactgacacagggaccaggggctggagccagatagtgcctgctccatcgcctcctcacaaacgacagataaggatgagaacagcagcaaacgctgaccccccacccgtgagagcataagtcactcaaccgtcaaggctgcatggccccccccaccccaatttaattcacctgtgagagggcaagtgcctggctcagcaatttctagtgcatgtaacagtacttgctttgtgccaatatgtattttactatatatatataaactctagatccattaaacaatgtattattacataacttatagaggtatgttttatgtctctgtctgggtactggagataccacagagaatgaactggacaaagccctgtcctccacgtttactttccagcagcagagacaaacataagccaaaataaagatcacgtcacaggggacgtgatgggagtcggaggaggtatggtcaggtaaggcggataccgtcatgaaggcaccaagaatcctcatttgtatttcaaggattatctgagggccacgtaggtcttgtccacacagccattcacccattcaggggggtctctgatgtgcctggggggcattccgagatgaatgagacatgcatggtccatgtggcagaggcaccaataggagagaaacttatgtatgtagcctcttaaacagacttggagaggggcaggccccagggggtctcttgcagcaggaacacaaaatgagtgatgtttgttttgaaccaatatttggggaagatatgaagatgtaaacatcatgaaaatgtaagatcacatgagcaaattcttacacagattccacgggattcttcttgaagcacaccgccatcaacatggatagtgatacaggtcctccttgctctattgagagccacttttggaccctttatttttaacttttgtaccatgaaatgcatccatttttataaccgaatgattttatagtaaatttacagagctgtacaacttttaccaacaatccagttttagaatatttctatcaccccaatttccttgttgcctttttttttttttttttttttaagacagggtcttgctctgttgcccaggttggagtacagtggtgcaaccacactcagcacaaccttgatgtcccaggctcaagtgctcttcctaccttagcctctcaagtagctgggaccacaggcatgcgccaccatgccaggctattttttttttttttttttttttttgagacaaggtcttgttttgctgcccaagctggtctcaaattcctaggctcaagtgatcctcctgccttggcctcccaaagtgctgagattacaggtgtgaaccaccgtgcccagcccctgttcccagttatagccactcccagacccaagccgatctgctttttgtctttagagatttgcccattcttcacatttcataaacgtggaatcatactagagtgggcttttttgactgatttcctccacttaccattatgtttttgaggtttattcatgtggtagcattgtttggttcctttttatgataataattttccattgcatacatataacatgtttttatttctgcatttactatttgacagacacttggatcatttctagtttgggctgttaaggttgatgcagccacgaacatgtccttggtaccagtctctatatggacgtatgttttcattcactgagtaaacacctagtaagattgctgggctgtgcaacaaggtgactatttggggaactgccctacgttgtctggagtagctgcaccatcttacatccccagtggccatgtatgaaagcccatttctctacatcctcaccgatgctggttatagtgtatcctaagggagaagggtgtgttccttttgaagtgatgttagagactggttgggatcagagaagagaagcaaagagttaaaagtgggatagaggccaggcgcggtggcttacgcctgtaatcccagcactttaggaggccaagttgggtggattgctttaggtcaggagttcaagaccagcctgaccaacatggtgaaacctcgtctctactaaaaatacaaaaattaaccgggcatggtggcaggtgcctgtaatcccagctcctcaggggctgaggcaagagaatggtttgaagccaggaggcagaggttgcagtcagccgagatctcgccactgcactccagcctgggcaacagagtgagactccgccttaaaaaaaaaaaaaaaaaggtgcaggatggatctcaggagagcagattgtggtcatagactacagcaggaggcctgtaatctctctcctggtgaacacagaggttctctggtggtctcagcaaagacccacccccgggagtaggttatagtgcagacacatggggcccagacaggaacaactggggttgccctgctggaccatccaggctggtgacgatgggcgtgaaggaagctgttgtctacaaggagctaagtgaacaagcatttcctcctttggaaggtttactcatagccccctccctgcccctgctgagggtgggtgagaggatgtcctccggctgcccattggtgactcaatccagccacactgactacaaagcaagcagggcagtgctgggcccccagcagagccaccatgcaaagtggtcagtgatgcttcagggcagcacacagcacctgccccagttgggcttcggcctccctcagcccccaccccaccacttccctgggatggatgtgcacgatagttttctaggcagacctctaggccaccatctgccaggcccgctgaccatagtcattctttcaaggctcctgccttacccagtccagggggagaggagcagcaacctggtccatcctcctgagaccactgcatgtgagcagacagacccctgcctgcccagtccccggccaggcagcaggcatgttcctcaccaagaccttgcaacccagggggaccctggacagcatccggagtgcctcggtttttcccttaagggaaaactgtttcccccttggtcatctgtttttccaaaccccagtcttttgcttgtttacttctctggtgctttaaataactgcacgagagagcgtaccagccttgagcaatgtttgggattggctgagctgaggcacaggcctcattatcatgctattctttatacggcttccgctctgcggcgcacactctgttctttggaacagagccagccttgggacagcctttcccactggagctgccagtcaggaccgccgtgagagccagtgcctggaggccaacaccctggtcttcagtcactgggagtcacagagaggggcccgataaagagccctcctggcagcatcagtaccaggttggagtgggcgctggacaccaccaatgctggggagtggacgctggctggagccccacccagggctgcacattgctcagccagctagctctgggggagcaggacctgagcagggtgtcctccaccctgggtccatcagaggcactgcatttgattattggggttacctgctgggagtggtgcagattttggacagtctggattgcttccagcacaaggcaggctgaccagtcatactttactcagtctccaaacttgggcaacaggaaactagccacttgagaaggaagctcagcttttctgggctttagaggagatggagacacgttggaaattcccgtaaccaataggctggggtgggagggtgttcttcccacacacacacaaaaaagtggaacccggaggtgatgggaagctttgaccttggccagccagactgcggggtggggtttccctcaaagcctggtcaaaaggccttggaggctggaagctctcgtttagccccaccagcttcccagagcagcaaggccaagcatgcaagagtcaccatccaccctggccatgatgcagggcctcctttggtacttccaccccagccgggcgggccggagccgggcggcctctgctgaaaagcacctgtgggccgtggttccaggggggctttgaggggcagccgctgatgtctggacagcttctctttctgtctcttcttacctggactctgggttgcttgttagctgcttctgcctgttctgggttttcaaggggagaggggcccagtgatggctgttctttgaaggaaaggtaagaatgtctcctgcttaacatgtttctgtgtttccagttacttggttggttagtagagccagggtctctcgctttgttgcgcaggctggagtgcaatggcatgatcatggctcacagcagtctccaccttctagcctcaagtgttgcccccacctcagcctcccgagcagttgggactgcaggcacatgccaccatgcttggctaatgcttttgaaaattttttttttatagagacagggtctcactatattgcccaggctggtcttaaactcatgggctcaagtgatcctcctgcctcggcctttcaaagtgctgatatcacaggcagggtttccattttttaaagctcccagcagtggtataaactcctcctttccagagaaagcgcactctgtccgcatccctcatgttgtcctctcctgcctctgcttagggttcactccgggggaaagtgccacttgagagtttcctttttatgtgtggttctgactgaccgctccctgctcacagatgctgcttctcagggtggggtccctgaggcctggagtgtggcctctgacgaccttcagggccaggtgcggaatgagagcctgtggccgcatggcccccggtgggagacgtcccgccgccctttgcttctctgtgccactctggctgcacagttcagagccttgggaaacgttaaccagtaggacctagaaggggaggtgagaaggggtcaacccccaggtgtgcctgtggtgagccttcgtgctgagcaggtgcagggagggaggcccaggtgcacacacctgtgaagtaggggggcagctggctgggctccttgacctgctccagagcttcttattttctggccacttcacctgcagaaggcccaggtggctgtagccgctagggtcccttgcagtggaaatgatgcctgtcctcagcccctctctaggcctggcactgtgctcagcaccgtcgtgtgtgtgtatgtatatgtgcacgcatgtgaatgtgtgcagacatcatgaggtgtggtccctgctgttaggcagcttgccttgtggctgaagtgaaccatcacctgaatcaagggatggaaacacaaggccagatgcagtggccttctatggagtcagacggtggctccgtgacctggcttcactccagaactacctggggtttctagctgtgtaaatcccaggtcccactcagattatgagtcagttctctgcaggtggaacccagggaggtgttttttttgtttttgcttttatttttgagacgaagtcttgctgtgtcgcccaggctggagtgcagtggcgccatcttggctcactgcaacctccacctcctgagttcacaccattctcctgcctcagcctcccaagtagctgggactacagacgcccaccaccacgcccagctaatttgttgtatttttagtagggacagggtttcaccatgttagccaggatggtctcaacctcccgacctcgtgatccgcccacctcagcctctcaaagtgctgggattacaggcgtgagccaccgcacctggccagggaggtgtatttttaacaagatggtactgctcattcacccagcccagccagtgatcttggcatacccaggaaccgctgacatagaacgtgctccccataaaacgggagacagaggcttcacggatgggggacatgtggcttggtcatgacagggtgttacataccaggacagactgtgttcgggtgacattaaggacaagctcctgcaggctagctgtctggatagtgccgggtgggggtagaagttagaggggtcacagaggggcttcctcccggccccctcatcagctgcttgatttagggcttgtttctgggtccttctgggcctgattctgaaccatgggactggtgtggcctgcaggctcctcccgccacaagctgttcatggtgcagggggagaacagtgtccacaattccccagacagcagctgtggatgccaggcccccaggagttgttactgaagttgctgctggacagctcacctttcactgagctccacatagcacccgtggtgatggaagccggatggagagagcctgccagcctgcacatcagctcccaactgggcggggcagagggaggagggggtggggaccccaggcagcagggctctgggagcagtggggccctgggttccaggggtgtctggcaggcccctccttactctacctctgttggcctctggatggaggtgctggccgcagtcgggctctgcctctgactaagggttggggaagtggcgggtgtgggctgctgccccgtggggcctctgaacagaccccagggcctctgccaatcatgactccttcctttcagctggacccgcaggccctgcaggacagagactggcagcgcaccgtcatcgccatgaatggggtacgtgtccgtgggactctcctggtgcccacttcccccagaaggatagggtggcctctgttcatttcaaatcagtcagaggtggctgagcctgaggcagcatctgagagggagcctggttggagaagggagggcccccaagagcagaatcaccatgcacgggaatcgtcattcattggctggaatgcagttgccagccaggccctgagcatccctcctcaaacaaaggtctcatggcaccaccaggacaggtggggcctccactcagggacctgggggctgcccatagaaatggagacccctgatttgtctttaggtaccccagaaaggtttagaccttaaaagcaatgacacacccaaaaaggcccgggtataaatggtaaaatgttaatatttgagattcttggctttttcttacattattctgtctttcctacttaatttttaattgttactaagaaagagaaagccaggcacagtgcacctatagtctcagctactctggagtctgaggcaggagaatcactggaacccaagagttcgattacagcctgggcaacattgcaagctcctatatctaaaaaaaagcaagcaagcaagagaagcagcggggattttaggaggtgcttctgcagaaaccagtcgtttacatcatcttcaacaatcctggctcttgctgaagtagactaggggcttccccgaggggcggctccacctcatgctgagacctctgcatgccttgggggtggaaatatttgatgagactcccaggggtccttgggaccttgggctatgaggaccagaaggattagaggactgtgccccttctccctactgtagatcgaagtaaagctctcggtcaagttcaacagcagggagttcagcttgaagaggatgccgtcccgaaaacagacaggggtcttcggagtcaagattgctgtggtcaccaagtgagtggggaggggcttgggctcacgcactgagggtgcctgtcccttcagctgtttctgcagaaaagagcatgtgtgggtctctcctctctgtgcgtggccactgcacggtgaggtcaggccccagggaacacggcgtcttcagctacctcctgtgtttcctgcaaaccagctcaggaatgtccttgccacctggcttggaagcagtaggctggctccaggaactgcccaagtgcagggttttctgcccttgcttggaatttatcacggtcccagattcctgttgaatggccgtaacccctgcccctttgtcacgagtcagttgccaagagaagcctgtttggtttgagagcagttcatgcagacatagaccacttcctctgagaattcatttgcttccccaggatggaatctggctgggcctctgaccttgctggtcacgtgggccggggcctccatcagtcataccctggactcctatctgtgtctaaacaccacgccccacccccaactgcacggcagccactcgcatagcactctgggagggctgtgggcatgagcagcgaggactccatcagcagctcccccagataagccctgctaatgagggggcttgcgaagcagctttgatgtgctggtaaatccaggtgcaaaacagaactcaagttaaggcctccgcacagcactgcgttctaactgtgaaggattcttactctagtgtcctgtgtggaggtattggaattgtccattgctaagactcagaggagaaaagcacttagcatcgcaggacttggagcaccggtgctgaggcaacccttcattcattcgtcggatgtgtgttaaggcccaggcccagggcaggggtcagggattctcctctcacacagcacgtgggtggcaggaccaacaccgggtctgacctcccagccgggggtacaggctgctaaccccaggcctggaatctgtcagatgcccttcccgtgctgacttgacatagacaggcctcctgaccttcccgcaaaggtcatgtgtgattcgcaggggttctggccgcttgaaaggttcctgagaaagtacatgccatgaggacagagcttgcagagggaggacaggcatgcagaaggctctgtgtgcagccccagacctgggtaccttcgtcaccgtcctcaccccacctccgggtgtgcagatatggagcaggtctcctgtgttatggcccaagcagggctgttaggacactgagaacattccctcctcccgcaggagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcagtgagtgttggcctgcgcaggacgggatggaggtgtgggcaatggtgtccgcgatgagatctcagagtgctccatggcccaggcatgtcacatccttctctgtgtcttttcttcatttactgtgttattatttttaaaaaagagaagacaagagttgtagaaaaagcctctgtagaaaccagtttttaaaccatcctagccatgcatgccacttgctggggtaggccaggggtttctgcagggccttggccttcctgccttggggttggacaggaggtggaagcccaggactcagtgcagtctgtcccctgccatgtgtgaggatgcggcaggcagaggg

SEQ ID NO: 25 - DNA, 135684 bp, Homo sapiens
aacaggaacagattcttctttcctcttaaacaattcaaccatcaaaataaatttattgaaataaaaaaactgttaaaatttaagtaagttaaacttgatggttttgcctcttgtgtaatcactaatacgacatcttcagtccttgtcaggatagaactaatggagtacaacgtgttgtaaggctgtacttttatgaattaatgatctgaggtttgatggtaatgtttctactgtctttgtaggtttgatcttcctttgccactgctgacagagctaagcctgggggtgttctggttgcaacagcctttccttattgttgtttgattttgagaactcccatgttattgatacgtggagggaattgtaaaacttgttgtgaattaaagctaagcctcagattttttgtgtctggatttgaaattaactcagctctcacttgttcacattgctataaatatgcttagcattttttgtgaggaatatctaaagtgccaagaatgaaaagtgggctgccctgatggtacttttcatttcaaaatcaaacatattccttgcttttgtctgtgatgattctgttgtttaaagaacatgttcttacccccgtttttattgtttggggattctttgttgtaagatgactctcagaaattactttttgattgatagtcagttaaaacttctgatcagaatgaagttgtcttcttcaccactttcagttgtaattctggccaaaagcaaaggaactttgatttacttaatttgtgcacttggctaacatgccgtttatattagactgtttggaaatagcccaagtggtggctgtattgctctttgtgaacctgttatgggtatagtaactctcaagtaggaaccaactgtgttaaaatgttaacttccacatggtaatatactatttctttgttttttaagaaaattcaactgaattttaagctaaatgttcttaatgcaagatcaatatcttgattctcatggttttcttttataaattttggtttatttttaataaatgtggacttgcaattgcaattacaactttcagccctttctagtacaaaataatataataataataagcctcaagaggcctatttcctgaggcaaaacaatattggggaacagccagtgggtggagcagccagaaccagcacaacatttattagtcaattttgccatcttatataagcatggtttatataagcatggtttgatattacaatagtaatatcaaagatcacttagtatagatcaccacaatagatataatcatgaaaatatttgaaatattgcgagaatcaccaaatgtgacacaaaaacagcaagagaggagatgctggaaaaatgggcacaatagatttttagatgcagggttgccaaaaactttcagttagtaaaaaacacaatagccttgaagtgccataaaatgaaatataatgaaatgaggtatgcctctccctgtctccaagaaaaatatccaagaaagacctttatatttgaccagagaatctttaaatttgaaatatcttaccttgctattattattattttaaatttaattttatttaatttaattttatttatttgtatttattttttgagacggagtctcgctctttcgcccaggctggagcgcagcggagcgatttaggctcactgcaagctctgcctcccaggttcatgccattctcctgcctcagcctcccgagtagctgggactacaggtgcccgccaccacgtccggctaattttttgtatttttagtagagacggggtttcaccgtgttagccaggatggccttgaaaacctgacctcgtgatccacccgcctcggcctcccaaagtgctgggattataggcgtgagccaccacgactggcccttaccttgctattattttttgggggaaaaaaaaaactgttgaaatcactaatctaaatattattgcttcccttttacaattatctcctgtcttcaatttccttgctgtgtttaacataaataactctacatatgatttctgtaaaaggccacataaacccacagtactgttaatatggtgttttgtttttttgttcatattgttatcattattgctggttccttgtgctatttcccatcctggaggtctacactctcctgagagatggtaaagagagaaagcccagcaacataatgtctggatggctcagtatccttacataggacacccagagggtgccccaactcagcgtacctgattactgggtttatttttgcagagcttggtgcctggtgactagaaaagcagacattagaaatttgcatatctttgtttttgttttgttttgttttttatcagctctggattgaagaaagttggtagaagtagcagcaggtcagagaagttccttttaaggttctggccccagtacttatgtgcagaaatcatttgtgtcatgttcattgtgtcactcattgtgcacccctctcaagtgctttaaaatgtcttctccctagttagaatcaatggatcttgattctgatctctgcctctaattgcatgatggttttcatatcatggtgtcatcattagataatggtgctaggaccaggtctactgcaaagtagagtagaggaagcacagttttgacaaagatcttttcttaatcagatttcgcctgtgtattttggatgctttcactattgatgaaaagagaatattggcaaaatatgttcaaagtgcctcctgttttctttacctttttctctcttgctttcttaaaatctgattctgtccttaagttctggctgaactgtgcattttcaaattttctaactcattgtctttatttctttctgtcctcttttataccatgttctctcgctaataatagcttctcatttcatgcacacactgtttctatacatctgtttcctagtgcttaacacaaagaataatgcagagtaaaccatttatatatgttaactgaattaataaataaatgagtgtgatagtatctatgaaacctagagttcgaaggattatgatgcagcctatatggtgtatgatgaaccatctagcttaacttgttcaaagagagaagtttatgaaaagaattgttatttcatctttctcaactttctggtactcaaacgattatattgtatctattgtttaaaactgtcatttattctaattattaactccagaacacataataaatgtacttattagaaatacaacatcttagggtagaataaagggctcagaagaggtttttggggggtagtatttaatgatttaaatatttagtaagaaagtaattatttatataattatttggctattctagaagcctgtaatctttcgaatttgcccagtcaaccaagcctggggtttaaatgaattttcaacacctttctgctgacagtcacacatgttaaaccttgatttgcttaaaagtattattaaggatgagaatgtaatactgccagtggtatgtggtgatattattgtggcgctggggggatgaaactaacgtctttcagtaagtaaatgtttaattttacacaccatataatcagttgtattattgcaagtgcacagcaggtatgtagaaaaatagaatgcatatatttaacatattagaaataactttattaatattcctatttcatgttctcatgaaattttaatcatttgcattttttagcttcaaacatttttataatatgtttctcttgcaccctttatctagtagctgacaaccatatagtgatccacttatcagttctttttaatgcaaataaagcggacattttttacctattagatcacttggaaagaaaaaaaaactaaaatcaatgtttcatgctacatattatctgtatatgagcagatatacacattttacaggtcaattttattgtattttggtaattgtctttcctttatcttctcttatttagtctttagatttaaaattgaaactgttgttgttgtactgaatgctaatgcagtgcaaaccaagacagtatgttttacatggcctgaatagattctttgtcactcccttaggaaaaatacgttgttcatctcatggaaataaacctttatatatagaaaagtatttaagagaaagtaatttttaccgtttaagtattaaattttacctaaacttctattacgtgaatctcagtagatacgttcaccattataaagaagcagaagttctggccagggcaatcaggcaagagaaagaaataaagggtattcaaataggaagagaggaagtcaaattgtctctgtttgcagatgacatgattgtatatttagaaaaccccatccatcgtctcagcccagaaactccttaagctgataagcaacttcagcaaagtctcaggatccaaaatcaatgtgcaaaaatcacaggcattcctgtacaccaataatagacaaacagaaagtcaaatcatgagtcaactcccattcataattgctacaaagagaataaaatatctaggaatacaacttacacaggatgtgacagtccttttcaagaactacaaaccactgctcaaggaaatgagaggacgcaaacaaatggaaatatatcgcatgctcatggataagaagaattaatatcctgaaaatggccatactgcccaaagtaatttatagattcaatactattcccatcaagctaccactgactttcttcacagaattagaaaaaactactttaaatttcatatggaaccaaaaaagagcccatatagccaagacaatcctaagcaaaaagagcaaagctggaggcattgcactatctaacttcaaactatactacaaggctacagtaaccaaacagcatggtactggtaccaaaacagacatatagaccaatggaacagaacagaggcctcagaaataaagccacacatttacaaccgtctgatctttgacaaacctgacaaaaataggcaatggagaaaggattccctatttaataaatggtgttggtaaaactggctagccatatgcagaaagctgaaactggaccccatccttacaccttatacaaaaattaactcaagatgaattaaagacttaaacgaaaggcctaaacccataaaaaccctagaagaaaacctgggcaatatcattcaggacgtaggtgtgggcaaagatttcatgacaaaaacatctgaagcagttgcaacaaaagccaaaattgacaaataggatctaattaaactaaagagcatctgcacagcaaaatagactatcatcagagtgaacaggcaacctacagactgggacaaaatttttgcaatctatccatctgacaaaagtctagtatccagaatctacaaggaacttaaacaaatttacaagaaaaaacaaccccattgaaaagtgggtgaaggatatgaacagacacttttcaaaagaagatatttatgtggccaaaaaacatatgaaaaaaaaagctcatcatcattggtcattagagaaatgcaaatcaaaccacaatgagatgccatcacacgccagttagaatggcaatcattcaaaagtcaggaaacaacagatgctggagaggatgaggagaaataggaatgcttttacactgttggtgggagtgtaaattagttcaaccgttgtggaagatagtgcagtgattcctcaaggatatagaaccagaaataccttttgacccagcaatcccattactgggtatatacccaaaggcttttaagtcattctactataaagacacatgcacacgtatgtttactgcagcactattcacaatagcaaaaacttggaaccaaccaaaatgcccatcaatgatagactggataaagaaaatgtggcacatatacaccatggaatactatgcagccataaaataggatgagttcatgtcctttgcagggacatggatgaagctggaaaccatcattctcagcaaactaacacaggaacagaaaactaaattcctcatgttctcactcataagtggaagttgaacgataagaacacatggacacagggaggggaacatcacacaccaggggcctgttggggagtcgcgggggctaggggagggatagcattaggagaaatacctaatgtagatgatgggttgatgggtgcagcaaaccataatggcacgtgtatacctatgtaacaaacttgcacgttctgcacatatatcccagaactcaaactataagaaaaaaaagcagaagcaattaatagtgttgcaattaattttcagttttaaaaatgtataagtacctgttatgtgccaggcattgtattacacactaaagatacaaaagaaataagaatttagacatgatctccagatacaaatagcagactaagcaaagtagaaagagaagtcctggatgaaccacaaggttgtttatctgttctctaaataagaagtgtgaagtgttttggaaaagaaagggagaggttgccttccttttcactagtcatcaggttgtcacctagagctgagcagcatttttttttaagaaaattagcacatgtactgggtgaaaacagcctattttctattttaatgagctaggtacatagaaaggaagacgtaaaattttcctaaagtagaatcagtataggctgtaatgttttgcagccagaatctgggacagacttgcctatctgagaataaattgttacatcggcatcataagagtcataagtactgggggtgcagagtacagagcccacttattgagtcacacttgcacatataatgattttcagtctctgatatatgtaatgcataaatggccattaaagtcagatttttcaagggcagttctgtgtcaaatattctttcctgttttcttaaatattgcattaacatattgagagattcccattattttacctttgaaagtatgcctcttataatgtattttgcacccaaaagtatctctaaacagacacatatttaattatatttgattatgaaaatgtaatagctggtttttttttttgtttttgtttttgttttgagatggagttttgctcttgttgcccaggcttgtgtgcagtggcacgatcttggctcactgcaacctccgcctccagggttcaagcaattctcttgcctaagcctccctagtagctgggattacaggcacctgccaccacacccagctaatttttgtatttttagtagagatggagtttcaccatgttggcctggctggtcttggtttaaactattctgttaaaaaaaaattgagggaacttattctggggtaaatgatgttttcaaatacattgttttttgaaaaatttgttctgagagatatattttcttcattgttaaaaaaaattgagggaactttttctagggtaaatgatttcaaatacattgttttttgaaaaatttgttctgagagatatattttcttcattgttgtggaaatatattatgtaagctatattattatgtgtgagaataaagaatgtattttctctgaaaatgtggcagctcattctttgttcacagtgctggttaaagagattaggccacaaatattagccatcacattgttaatgcactcaaactgccagttcatgaccctgagattggagaaattaataagaaaaatataaacataattttaaaaataactgatagaaaatccacttgggaacacataatttttaaaatctaaaatcatttaatgataaaatagtatgtggtcttgccaaatgatctactcttctactgtgaaaaccatagattattacagatttgtaaagttgttgacactttaaaattaattttatttgttaaaggaaacaatttactaacattaaactgtttagcataaaataaaacagcatgcagcatttcattacagcaaacatgaaatatgaattctaaagaaataaaatatgaaagaaatgcattctttttatagcctgaaaagacaatattaatcaaaataaccaaaatactttgaaaatcaatgttgaatgtgaatgtttctggttttctttttcttggacttgtatttacttttgtcaaggtaacataaagctacagtatatatcctctgtaacagtaaaactcagaatgtagattttttttctgagtatagtgcctaccctagtgcttaccctacttatctttataccccatagagtttaaacccgtgactagcagaagtgagtgctcactgatggaaattaaaatgaatatatgcctgaatggatgaataaataaagttaaccatctgctccttcttgttcgttccttcagaactctttattccatattggttagattatcacttttcaacccaggggcatggtggggaaataggaaggtatctggattgacataaatcctgagcccttgtcctggctctgaccctttctagttatcagacattaggcaaatcactgaacttctctgagcctgtgttctcacctgcaagatgaaagggttagaatagcatgatcccaaaagtatgcttctatattataacatagtagcccatgtgtaactttttttttcctcttaatctttacagtttgtcaaatctctgctccatgcttttcttgggtgtaaagagataattaattatttctgtttaaaagatttcctactgtgccacagctggcacaggtgaaagaaattaagtaagaatgcagtagcacaagacatcatcacccactctgcttaattatagaagtcagaacttgaaaatgagatttatgaggataagttgaaatgcagataatatgtttcgggataatgtagagttgatgatgtgttattttggaatcttaaatttccaagttctgcataagtaaaggatgatggtatcataaatccaagtggaaaatggatccttcagtgtctaggccagtgagtttgatgtggacccagtaaacttttaaatttgataattaattacctagagtgtgggtactaagaaaataaataactacaagctagcaagtcttttggttacagctaggtcagctcaaggagctgtgtgaaaataatggtctttaatttttactaggcatttaacaaaaacatacattatatttttgtccacatggtagagaaatatggaccaaagtacattcataaggttgatcaaacctacccaaatagtgttcatataaatctagagagaaggtctcctttaccgtgttatggtggtcttcttttattagcttttccatgattggatgtttatttgcttattatttttcagtgactgaatatgatatttttaaggttctagatgatgatttagtgcttgcatttgtatgaatgtttagtgttatcttgaatggccaggaggatagactataaaccaagtaggtctacattttataagacaggggttttacatttgaagtttaatgttaaaaaataaataaataaactacaagtacagaatcctgagggtcccagcttgacaatatttcaaatggagaatattggtgattgcagtaatctggagcttaattaatagaaggatagattttaggcaaaaacaggtaatattcctactatgtactatattgctcagacttcatgatgagtacttaattatggggaacacgtttaaaagaacaattgtctaactgaaataaattcagcaaaataataagattgttgaaagttctcaaaatcttgttcagtgaaccgtgcttgatttactatccagattattcaaccagtctttattttatggtggccataagcctgtttccctcctgagaatcaagacttcttccactattaatccttgtatttagggtaaagttgactctacagtctgcttcttgggcaggtcaaggggagttcttgaaatagaattaagatcagtaaagatgcactgtacggccataattgctatttatggccagtgtccattctaactggcctgaacccagttagtttatatatgttatgttaaacctgtctcccatatttaagttaatcaatatattatatttgtcatgccacagggattaatactgtggttaatgagaattggctggggacattttctgtcttttccactaaactcagagttatgaagtcacaaagctgggactatcttaacattaaaatggataaatctgtgaggccaacatggggtagaatgtaagacaagttttgaagatggcaaaacaaggttctaaagatgtaatctgagcctctggtcataccaaacctgtagctggtagatctactccagtacatgggttaaagaaagaatgttttgcttaagccaaaacccaaagagcttgaattgacacatcatgtagaaaacatatatatatatatatatataaactgaaagatgtttagcttacaagaggtgagggaaaacaagttatataagcttatcagacttctcctcattatttagagagaatcaaaggctctatctgatgtaggaaggtagaattttcaggtagaccgaattgggatcaatgaaaaaggatgtacatcttcacaatttgagttaccagtaataaaacaagctgtcttctgtgcttaaaaaatattaaaatagagtgtagtttataaagactctcatattgagttgaaagttctactatctgttactcaaatccttagaatgtgttaactaactactgtgccagacattataccaggcactttatataaatttcctgtaaagtcagtaccattatgaactgaagaaaccagggagtaacaatgttgaataacttgcccaaggtaaagaaatctagtaagtatcaatcaatgaacaacaaaccctatgtgtctgacttttctttccactaacattctagcaatacctggattttttatgaattcaaagtaattatacaactcccctgttgtcagtattttagccatgatttacataacagaaaaatgaaacagtttagttcaaaatgaattatttttgatttagggacagtaaggaatttctaaaaatgcactaaaagcactttagtacgtaaattccatcatgactaaaaggtgccatgcctatgtaagtataattgtgctgaggtttatacaattccataagtactaaaaagagaagttttttaaaaagtcataaaaatgcaaaacaaatatgttctgatttctgagaaagcctagaagagcccccaggcaatatgtattcaagggctatgtagccaggtgttcccctctggggttgtattcaacgtgatttcttgagaattaagacagtagtgaggaaacacagaagaaaaaatttctgctgtaaataaaatcctgatagaaaaagcataccagggaattttggttgataattgtttcgctaatttattgcctctcactttatctcgaaaaataaaacattgtttggcccttattcaaataattttcactagtgcaggaattctggtaacctgatcatatatatctatctttattatgagatcttcagttgtttaaagttaccatattttataatattatatatatatatatatagtcaattgaaaaactgatgtagtcgagaacacaccttgcctaatataactgctacattgaattcatttacatcataacaatttctcagttctttaaaacagaagtttaaaagcagattcattatgtggttcattagattgaattctgtggtcagacaaacccaggttttgtttcttttgtgtgtgtgagacggagtctcgctctgtcgcccaggctggagtgcagtggcgcgatctttgctcactgacacctctgcctcccaggttcaagcaattcttctgcctcagcctcctgagtagctgggattacaggtatgtgcgacgacgcccggctaattttgtatttttagtagagacggggtttcatcatgtttgccaggctgatctcgaactcctgacctcaagtgatccaccttcctcggtctcccaaagtgctgggattataggtgtgaaccaccgcgcccagcccaaacccaggttttaattatgaccctcctgtttgctgggtgaactccttaagactctgcatgtctctgttttctaatctggtaatgaggatcctaatgcttaccttcttcagagattattactggtattaaattatattattttaaatgtctctgtctgcctgcaatggtgctgaatcaacagtagctgccttctctgttttccccaaacaaattctccccatgtctctctaagttctctgcactaatttcaaagttaatgaaaaacaactatccatctctttaatactattcagattttaagcctgtgattttgtgtataaactattctcaatcatacaaaacagtgtacttttagagaaagggcaaagttcctattttgtttgttttaaaaaaaaagtaagttagaatgaatgggagttcatttttaagtcaacatctatttcccttttttgtcactctactttctttcagaatctttccatgccacttccagcaggacttacacgtgggtgccctggcttccttagttgcattgcagaatagttattgtaaacagaaaatctttcactgccaaatttgaacttggagtagggggtcttccctaatttgagaaagtcattcaagtgtgtaactatataggaaatgtattactttataagtttggagaggcttggaaatattgctggaacacaacgaaaaaaggaaatgaaatgaaacctcattaactctgtccctaattcttttgtaagcagatagcagttcccttgaaatggaaaactgggaaaaaggccacaaagaaattatatgattattctcctaagatcacataggaatgaagtacaacagttatgagcataagctaagatgatttaggatgctaaattttggctaagcaaacatatacacttttccagcttaggaagagattcacgtatccaacactacatcttctttacattttaatttttacttcatctgaaaaattgtaagttaaaaaaaagttgtagataatatataagaaaatacaaaacaagttcaaacccacacaattatttttcatatattctagttatttctcactgatcattttgttgaaaatacatgggatatatcaatgtcctgactgcatgaaaaagaatttcagtgaacatccctaaaagaaaagacgcatatccatcctttcttccccgtacccagcaaaatgagaacataaacatttagtccctaaaagttttcagttgccagaaaaacaaagaaatatagttacacatccatttttaaccatatatagaacctagctctgatagacttgaaacaaataacactatttttcccaatgatttctaaaagcagcaaaccatgaaatacaatttcattttcctctaatggtaatagaagatatttcatgttgctaccaaacatatactgtatattcttgtctcttcaaagtctattttttattagcttaaaaccctgagctgttaaatgtagcataaaacttctgtgaaattacactgctttgcatcaggggaaaagggtcttttaattggatgattgcagaagaggagagaaaaaggagagagccttcaaaagtttgggtagttcagattttaaaaatctggatgcttcagcaaaattgccaatcctctgagctttgattattattactaatgtagcgcttacagatactgtaaattagatcttgagcacattatgggccaaataccatccttttatactcatgtgtaacctttaacaggtttcaatgggaaatgtgcatggttactcgaaagcagttttcccattatttttctactctaaatctgatacaaaataaggcaattagaagaaacatgttaaaaaattaatagtaacaataactttaattttgtatagacttttccaattacaaagagttttacacaacataacattatagctgtatagtgaaataagtttgtgtatataaaatcatattaaagcatcttcaatatcaaaatttaacatcagtatatctgataaaagatgattgtttagatttatgtttgacagagtagcattttgaaaagaataaaattttgaattcaattctgttaaatggtcaaacacgttaattttaataataggagtaatttatactttatataatctataaacattattcttttataattgtttttagtttatatttttcttgtatgtttgtaaatctgtcttttgttttccctttatttgcttgtttgcatatttctttttcagttttccgaaaaaatttagctatattatgtttttatttttctggttcattgtcttggaaagtattcaccaggatacaggcttccaacaaggcatattctgaggaagcatcctaagtcattttcacaagtggttgaatttctgagaagtaatatcagtcttgagctacttccattatataacctaggataaaccctgtgcattctagttattcaacaggacttggtatttcctaagcctgtatcaagatgcattaactgatttaatagtcagagttctttaattgtttgttattttgttttattcatttacattttttacaaacaagaagaacactatgatcttcagatcttcagaccaaaaaataagcaaaaacaatgttgaatgctattgtgcaaaatgaaagccatcaataaacaatatttgctgtgggtttttgcttgtacctaagttgatgaaacaaaggatatctctacttttgtggaagagagagaacaataatagcaataaacataatgaataaacacattttatagcctgatggaagatgaagatggtaattcctatagataaagaacagggtcacaaagatcaggtttatggaggagagttgcttgtaattagtcctagccctcgtcaaggaggtgagggaatggtcaagaaattagatgggagaggagtgttctagagatggaggggaaaggatgtaaatttgaaaatgtgcctgatgactttcaggaccagctgaagggtaaatagtgaaaatagcagggaaaggtgaggttagagaaagatgggtaggaatacaatatgaaaggtcattgtcaactttaattcttatttaggtgtgaaaactctaacagactctgagtgacacaaagtggcttttaacaagatcattctggtttctcagtttacagcacattgcaggaagctaggggcagagacaatcatttaacgttttatctacttttttgtataaatttagggggtacgagtgcagttttgttacatgggcatattgtgtcacagcggaatctaggcttttaatttaccttcatcagaactgtatacattgtatccataagtaatttctcatctcctaccctcctctcaccttcccacccagtgtttgctatttcatactatatgtccatgtgtgcaatgatttagcttcctcttataagtgattacatgaagtatttcaatttctgtttctgagttatttcacttaagataatggcttccaggccaggcacggcggctcacgcctgtaatcccagcactttgggaggccgaggcgggtgaatcatgaggtcaggagatcgagaccatcctggctaacacggtgaaaccctatctctactaaaaatacaaaaaacaaattatccaggcgtggtggcatgtgcctgtagtcccagctacgccggaggctgaggcaggagaatggcatgaacctgggaggcggagcttgcagtgagacaagatcacggcactacactccagcctgggcgacagagtgagacttcgtctcaaaaaaaaaaaaaaaaaaaaaaaaagataatgccttacagtttcatccatattgctgctgcaaaagacatgatttcatgttttatgactgagtagtattcgtctgtgtgtgtgtgtatttcccattttctttatccagtcatctgttttagacacttaggttgatgccatatctttgctattgtgaagagtcctgctgcaaacgtgaatgcaggtatattttatacaataattttttttagcggggggattagataccccatagtgggatgctggattgaatggtagttctatctctagttatttgataaatctccatactgttttccatagatgttgtattaatttacattcacaccaaatgtgtataagcattcacttttctccacatccttgccaaaatctgttattttctaactttttagtaatagccattctgacttatgtaagatggctatcttgtggttttaattttcatttctcagatggtaagtggtgctgagcaatttttcatatgcttgttgttgcactgagttgcttgtagattctggatgttagtatttttcagttgcatagtttaaagatatgttcacccaatctgtaggttgtctatttactctatgattataacttttgctgtgcagaggctttttagtttaattcagtcatatttgtctagttttgttttggtttcatatgcttttgaggtcctagtcataaattatttacctaggccaatgtccaaaagagtttttcctaggttttcttctagaatatttatagtttcatttgatttttgtttttaattacgtttatgcagtgaatcacatttattgatttgtatatgttgaaccatccttgcattcctggagtaaaacccacttgatcatggtgtattttattttattttatgatgtgctgttggatacagtgttttgttgaggatatttgcatgtatgtttactagaaatactgatctatattatctttttgtgtgtgtgtgtgtgtgtgtccttgtcttgctttgtatcagggtgatattggcttggtataatgtgctggagaggattctttactgctcaattttcaagaacggttttaataggcctggtatcagttctttgtatgtttggtaggactcaagtatgaatccatctgttcctgggctttgtttgtttgtttatatatttgttagtacagatttaacctcactacttactattttggtgcaaaagtaattgtggttttgccattgaaagaaacagcagaaaccacaattacatttgcactaacctaatattctatttgggatttctatttcttccttctacatgcttgaaaagttacatatttctggaaattcattaatttcctctaagttttttagtttatgagtgtagagatattcatagtagtctctgaggatttttagcatttctctagtatcagttgtaatgtcttctttttcatttctgattgtgtctatttgaatcttctctcattgtttctcgcttaatgtagctagtggtctatcagttttgttcatcctttcaaataatttcttgtgttgttgattctttgtaatttttttggtttctttttcatttagtcctgctctgatctttgctatttgtcttctactagctatgaagacactttttagtttaagttccatttgtcttgttttgtttgtgttacatttgctttccaggtctcagtcataaattctttgcctaggccaatgaccagaacagtttttcctagattcttttctagtatttttatagttacaggtcttacatttaagtctttaatccatcttgagttatctttgtatatgtgagatgtaggggtccagttttatccttctagacatggcagtccaatattcccagtaccgtttattgaatagggtgtaattctcccaacatatgtttttgtcgactttgtcaaagagcagttgactgtaggtctatggcttcatttctggattctctgttctagtgatctatattttgatttttatctagtgacaaaaatctatgtgttgattttatttagtggttaacacatggatctatgtgttgatttttataccagtaccatgctattttggttactatacctcatagcatcatttgaagtcaggtaatgtgatgcctctagattttttctttttgcttaggatcgcttcggttattcaggctcctttctggttccatattaattttaggattttttttcctaattctgtgaaacattacattgtaattttaatgggaattgcattgaatcagaagactgctttagtcagtgtggtcattttaacgatactgattcttctgattcatgagcatgggatatttttcccatttgttcatgtcatctaatctgccatcttgaagggaaaaaaaaaacccacaacattttaaatgaataaaatgaaggctgaaataacaatgtgaactcaggcagatactatgtgggttcttaggtttttataaaattgcaaagtaagtaaattaatatccaatgctcctagattttccataaccttttttcttacttctcctgtgcacatttctctttgtcagacttaatcttagcaaaggattcaatacccacacattaagaatatttctttgactttttaatgagttacctgcattttaacctggaggaacccacaggaataaatttcaaatggttaaatgtcaagccttaaaaaccatgaataattatttttggctaggaataaaatttagatccgtggtgaaccccagtaatttctggctcttgggatttttaatgggaataatttattataaatgtttctctccatcagaaaattaaaaaattttaaaaggcacagtatttttgtttgaggcgagttgataagtctactaatttctctaaaaatgtcatcgaattattacacagaaacaagtagttgccaggcaagaatcaaggcattagagataaaatctgatttacataccgcacttctctctcctcaatgtgctcatagtataaattggaggcaataggtaagtaaacaatgggagggtgttggagagagatctatcatagagggaagtatctatgcttatgaccgtttatctaaacatcattctcatctttgattctgtttaatcatcactacgattcaactcaatgcagtttcttttcttatttctaagaatagtactatattctgtctgtcacacaggctctttcacctggaattgtcactaacctctctcttttcctcactttcaactttaaatttggttctagaataattccttggaatttaataaaagcatattcaattaaattgaatataatattaatgtatggccttttttcaaaattttttcttcatatcattttaatgactcctgtatactcataaaagtttaagtttcaaagcattagcttgtaattttttacacatacatacccaaatatgaagataattttaataccttatataaataaataataaaataaataaaatatatttattttcaataaatgtaaatattatcttgatatttattttgcactcacagttattactgatttaataacttgatatgaaacatccttgttttcagaagtgtactgtgagtttggatattgctgctttttattgccacaaaagagtacataagcatttagcagccagagcatgaagcccatagggtgactgtggcaacagagtttctaatataaagtcgatgtaaaagtatgcaggagagaaatagaagaaaaataagaaaaataattaggccagacctcaaaaataatgcttatataaattagatgtgataaagtgataggtaataaaacttcaagggccaaacaaattaagaaatgaatgatgtgaaatggaatcagctcaggggagcaatgacaatggatggaaccaaagaaagaatacatttatgaattacagagaaagaactttagattaatgaagaggagattttatcatatcaacagagcaattgagatgagtggtccataaagctttatgactttagcatgaattctggtggaaagaaatattatagtagatcatgttaatctaattttactatccttaaatgtaatggcttttaaaattgttagctgaacaattcaaggtggcaatttgctacatcaatataagcagtctcttgtgaccttttaggaatactgagctactgattagttaagtgacagtgatcctttttcaaaacaaatgctatatagagattttactaatttccctacttaattaagaaatgatatttatttcccctaaggacaaaaattttcaatggtactgacgatcatatattagatggtaaagtggattactgaaagttagtgccactctaattaaaaatttgattcatcccacccaagacagaaatggggactgaattttatatcccattgaataaattaattccacacacaagttttaagttcctaaagtctttaacttcagctgtggctctaaaaaaatcaacatgactctaatttataaaatataataacgttaaaattttcatatgattgtgaggatagagttaggtaataaactaaataactacattgtttaaaaatttacaaatgcataggagatctgtaaacattaaaatatgattgaatttttcaatagataattgttctgatgtttgaaatgttctggaagtgttcatatagaggagtatgctgtccaatatggtatttaccagctattgatggctactgagcacttcaaatgtagctcatttgatgaggaaattaattttttaattgtatttactttcaattaatttaaatttaaatactcatatggggctagaagctccaatattgggcaatgaaagtctagaactcacatcttaaatttgatttgattgttgaatacatcaagtttgtaattaatgtagctgctgggaggtattgctacaatcagacaatcagaggactcaaagtttgcaatagagatttaaggtaaactgtgagcaagacacttttagtgatgaatttctaattaatttattaatttcagtactgagttcgctctataattaagtcttaatatgcatattacttaaagttaattataaatactaattcttggttttatcaatcacaaatgggtgtagggggtagaaaatgtgaataaaaatattggagagttaatttatatactagtcttacactgagaggtgaatagtttatgtttggtacagattagctacatttagtcaaagcaaatattgtagaaaaataaacatagtgcctcttttgaatatgtaagtatttttagtgacaatttgattattcaaattgattatttgaaaatttgattatttgacaatttggattttagaaatctgtagacctgaagcttcccttgaaccaggattaattaaagacaatattgccaattaacaccagacagtataactggtgttcttgctgtgcttttatgtatgtgctctaggcagagcttttactagcttacacatctctacgcagatttttaagcctttcaagaattttgccacttctgagctgagctcagagccaaaggagagctgaattttagcactttggtggaagcagctttcatgcccctcaggcttatacttaaatctgtctttactctaggaaacttcatagagctctcttggcctctgtgcccctttagtttctaaactacaagggaacccagccctttcatccttaaaaaagacacttttaggactttacttatcatttatttatttatttttttagaggcagagtctcactctgtcacccaggctggagtgcagtggtgtgatcttggctcactgcaacctccacctcctgggttcaagcgattctcctgcctcagccacacgagtagctgggactacaggcacctccattaataactactaggactttaagccttttcccctagaacaaaatcctctggtgttttatttttccttgacttagattaatctcaattttacagtttactactcaaagtgttggccttggactagcagcatagcttcactctggagcttgttaggagtgcagaatatgaggccccacaccagacgtactcaacgagaatcaacatcttatgatccccaggtgtttcataggtacataaaagtttaagtactgtatgtagcacacttcttcttgtttgctccataagaatacaaaggtattttattaatggaatttgtttttatagtacttccttaaatgagccaaacttcatgatcatcaaccagtatatgccccgtttttccattccagatcattctttacattttatttattaacttttttaaaaaaattaagacaagtacaagaaagagccagacattcattcttcccttgtcttaatgtaaagtataagtgtgcatattcattgtctcatctgtcctgcactcctctcactttagcagcaactctgtagaggacaaggatcatttgtttctataggtaggtatttggtacctcttagaatattatctacctgtcctagaaaccatatagtccattccagttttaaatttttttttgagacagatattcgctcttgtttcccaggctgtagtgcaatggcgcgatcttggctcacttcaacctccaccttccaggttcaagcaattctcctgcctcagtcccccgagtagctgggattacaggcatgtgccaccacacctggctaattttgtatttttagtagagatgggtttctccatgcttgtcaggctggtcttgaactcctgacctcagttgatccgcctgcttcagcctcccaaagtgttgggaatacaggcatgagcccccacacctggccttaaaatgttttctttaaaaacttaaattttcagctgggcacggtggctcatacctgtaatccaagcactttgggaggccgacatgggcagatcacctgaggttaggagttcgagaccagcctgaccaacatggtgaatccctgtctctacaaaaacacaaaaattagctggatgtgttagggtgcgcttacaatcccagctactcaggaggctgaggcaggagaatcgcttgaatccgggaggcagaggttgcagtgagccgagactatggcactgtactccagcctgggcaacaagagggaaactccatctcaaacaaaacaaaacaaaaacttgattttccttattatctaaaaacacagtaagtttttcatgaaaatctcagtgctaagcattgtgagattcactagctattctcatgcagatcttaatgtagggactaatgtctatcagatgcattcctaatctgattttgttaatagtttttttattgacagtaattcatcagagataagtactagtttccttttacatgtaaaatattcagtataattgtattgattgaattatagcatcaactattttaacaataaattattcctactctacacatccactgagtacacattatgagtaacattatggtaactgctgaaatatagaagtaaaaattagagttcttattttgtagtagcacaaagacactgaaaagcaagatagagctttcttagaaaaatattagcgttaaaaatgtgaccattacttgtcgtgaacctgggaggcggagcttgcagtgagtcgacatcgtgccactgcactccagtccggacgacagagcaagactccatctcaaaaaaaaaaaaaaaaaaagcagccattactaaacaaaaaatatgaaaaaaaagtactaacaggtagcacactttgctagattcaaaataaattttatagtatctgattctaaacagcatgttatagatgaattcttaaagagaatagttatataaaaaattctaatttattttggaaaattaaatttctgtcaaaacctgtaatatttatgaacagacatacttttcttttagcacgtcaacagagttgttaggttgtcttaatccttcactggctacctgcactttcccttcaattcgtcaggcacctttgaggctgtccttatatcttcatcaattgtcttcaacaaaatggatgagactatgaatagaagctcattgtcatgaaagtgatatgagaaataaatttgctgagtaaaagattataaattcacattaattgattgttcaattttcttgaaaactgatgattattctgattttaatatgtttggcagattttaaattatatacttgtttttcaaaatagagcttggtaagagtgatataccttatcatatctttaaaagaattattttttattttaagtaattagtgtcctaatctagccatatatacaagaattcagataaaaagtttactggttgaattaatctacactatcatagaactgtgaaaacatgcaataaagttagtttttttctttttttttttcaagaaatgctttagcaaaccaaaacttgttttgcgatagccatctctcctatatatctctaataaaagagcactttttcacatatttttaagtagctattccattataaacaccttccctcaatttgaaatcaattaatattttaaatactggagaaaaggcaaatctaatatatatcttctaaaatattttttacatagtagcaaaacctctgattatggctttaattttaaaccactcccatttgcctaacgctgtcctgattccaggattgaaatttccacattctaggaaactcctcagttgcagggatacttggatgattggtcaccatcatgtaccattttattgccttaatattttaatattcaaagtgtaaaaatgtgtcttatacaggaattcagagctccttgggatgtctatagtgataactttaacattatttgctaatgccttctgttattttaaaacccattaattaagcacctatttttaaagcattttttatgttaaaaatttcaatagatcatgctctatgtccttaaggaactcatagcttaaccaaagagcaaggcatacaaaataataaattataaatatgaggttggaattgttaaaagaaagcaaatttcttctaaacacagaagacttagacacttactttacctaggagaaattaaggaagtcctccattagtcctaattaaagaagttgtggtattttaggagaaacaggagttaaccaaaagagaggaaaggaggaaaggatttccaggcttggtggtatgaaaatgaaggctgtactcagtgtttggtgagaaatttaaagccattataatataggatggatgatgtggacataatcatttggaagagcattgatgaccagaattgagcaataggatttaccctataggagtggtttgaaaaaaataaaaataaaaaaaaaaagtaaatgctcaggacttaatcagaatcacctgggaagattttacaattacagactgctgcaccacttccagcccaatcccccagagaacctgctgagcagatctgaggtgccaattacttcagttcatatatttgtaatgatcttcataggattacgatgtctgtggagatttagaacctccagatttcccatagagagccaatagtggtaattaagcatttgatttacatgattttatttgatttaaaaaataattctagaacatttttgtagagacagtaggccactaagatttctttgaatgatgcagttgagagataaggaactgtactgaggctttgtcaagggaggagaaggtagtgctaaatacaatgagaattttcaaaagttgagtacaatctattttttcagagtgtggctgccatttggtatccttgggggactggttttaggacctcttttcatacaccaaaatttacagatgcttgagtccctgatataaaatggtgtggcacttgcatataacctatgcatatactcctgtatactttaaatcatctctagctcacttataatacttaatacaatgttggtgtcatgtgaatagttgtcataatgtattatttagggaataatgacaagaaaaagtctgtacatgttcagtacaaacacaattaaaaaaatattttccatctatgaattcatggatatggaggaccaactccatatgttttacgaatatttgttatactagtttctgatacagttgatatagtttgaatagagtacaaatactgcacgttgaatatcagtatataataggacaaataatgagactatttttctcatgttttccactgtatctgtttatttcttttttcattattggattgattcatccacatagtaagtaatttttaactgcccaccatgtgccgaacagtgctaactagatgaagtattcatttattgttttttggaaaggattgaaagcaactttaattaaaatacaaattattgtatttagtattcatttataataaaaatggtatattttcaaaaggaccatacatttcatacaggtattgacattaaagtgttctacttaccttttctttgcgaagaatttagaggggcatttataatataaattgttaccacttttctgaaggacaacttacctgtgtaacaaaaacacttaaagtgtgcaacacatagtggatatttatttctgcaggtagttaggtataacagttgctgaagtagtattcttaccacgtgtatgctgtattgttggactgccatgataaaacaaatactatgtcatttgtgcatatcttttttttttaacaaaacaaatttatacagggattttaggaccacaaaacaattgctggtgtgtcatgaagaaaatatattgtggaaataatatgttccatctgtggttttcttttttaaatgtaccaccttaatacagaactgcatctctaaatcaaataaccttaagcaataaatagagacttgctttcaagtattggcaaataaatgccttttttttttttacaagaacaattttttcctagttgttcatgtgaatttaggataaaaacatgcagcaacaataaatcccttgtggtattaattcttaaggtttatcacaaatagtattagagataacaaaatatagtcaacacaagcttccagtttttcctgtttatggcttaataataatttggacataaagatgcctactttatcagcatgttattggcccatattttatatttggggaatgataagaattttttcataaataatagaagataatatttttatgttatcatgtctgtcatgtactttactatattattgctgaagacaaaacactttcttgaagaagttttatttaatctatacaggatattatatttcagtcttcttaggttttccaaagtaaaatgaaacaatttttacatttctacaaggatatatgagcttttaacttcgtaaaagagaagggtatactacacatgatgttcatctgttcagcagcaaaaaggtcaagaagctaaacaaatatgccctcaagtctgaaagtgaaaaatagatcttgtaagcaagagagacactaaggtattacattagagataggtagcattttggaaccttagctgcaacacactatttgtaaaatgtatttcccatacgtcctgatggtaattgttatgcattttagttacacagatagtgttttgatatgtacagaaaaaaaatgtttatcatttaaaagataccttattccataatatatataaagaaagttgttattatagtcattaccaggtacaaatcagcaaaaaacacttatgtcaatagagtttcaagaagtactttaatatgaaatgttttaacattattctgatttttaaaaattgatacatttgttgagtggtatttaaattttgtgatattatttaattgtagaggcaatgagttatagagatgtcgaaaacaaactctttaagaattgtgaatatacaactatgatttcttaaagtttgagactttataaaagcagtggttccaaaaaaagtgcataaatacacatttacacgtatgtttacacataacttggtgggaatcacagatgagttgtaatttacccatgacatcaataaatacattgtatcttatccatgacaccaatttggaacctagaatagaaacttctataaaagtatagaagatttgttttacttccttatatacaagtagagtattgatcctaattttgatttattaaagaggataactttgtggtttaagattatattttgatggtgaataatcatcaatattaataaaataaatgaaaatatgaatcttgactttaaaatttctgtacttctcataaaacttctgagtatgtatgaaaaaatgtttggtttttcatgataaaagttttgtgaatatcaagtttgaaatatattacagacatttgctactttgtctcctcaccttggttctgtgaaagaatcatctggaaaataacttggaaagtttaccttcctagtataaggaggggaatagtgaaatacgacaattagaaaacttgtgttttattgctattctgggcactaactattattattattgttacgtttttgtctgataacaacctacattttttccagatctccatctatgcattcacaaggcacacatgtctttcaagattatcctaaatataacttttatctgaactccctctgttttatatttcactttcattcttcaagagaccaatttcctgcatgaacttgtcctagatgaagctcattttcataaatgttattttcttttgtaattagactgtatacgggcatctaatcactagcaaaactgcagcacttgaaaaccaagattatactgtagcatttgactagctttagaaaatatagtagatttttattggataatgaataacttactggttgagagagaaaattgtctgtatgttaacaaaaaagaagtataaaacgaagaaacgtttcactaagtcactcagtataccagagacaataaataaagtgaaacgactcaaattctataaaaggaaattcctcttccctcacaaaaaatgactactattttttcaaacattcattagaagtggatagtacgttctacttgtaagtacagaattattttaaaaattataattagcaagtctgctagtcattcatagcatactgcatttgaacagtgtttgaaaagcagaaatggtttggtccaaaatatattgtagttaatatacatgtgaattacattagttttattaaaacaacaatgaattaacatttgcaaatcgatctttggtttattttagcatccaaatatgtgttgtattttctatccactttgcattaaacaattgtacatatttaataatgtataaagagataaaatgtaaacatattttccccaatgttaaacagtcatgcattagattgtgcatggacatttttactcaatagtctattgggtaaaatgcttggtaattatttccttagctatatgcagactttataaaagtgtaaatttccctcttatactatgtttttaacactttaaaagaaacatatatctatgttcttcaaatattatttctctaatctttggaaatataatttttttacttttatttctggtttggagtgtaagtgcaggtttgttacataggtaaacttgtgtcatgggggactgttgtacagattatttcatcaccccggtattaagcctagtaatcattagttacttttcctgatcctctcccttctcccacccaccgcattctgataggccctagtgtatgttgttcccctgtatgtgtttgtgtgttcttatcatttagttcccacttgtaagtgtgaacatgcagtatttgattttctgttcctatattagtttgctaaggataattgcctccagcttatccatgttcttgcaaaagacacggtctcattctttttttatggctgcatagtattctatggtatatctgaactacatttttttaaatccagtctatcattgatgggtgtttgtgttgattctatgtctttgctattataagtagtgctgctatgaatatgtgtacatgagtctttaaaatagaatgatttatattcctttgcatatgtattagtctatcttcatgttgctataaagaacttccccagactgggtaatataaaggaaacagattcaattgactcacagtccagcatggctgaagagtccccatgaaacttacaatcatggccgaagttgaaggggaagcaaggcacctcttcgcaaggtggcaggaaggagtagtgctgagcgaagggggaagagtcccttattaaaccatcagatctcatgagaacttactcagaataatgagaacagcaagggggaaaccgcccccattattcagttatcttcacttggtctctcccttgacacatggggattatgtcctattagccttattctaatgcctaacagcatagattagttctaccatttttgttgtttcaaaacatctagatgtctatgctgttagacattagaatagggcttacttggggcaagtataatgactggaaggcacaaagagcctcaaggatggtcaaatgttctggtttttcatctgggtgctggctatgctagtgtacttattttgtgaaaatactattagctttacaatatgaattttaaaattgtactttggggattatgggaattgcaattcaagatgaggttttgggtgagaacacaaagcctaaccatatcagggtagtacccagaaatgggattgctgggccaaatgttatttctgcttttagatttttgagggatcaacccactactcttttccataacagtggaactaatttacactcccacctacaatgtataagtgttcctttactgcatagcgtggccagcatctgttatttctgactttttaatagtagccattctgtctggtgtgagatggtatctcattctggttttgatttgcatttctctaatgatcagtgatgttcagcgttttttcatatgattgttggccacatgtatgtcttcttatgaaacgtatctgtttatgtcctttgcccaatttttaatggggttatttgtttttatttttggtaactttgtttaagtttcttatagatgctggatattagacctttatcagatgcatactttgcaaatattttctcccattctataacttatttgctcactctcttaatagttttctttgcgatgcgtaaactctttagtgtaattagatcccatttgtcaattttagcttttgttgcaactgcttttggtgtctttgtcgtgaaatttttcctgtgcctatgtcctaaatggtattgcctaagctgtctttaagagtgtttatagtgttgtgttttacatttaagactttaatacataatgagttaatttttatacatggtataaggaagggttccagtttcaatattctgcatatggctagccagttatcccaatttattattttgaagctagaaaacgatcattgtctctgtaattttagagaaaccgacactgtttttaaattatactttaagatttagggtatatgtgcacaacttaaaggttagttacatatgtatacacgtgccatgttggtgtgctgaacccattaactcgtcatttaacattaggtatatctcctaatgctatgcctccccccagcccccaccccacaacaggccctcgtgtgtgatgttccccttcctgtgtccatgtgttctcattattcaattcccacctatgagtgagaacatgtggtgtttggttttttgtccttgtgatagtttgctgagaatgctggtttccagcttcatccatgtccctacaaaggatatgaactcgtcattttttatagctgcatagtattccatggtgtatatgtgccacattttcttaatccagtctatcattgttggacatttgggttggttccaagttttgctgttgtgaatagtgccgcaataaacatagctgtgtgtgtgtgtctttatagcagcatgatttataatcctttgggtatatacccagtaatgggatggctgggtcaaatggtaattctagttcttagatccctgaagaatcgccacactgacttccacaatggttgaactagttaacagtcccaccaacagtgtaaaagtgttcctatttctccacatcctctccagcacctgttgtttcctgacattttaatgatcaccattctaactggtgtgagatggtatctcattgtggttttgatttgcatttctctgaccagtgatgatgagcattttttcatgtgtcttttggcggaataaatgtcttcttttgagaagtgtctgttcatatccttcgcccacgtggtgatggggttgtttgtttttttcttgtaaatttttttgagttcattgtagattctggatattagccctttgtcagatgagtagattgcaaaaattttctcccattctgtaggttgcctgttcactctgatggtagtttcttttgctgtgcagaagccctttagtttaattagatcccatttgtcaattttggcttttgttgccattgcttttggtgttctagacatgaagtccttgcccatgtctgtgtcctgaatggtattgcataggttttcgtctagggtttttatggttttaggtctaacgtttaagtctttaatcgatcttgaattaatttttgtataagatgtaaggaagggatccattttgagctttctacatatggctagccagttttcccagcatcatttataaatagggaatcctttcctctttcttgtttttgtcaaagatcagatagttgtagatatgtggcattatttctgaggactctcttctgtaccattggtgtttatctctgttttggtaccagtaccatgctgttttggttactgtacccttgtagtatagtttgaagtcaggtagcgtgatgcctccagctttgttcttttggcttaggattgacatggcaattcaggctcttttttggttccatgtgagctttaaagtagtttttttccagttctgtgaagaaagtcattggtagcttaatggggatggcattgaaactataaattaccttgggcagtatggccattttcacaatattgattcttcctacccatgagcatggaatgttcttccatttgtttgtatcctcttttatttcattgagcactggtttgtagttctccttgaagaggtccttcacatcccttgtaagttggtttcctaggtattttattctctttgaagcaattgtgagtgggagttcactcatgatttggctctctgtttgtctgttattggtgtataagaatgattgttatttttgcacattgattttgtatcctgagactttgatgaggttgcctatcagcttaaggatatattgggctgagacgatgggattttctagatatacaatcatgtcatctgcaaacagggacaatttgacttcctcttttcctaattgaatgccctttatttccttctcctacctgattgccctggccagaacttccaacactatgttgaataggagtggtgagagagggcatccctgtcttgtaccagttttcaaagggaatgcttccagtttttgcccactcagtatgatattggctgtgggtttgtcatagatagctcttattattttgagatatgtcccatcaataccgaatttatggagagtttttagcatgaagggttgttgaattttgtcaaaggcctttctgcatctattgagataatcatgtggtttttgtcgttggttctgcttatatgctggattacatttactgatttgtgtatattgaaccagccttgcatcccagggatgaagcccactggatcatggtggataagctttttgatgtgctgctggatttggtttgccagtattttattgaggatttttgcattgatgttcatgagggatattggtctaaaattctcttttattgttgtgtctgtgccagactttggtatcaggatgatgctggcctcataaaatgagttagggaagattccctctttttctattgattgtaatactttcagaaggaatggtaccagttcctccttgtacctctggtagaattcagctgtgaatccctctggtcctggactttttttggttagtaagctattaattattgcctcaatttcagatcctgttattggcccattcagagattcaacttcttcctggtttagtcttggaagagtgtatgtgttgaggaatttatccattttttctagattttctagtttatttgtgtagaggtgtttatactattctctgatggtggtttgtatttctttgggatcagtggtgatatcccctttatcattttttattgcatctatttgattcttctctcatttcttctttattagtcttggtagctgtctatcaattttgtttatcatttcaaaaaaccagctcctggattcattgatttttttaaagggttttttgtgtctctatttccttcagttctgctctgatcttagttatttcttgccttctgctaacttttgaatgtgtttgccttgcttctctagttcttttaattgtgatgttagggtgtcaattttagatctttcctgctttctctagtgggcatttagtgctataagtttccctctacacactgctttgaatgtgtcccagagattctggtatgttgtgtctttgttctcattggtttcaaagaacatctttatttctgccttcattttgttatgtacccagtagtcattcaggagcaggttgttcaatttccatgtagttgagcggttttgagtgagtttcttaatcctgagttctagtttgattgcactgtggtctgagagacagtttgttataatttctgttctgttacatttgctgaggagtgctttacttccaagtatgtggtcaattttggaataggtgtggtgtggtgctgagaagaatgtatattctgttgatttggggtggagagttctgtagatgtgtattaggtccgcttggtgcagagctgagttcaattcgatgtccttgttaactttctgtctcattgatctgtctaatgttgacagtggggtgttaaagtcttccgttattattgtgtgggagtgtaagtctctttgtaggtccaaggacttgctttatgaatctgggtgctcctgtattgggtgcatatgtatttaggatagttagctcttcttgttgaattgatctctttaccattatataatggccttctttgtctcttttgatctttgttggtttaaagtctgttttatcagagactaggactgcaacccttgcctttttttgttttccatttgcttggtagatcttcctccatccctttattttgagcctgtgtgtatctctgcacgtgagataggtttcctgaatacagcacactgatgggtcttgactctttatccaatttgccagactgtgtgttttaattggagcatttatcccatttacatttaaaattcatattgttatgtgtgaatttgatcctgtcattatgatgttagctggttattttgctcattagttgatgcagtttcttcctagcctcaatggtctttacaatttggcatgtttttgcagtggctggtaccagttgtccctttctatgtttagtgcttccttcaggagctcttttagggcaggcctggtgttgacaaaatctctcagcatttgcttgtctgtaaaggattttatttcttcttcacttatgaggcttagtttggctggatatgaaattctgggttgaaaattcttttctttaagaatgttgaatattggcccccactctcttctggcttgtagagtttctgcggagagatcagctgttattctgatggacttccctttgtgggtaactcgacctttctctctggctacccttaacattttttccttcattttaattttggtgaatctgacaattatgtgtcttggagttgctcttctcaaggattatctttgtggtgttctctgtatttcctaaatttgaatgttggtctgccttgctagattggggaagttctcctggataatatcctgcagagtgttttccaacttggttccattctcccagtcactttcaggtacaccaatcagacgtagatttggtcttttcacatagtcccatatttcttggaggctttgttcatttctttttattctttttttctctaaacttctcttttagcttcatttcattcatttcatctttcatcactgataccctttcttccagttgatcgcgtcggctactgaggcttgtacattcatcatgtagttctcatgccatggttttcagcttcatcaggtcctttaaggacttctctgcattggttattctagttagccatttgtttaagttttttttaaggtttttaacttctttaccgtgggttcgaacttcctcctttagtgcagagtagtttgatcgtctgaagctttcttctctcaactcgtcaaagtcattctccatccagctttgttccattgctgttgaggagctgtgttcctttgaaggaggagaggcgctctgatttttagagtttccagtttttctgctgttttttcctcatctttgtggttttatctacctttggtctttgatcatggtgacatacagatgggattttggtgtggaagtcctttctgtttgttagtgttccttctaacagtcaggaccctcagctgcaggtctgttggagtttgctggaggtccactccagaccctgtttacctgagtatcagcaatggaggctgcagaacagcggctattggtgaacagcaaatgttgctgcctgattgttcctctggaagttttgtctcagaggagtacctggccgtgtgaggtgtcagtctgcccctactggggaatgccacccagttaggctactcaggggtcagggacccacttgaggaggcagtctgtctgttctcagatctccaactgcatgctgggagaaccgctactctcttcaaagctgtcatacgggtacatttaagtctgcagagttttctgctgccttttgtatggctatgccctgcccccagaggtggagtctacagaggcaggccggcctccttgagctttggtgggctccacccagttcaagcttcctggccactttgtttacctactcaagcctgggcaattgtgggagcccctccctcagccttgctgctgccttgcagtttgatctcagactgctgtgctagcaatgagtgaggctccgtgggtgtaggaccctctgagccaggtgcgggatataatctcgtggtgtgccgcttgctaagacagttggaaaagcacagtattacgatgggagtgacccaattttccaggtgccatcgtcacccctttctttgactaggaaagggaattccctgaccccttgcgcttccctggtgaggcaatgactcaccctgcttcggctcatgtttggtgcactgcaccctctgtcctgcacccactgtccgacaatccccagtgagatgaacccagtacctcagttggaaatgcagaaatcacccatcctctgtgtcgctcatgctgggagctgtagactggtgctgttcctattcagccatctctccacccccccagaaactgacacttaacttttaggctcatttaatgtaaaaatgaactgctctgaactggttgtcaattcaaatatggttttaatatgaaattacaaaaacataagaatatttctaagaagaaactcactatgtaatagtccaaaatctaaaaacaactcaagtatacatcagcaggaggataaatatataaattatataataaccacttagtgaaatactgcaaatcaatgaaaatgaatcaccactatacaaaagatggatgaatctcacaaacgtcatgctgaatgaaagaagccagaaacaaagcgatgcttattttttgatttcattcaaaacatcagaaatggcagaactaatctatgctgttagacgttagaatagggcttacttgggggaagaataatggactggaaggagacacaacggaggctctaggacgctgaaatattctgctgtttgttctgtgcacttgctatgctgttgtaattattttgtgaaaataccattaaactttacatatgaattttgttcttttttgcatgtgcattatacctcaataaaaaagttgttttaaaactggaatatatcaccattttctaccatgcatcatttaaacataattttcatgaaatgcaatagtgttatataatcactatgtagtaatcttaatgcatattggtttaaatttgcatattttaagttttgaaaggataactgtcaggaaattgaagtatatactatcagtgatgtttgtaagttttttatcatttttgttagtgaagaactaacatgtttatgctgataattgaatatactgttttatattacaatgtgaaatctactttcagaaaacttgatatggaatgaatgtttcctttaaagcttttcagaattaaaatattgctttattgttgtaatcttttaaaaagatgcaaaacaattaacatcagatttttcataaagatacaaattcaagtgaatagtactaataccatatttaattagaaatcaataaaaaaatcactttattctttataaatactttagaatacttatttctattctgccattttctttgttttattttctgttataaaagccaaccaaaaatgacaaaaatataccaggaaagataaactgcgacgtaactggggagtagatacattatacacatactactttggcaatataaaaggaggaaataatctgttattacagatagctccatgaatattcaccagtgaagcacataatgatcatttccacagtagcaatacagagactgcgacattgaaattattcagtcctcctgtaaactagttcaaccattgtggaagtcagtgaggcaattcctcagggatctagaactagaaataccatttgacccagcaatctgattactgggtatatacccaaaggattataaatcatgctgctataaagacacatgcacacgtatgtttattgcggcactattcacaatagcaaagacttggaaccaacccatatgtccaacaatgatagactggattaagaaaatgtggcacatatacaccatggaatactatgcagccataaaaaaggataagttcgtgtcctttgtagggacatggatgaagctggaaaccatcattctcagcaaactatcacaaggacaaaaaaccaaacaccacatgttctcactcacaggtgggaattgaacaatgacaacacatggacacaggaaggggaacatcacactctggggactgttgtgtgttgggaggagtggggagggatagcattaggagaaatagctaatgttaaatgacgagttaatgggttcagcacaccagcatggcacatgtatacatatgtaactaacctgcacattgtgcacatgtaccctaaaacttaaagtataattaaaaaaaaaaaagaaattattcggtcctctaaagtgagggtctgctgatttttccatggatgtgtaagaaatcgtcaccatttctgaaattaagttttgtttgttaagaagaaacagcctaactttttagatagttttaaaaattatcttccaaaacactgctgcatggacaaaccatagagcactaaatcttgtagatagatcggtccatgccatgctgttgcatgaggttatatttttctagttacattcactgcatcatagcctggagaacaaaaacacagcatgacaacatatgccatgtctctaaaccatgcatctttaagagtctgatattcagcctttcattcatttaccttccttgttagcctttcatttaacactgattaaaatacttcaaatgattaattattgcacatttttgcctgatttatcacagctcagcaataagatcctttgttgtagcttcatcatattaatgtggaagctgttaatgtgagataatattacaaactcttctgtttctgacctgcttttcttagttcctatcttctttacctgagatccatcacttaaaacagcctttccccaaaggtaagcagccctctttaagagtcttgccacattttaacatatgaattaatctaagcaagggtccagaataaaataacacgtggtgtctttgctcaactaggttagttttccacaccttcctgtaacattatcagcagaagtcattcacacataaagcaacgacctcaaaattaaaaagttactttggataaaattcattttattgtgtaatctgggtattccttctctgtctctcctttcacccccaccatgggactttaaaaaagtaagttgtaatgctgagatttctgtgtcaaggttaaagagtgaagagaatcatttcagagattagaggtgtcactcatgtcaagaaacattataagagatctctggaggcatgtaccaacatattaaattactacatggaaaaataaattgaaaaagaaaagccctgaagtaatgaaagctgactacattttcaaagcaactactattttaagaagagtatatttcctttatccacaaacaaatacaaggcaaaaactgggtgtgtaacaatatatgatcttctttatgatatttacatgttggttgtgtcacccaaactagatcaaatgatttttaaaataacatttatattggtaaactctttcaaaataaatgtagaaattttctgtggctggcttctaggtgtggaattagggaagcaacatgtattaacttgaaattcctacccaggcattcacttgaaaggtacccaaagttatatttgatagtaacatagttttaaaagcttctgctttctgttttaactgatttgcttctacaccactccatggacatcattaagcctttttatttagaattatgacattgcttttatttcattaatttcactagcacaggttcaaagggacaagagttagttttagatgtaatatataatgtaattaaaaagttcccatcatttgtgtgtttttgtagtcactacttactaatgtaagtagtctgcacattccaattctgtttactacagaattaaagttgcaacatcaacagttgtctgagactgtatgttttatcttgaacaaggaaaataaggttttaatagttctgattgttattaaaagcctttatgaagtaacatttataaaacacttctaatggtggagattaattttgcccctcaggtattttggtccaagtaaataagaagcgactgatggtcccactaaacaaaataactacaaggaaaatgcaggaatttcttttcttcttgttaatgaatattttgaagatggttaatttacggttatgtagacattctgcaatcagctaagatgttaagtcacatgttttatatctatgaaagctactattttgtagtggtgacaatttgttgtgtgaatcagtatgtacaatgaagagtgacccattacatacaatagaaagtggtggtagttcaccatagaaattatctgttgctataataaatttcacatattctttgatttttaatgatttctaaacaaggcatataaatatgctatatacatcatattaccaaagacatcctttcaagtataactgctgaaaaagagtctattgaatgagttagtaaataaatgattatttatttgcaagccttttggtaaaatagcgttatttacacaatgaatttcattgttttggcattgtaactgtgtcttattctgttttgtgctgctaaaagagaacatctgagactgggtaatttatagagaacagttctggaagctgggaagtccgagattgagagaccacacctggtgagggtgttcttgcagcatcatatcatggcagaaggcataacatgagttaaggagcaataactaactcattcccatgataatggcattaatccattcataagggcagagtcctcataacctaatcacttcttaaaagttccactctcaactgttgcactggggactaagttcaacacatgaactttaggagacacatttaaaacatggaagattatatcccaaccagctctcctttaaaacccccaaatctgatacttacctgattgataagagtatttaaaataataaaatgagacaacatctttaaaacatctttctagtattatgaacttggagataaaccaatatagtccaagttgattatagctcatattccagtatcaacatgttcccagcactaaagcaattattttctacagttaaagagaagttttatttcataagagaaatccaaagagtaatacccctatcttagttgttgagggatcctgtaaagaactgtgaatctgatgttttatcttacttgctataatagcttacaggttagcctgccagttctatggatgctggcagaacttcttgggacaaagagaaaatattttatttttcacaggaatcatagccagtgtgtcagcattttcttgtgtttgtgcccaagttccaattcccacagggtagcacaaagagagctagatgctacctgtacacagttgggttgcaataacaaaaaaagagaaacctgatcctaggtacaaaaaatcatttataatgggtagtaagcatgtctggacttagtttactggacagtaaccatgcctgacctttgctctagtgagaatcactatctatatcttcagtgttttttgctatacagatttgagatcctttatccaaaagacagagccatcaagagttgtctgagagtgtgcatttaattttgaacacggaaaataaggttttaatgttgcagattcttatggagatatttacaagcctttttgtgaagtaatatttatacaacacttctcaatgatgaggattaattgaaaaatctgaacgatttcagatttttgcatttttttggatgttagaatgtttgcattatacttaccagttgaggatctcaaatctgaaaatccaaaatccaaaatgcttcagtgctaatattctttggatgccatgttggtgctcaaaatgtttcaaattttacagcatttcagatttgggtttttggattcaggttgctcaacctgtataagcatctttgaaaacttaatccagaccaaaagggctaccagtgctttgtttccaagactaaggaaacttgagaaaccaacagagaattgtctctcaacagaaccagatacaggtgcaatagaaaaaccaccagtctattttattatccttataaattcccactaactacagctgtttagaccaattgcttcagcaacaggaactgaaaatggaaacttatttacagagtaaaaagtagagggctggaattgtgtgcatccagtaatataattttcatataatttttatttagaaagatttaagtcatttcatgatatttagaagtagatatgtagagaatgtagtcaactcagcaataatctcatagaaatacaaaatacactaatagagtttcccatgcatatttaggttctcatacacggagaattaaatacaaagtaataaaaaatgactataaagtatacagtgaatatgctgtgccaatgtagttctgcagcataatatatccataaattttcttgcctttattgaacttacataatttctcctaacatttacttgagatgcattcttgtgatttatttaaagaaatgatatttgtggccaaaaattggaaagtgatatttcgctttagtacataggtaattaaccactgaactaaaggtctgatcatttatccactttcacattaaagtgcaaacactgaacaaaacataggtaagagatgtttcccatttcaagtggcaaaatttctagtgattttgtggtttacagaattcagttgaggtttgtatagtcattcacagagcaaaatattcaaagtagttattttttgagaaccatctttggcaacatatagcagtttttgatttccccatctagtaaaagcaatgagctaaagaagtccaccttccaccccacccccaaatgaagcccaaattaaactgttctaagtaggcattgaattcaacatattcattttgcttaggattaatttagaatattaaattaatgtgatcagtatatcttctttttatgtttatttcattttctttttgcctattagaaatactttaaaaaggcaaactctgtaaatcctcaatctttaaaggagccacatcagcatcagctttaaaagaacatctttttttttattgttaaatgaagcacctgttaatattattgttgcatgaataaaactgtctcttcatagctctttatctaaaaaagactgatttgaatgaaggtaaacatatgtggatacagatttccttgattttttaatacattcataattttgtttctttttttctcattttatataacacctatattttgattaaaaaaattatttcttctttaaaagatacattaaaaaacctaacttataacaagtgtaagtaatttttctagttgttaggttataatgttttaactttagtttttgtatagtaagtatggatgcatttttcgcaccacagagttgatcaaaataacagactgacataagagttggctgtctgataatattgtaacttgtgaactaaatgagcatgtaaaagtcatgctaacattcatttatttgataaagtcttcttaaagattttgagggcattgatagtacaaatcaaatgcacaatttaaaactgagatggttttcttatttactgaagatctgaacttggatattaaaatctctcctttgccatattctgcatgaaattatttcagtctcttaaccttactttttccatgtgtaaaatgatattattaatgtctaatttgtagattttagtttttaaaaaaggttaatatgtaaaagtgcttgatacatactgtttgcttaataaatatattaaacatacattcttttttacttgggttgtacaaaatcataatatcttaggtatgtaaaacactttttgagttctggcctaattcaatatttctggtgaaaatatgggaaactccttctccctccctccatcttggccttgcccaccacagaagaagaaaatatgtattgaagaacagtagcatttaattttcataactttttcgtaaatgaggataccggaagtcacacaaagtaaatgacttactcaagatcacatagacaggaaggacaaaggtaggattcacacccggatctgtctgaatccaaaggtgaattatgtttcatcatattatgctttttatcatagcttagagatttttctagcatggaacattatttagcaatatctgtgtgattaggcatctgcttcctaattcaacgttttcatcttcaactaaggtttattattaaatataaaacatttaataaaagtcaaaacatttgcttgttcaatttattttaatttatatttttgccttgccataaaaaatattaaagaaggcttaaatttgaatatacttgctatactaccttttaattggtgatatttcaaatttaataagcaaactgcactatgaagacaggatataagaagatttaggcaattggaaagattctttatcttgttacactttcggcatttttttttttttttttttttgccaattctcaatgtgaataaatttacaacatgtgaagcatcaaaagacttataaaatcttgagtcttgtctgaaattagcaaattaaaataaatatatgtgttgaaagaaaagtcctgtcttgcagatgttttggattagaatgaaaatggacacacacatacacatgcataattgttaactttcatttgaaataaaatttaacttagcaaaactaacaagaaaaaataaaataattgaatatctatattctattaaggaatgtaaatttaaacaaaaacattccacaaagaaaactccaggcacggaaagattggcaggttaattctatcaagcatttggggaaaaaacgaaaaagtaaaagcaacattacacactcagaaattaaggaaggaaacactttccaatgtgtttcatgaggcagcatatctctgatacataaacctgataaagacataacaaagaagaaattgcaggttttttaccactacaaacatagttaaaatccttaaaaaaattccaaagttgtattcagaaatacataataataaatcataatggagcagagtttgctataggattgaaaagttggtttaacatttgaaaatcaactcactaattcaccatattaatagaataaaggagaaataacttaataggcattaaaaaaaagcctgacatgacactcatttatgttttaaaaaggtaagactggaagagaacttccacacttttctgaagggcatttatgaaaaccttacagctagctaatttattgttacagatgaatcactgaatacttattcccagcagttgggaacaggcaagatctcttcctactcctgtactcaacattgcattagaattcttatggtagtgtaatttagcagaaaaaaaataaatatgatacataaatattgggatacatgaagtagaatgataatcatttgcagattacgtaagtgtgtttttaaaatcactaagaaattacaaaacaactacccaaggctacaagatagaagatacacacacacacacacacacagcattcggaatagatctagagtaaccaaaataacctggataaaaaaaaaaaagtttgaatacttaatatgatttgattattttttataatgctactgcttctagtaataaagtcatgtgttattgccgtaagaatatttcagcaaaacataatgagtagagatatttatccacacacgtgcagtcaattgttttttgacaaaaacactcaggcaactcaatggaaaaaagaaggcctttttaatagaaaattctcaaattactagatatttgcataaaatatgtaaaccatatgctttcattttatttcacacataaaattaatttgggataaatcaccaacctaacctaaaaactggaactgtaaatcttctcaatttggaagtaggcaacgatttcattggcaaaaaataagaagcatcaagcatgaaaaaattgatgacatttcttctcaataaaattgcaattaagcatatgaatagataagaaaaagagtcgggaaaagtaatcgatatttaataactgtcaaagaatttttatccaaaatatttaaacaacttttatgagtaaatatgaaaaaaacaacacattaaaaaatggtcaaaagacttgggtcgtcaccttaatgtgagtatgaaaaatatgctcaatgctaatatcattagacaaatgcaaattaaaaccacaagataaggttttgcacaactacaatggcttttagacacacacacatacatgcacacatgcacacacattaacaataccaaaatttggcaaggatgtgaaacaattgtaaactatagctcccatacaccacgttttgtggtaggaaaaatgtatgtgaaatagtacaacaattttagagaagtgtatttaatatctgtcaatcctaaaatcaagcaaccccattcccagatatttgcccaagagaaatgaaatcatatgtccaccaaaatacttacacaaaactattcatatagcacatttaattcatattagccagtacctgcaacagctcaagtggcccaaaatagaatggataaatacattatcttatattcatacaatgaaatactacactgaaaggcaaagcaacaaaaacgaatgcaggcaaaatgtggatgaatctaaaaaagtctttattgagctaaaaaagtcagatataaaaagtatatatcatatatatggtatattctgtatgtatgtgatctgatttatacggaatttgtaaagtaggcaaactattgtgataattgaaattagactgttgttgcttttgggtagaagtgggaatgattgaaaaggagtgtatgggaaatttgggaaataatgggaaaagtcagtatcttgatttgagtagtggttacataggcttataatacaattagcaaaacctatcaaatactatacttaaaaacctctccattttattttatatacattataattcaaatacaactgataagaattatagaaaatgtggacaatatgtacaattttatacattatatatatatacacatatatatatgtaatgtttcccttaaattttacctcttaatcggattactgtggaaatatattcttaaaagtattatttgtatgtatcagttgcaaatctgacttacattattttaagtggtgtaagatattaggagaagtttgttatctaatgtaccttgatcactaatttatattacaaaaagtaatatgttccaatccatatttcttattggttaaatcagttctactgaaaaaattttaaattctatgcttcacaaacaaaacagagagaaatgtatttgaatactgaaggctacactgtgtctatttccaaggggctaataagatttaagacttcaaagattcagtcttgtggtcaagaataagtgatgtggatgcctaagaaatgataagccatgccaggagactggaacataaatttgaggctgaatgactgcaattttccaaacatattttctgtttatcacaaagtttcatagtagttccataacttttccctccactcggtctctttaaaattctactgaacttctgagtaaaattgagaataatttggtccactgaatactatggcaaccctcccaccaaaataaataaaatgaaaaatttttctttcttttccttgctgttttctaattattttatctttgattatgcttcaaaagccccctattttctcggaaatggaatgttgtatatcttcttagattcactttgtttgtaaaagggaggaatatctgaaagtagaaggtaattatttacattagaagcagtgttttttactctctatgaaacttcctgcaaatataatacttaaacactctataaaagattgcaagtatacacagcaagtttgtaaatttttattttaatatctctaaagaatgagtagattgtaattttgtatttgataaaaattattgaggcctgaaatgcttttttcctactttagaaatttaaatgccattttcataatattgattcttcctacccatgagcgtggaatgttcttccatttctttgtatcctcttttatttcattgagcagtggtttctagttctccttgaagagatccttcacgtcccttgtaagttggattcctaggtattttattctctttgaagcaattgggaatgggagttcactcatggtttggctctctgtctgttattggtgtataagaatgcttgtggtttttgtacattgattttgtatcctgagactttgctgaagctgcttatcagcttaaggagattttgggctgagacaatggggttttctagatatacaatcccaaggtaatttatagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagatcaacagaacagaacagagccctcagaaataacactgcatgtctacaactatctgatctttgacaaacctgagaaaaacaagcagtggggaaaggattccctatttaataaatggtgctgggaaaactgactagccatatgtagaaagctgaaactggatcccttccttacaccttataccaaaattaattcaagatggattaaagacttaaacgttcgacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcagaagaaactagcatcagagtgaacaggcaacctacaaaatgggagaaaattttcacaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaaggctcactatcactggccatcagagaaatgcaaatcaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggcgcttcctcagggatctagaactagaaataccatttgacccagccatcccattactgggtatatacccaaaggactataaatcatgctgctataaaaacacacacacacgtatgtttattgcggcactattcacaacagcaaagacttggaacccacccaaatgtccaacaatgatagactggattaagaaaatgtggcacatatacaccatggaatactatgcagccataaaaaatgatgagttcatgtcctttgtagggacatggatgaaattggaaattatcattctgagtaaactatcgcaaggacaaaaaaccaaacactgcatgttctcactcataggtgggaattgaataatgagaacacatggacacaggaaggggaacatcacactctggggactgttgtggggtgggggctggggggagggatagcattaagagatatacctaatgctaaatgaggagttaatgggtgcagcacaccagcatggcacgtgtatacatatgtaactaacctgcacattgtgcacatgtaccctaaaacttaaagtataataataataaaataaaaaaaagaaatttaaatgctgtctacttgaagaaaatgtttatattgaaatgttaaacaaaagaaatgcacttttaaaattataaagtatattttgttatctctttaattttctttcaattgttacatttatattgtgatcttcacaaacgaatcattatgaaacacttttgacaccaatttgatctgttgactaatagttcaattaattaatagctaaataggctttgtttcctttcaaattgattaaatgtttgcatagtttaaaaatagaaaaaaattacactaaggcattatctgagattcgtttgtaaatataaatcacgccattaattatactgcctaattcatgataatagagttaaggggtctgttttatttaaataattttctgtggttttcaacatgatttaataaaaatattcctgaaaaagatcaacacatttcccattgtgaaaattttttcatgaaattattatctagtatttaatcatgtaatattagtagattgtggtttccagttgctttgagataattacttccttttaccagaaaacttcaacatcaaatttgtaggcctgttgtcatttataaggtctgttcaatcaaggtcacaattctgtcttaatttcatagtattgctgtaacttcaattaagagatttttggaagtttgcctcatcaatttttctgcctctggccatgataatacataaaattgtgaggatataatatttttaattacttacttctgagaatcctcagtcctcaaagaaacttagccaaatatatgtatgttttgtttgtttgaattttgttttttattatagcccccatagttggtatgaagtgatatgttcttttaatttgcatttccctaatgactaattatgttgagcatcttttcatgtgcttgtaaataatttgtatttcttttttggagaaatgtctcttcaagtccttggtccactttttaaaataactgtttttctctgttgttgacttgtgaaagttctttatactttctgcatactaggcggttatcagatataagatttgcaaatatctcccattatgtggcttgtctttctctttccctttctctcgctgtcttgatagtgtccttagatacacaaaatattttaactttgctagagtccaatttatttttctttcattgctcatactttcggtgtcagatctgagatattattaccaaatccaaggtcatagagattttccgcattctttcttctaagaattttatagttttagcacttatatttaagtctttgatccattataagttaattatttatatgatgtgaggtaggagtccaacttcattcttctgtgtgtggatttccagttgttccagcaacatttgttgaagagactgctcttgccttcaaaaaatggtcttggcacccatgtcaacaaccagttgaccataggcccctgggtttacttctgaacttccaattgatcagtatgtttatccttatgccaatgatccatatatttatatttatgtcagtatcaaattatctggattactggtgctttgcaataagatttgaagggcaaattaccctgttatattatttttcataattgttttagctttggggctccttgccttccactggattttaggatcagctttctttaacatttacattttagcaaaaaaagaaaaaaatcattgggatttctatacggattgcattgagcctgtagattgcttttggtagtattttcatcttaatagtattaattcttccagtgtagtttattttggctgattactctgactagaactttcagtaccaatgttaaagcacaagggcaaatgtggaaatgcttgtcttcttccttatctaagtagataggtttcaatctttcacctttaaatatgatggtagctgtgggttttccacaaatgccctttattatgttgaggaagcttcttttaattttcagacttcccattgtttttaagatgaaataatgttagatttttttaaatgctctttatgcatgaactgagaagaatttctgtttatttctctttgttttatcaatatggtatagtacattgattgagttttgtatgttgaaccaccctggtattgctgaaataaatcacacaaaatcatgatataggatccttttaatatgctgctggatttggtctgttagtaatttgtgataaattatcagttcttatttttagttgggattcttttcttatcaatagcataaatcttctttatggcccatctttctggttttgtttcacaagaatttcaaaaaaactattataaaccatctttcttttccatgcagtcaattgaaattccctgataattatttttcataagagaaataactattttccaagtatggcctactacttctatttctaaatctctttaaattgagatggttaaagtacagtatagtaacaaccctagctatgtaatattaagattagtgggaggattaatgtcaatatttctttttttttattatactttaagttttagggtacatgtgcacaatgtgcaggtttgttacatatgtatacatgtaccatgttggcgtgctgaatccattaactcctcatttagccttaggtatatctcttaatgctatccctccccccagcccccaccccacaacagtccccagagtgtgatgttccccttcctgtgtccatgtgttctcattattcaattcccacctatgagtgagaccatgcagtgtttggttttttgtccttgcgatagtttgctaagaatgatggtttccagcttcaaccatgtccctacaaaggacatgaactcatcattttttatggctgcatagtattccatggtgtatatgtgccacattgtcttaatccagtctatcattgttggacatttgggtgggttccaagtctttgctattgtgaatagtgccgcaataaacatacatgtgtgggtgtctttatagcagcatgatttataatcttttggggatatacccagtaatgggatggctgggtcaaatggtatttctagttctagatccatgaggaactgctacactgacttccacaatggttgaactagtttacagtcccaccaacagtgtaaaagtgttcctatttctccacatcctctccagcacctgttgtttcctgacattttaatgattgccattctaactggtgggagatgatatctcattgtggttttgatttgcatttctctgatggccagcgatgatgaacattttttcatgtgtctgttggctgcataaatgtcttcctttgagaattgtctgtttatgtccttcacccactttttgatggggttgtttgtttttttcttgtaaatttgtttgagttcattgtagattctggatattagccctttgtcagatgagtagattgcaaaaattttctcccattctgtaggttccctgttcactctgatagtagtttctgttgctgtgcagaagctctttagtttaatgagatcccatttgtcaattttggcttttgttgccattgcttttggtgttttagacatgaagtccttgcccatgcctatgtcctgaatggtattgcctaggtttttgtctagggtttttatggttttaggtctaacatttaagtctttaatccatcatgaattaattttggtataaggtgtaaggaagggatccagtttcagctttctacatatggctagccagttttcccagcaccattaattaaatagggaatcctttcctcatttcttgtttttgtcaggtttgtcaaagatcagatagttgtagatatgcagcattatttctgagggctctcttctgttccattggtgtatatctctgttttggtaccagtaccatgctgttttggttactgtagccttgtagtatagtttgaagtcaggtagcgtgatgcctctagctttgttcttttggcttagaattgacttggcgatgcaggctcttttttggttccatatgaaatttaaagtagttttttccaattctgtgaagaaagtcattggtagcttaatggggatggcattgaaactataaattaccttgagcagtttggccattttcacaatattgattcttcctacccatgagcatggaatgttcttccatttgtttgtatcctcttttatttcattgagcagtgatttgtagtttttcttgaagaggtccttcacatcccttgtaaattggattcctaggtattttattctctttgaagcaattgtgaatgggagttcactcataatttggctctctgtttgtctgttattggtgtgtaagaatgcttgtgattttttgtacattgagtttgtatcctgagactttgctgaagttgcttatcagcttaaggagattttgggctgagacgatggggttttctagatatacaatcctgtcatctgcaaacagggacaatctgacttcctcatttcctaattgaatgccctttatttccttcccctgcctaattgccctggccagaacttccaacactattttgaataggagtggtgagagagggcatccctgtcttgtgccagttttcaaagggaatgcttccaggttttgcccattcagtatgatattggctgtgggtttgtcatagatagctcttattattttgagatacatcccatcaatacctaatttattgagagtttttagcatgaagggttgttgaattttgtcaaaggccttttgtgcatctattgagataatcatgtggtttttgtctttggttctgtttatatgctggattacatttattgatttgcatatgttgaaccagccttgcatcccacggatgaagccctcttgatcatggtggataagatttttgatgtgctgctggattcggtttgccagtattttattgaggatttttgcattgatgttcatgagggatattggtttaaaattctcttttattgttgtgtctgtgccagactttggtatcaggatgatgctggcctcataaaatgagttagggaggattccatctttttctaatgattggaatagtttcagaaggaatggtaccagctcctccttgtacctctggtagaattcggctgtgaatccctctggtcctggactttttttggttggtaagctattaattattgcctcaatttcagatcctgtaactggtctattcagagattcaacttcttcctggtttagtcttgggagggtgtatgtgtcaaggaatttatccatttcttgtagattttctagtttatttgcatagaggtgtttatagtattctctgatggtagtctgtatttctttgggattggtggtgatatcccctttatcattttttattgtgtctatttgattcttctgtcttctcttctttattagtcttgctagtgttctatcaattttgttgatcttttcaaaaaaccagctcctggattcattgattttttgaagggttatttgtgtctctatttccttcagttctgctctgatcttaattatttcttgtcttctgctagcttttgaatgtgtttgctcttgcttctccagttcttttaattgtgatgttggggtgtcaattttagatctttcctgctttctcttgtgggcattgagtgctgcaaatttccctctacacactgctttgaatgtgtcccagagattctcgtatgttgtgtctttgttctcattggtttcaaagaacatctttatttctgcgttcatttttttgtgtacccagtagtcattcaggagcaggttgctcaatttccatgtagttgagtggttttgagtgactttcttcatcctgagttctagtttgattgcactgtggtctgagagacagtttgttataatttctgttcttttacatttgctgaggaatgctttacttccaagtatgtggtcaattttggaataggtgtggtgtggtcctgagaagaatgtctattctgttaatttggggtggagcgttctgtagatgtatattaggtctacttggtgcagagctgagttcaattcctggatatccttgttaactttctgtcttgttgatctgtctaatgttgacagtggggtgttaaagtctcccattattattgtgttggagtctaagtctctttgtaggtcactaaggacttgctttatgaatctgggtgctcctgtattgggtgcatatatatttaggatagttagctcttcttgttgaattgatccctttaccattatgtaatggccttctttgtctcttctgatatttgttggtttaaagtctgttttatcagagactaggattgcaactcctgcctttttttgttttccatttgcttggcagatcttcctccatccctttattttgagcctgtgtgtgtctctgcatgtgaggtgggtttcctgaatacagcacactgatgggtcttgactctttatccaatttgccagactgtgtcttttaattggagcatttatcccatttacatttaaggttcctattgttatgtgtgaatttgatcctgtcattatgatgttagctggttattttgctcattagttgatgcagttgcttcctagccttgacggtctttacaattgtgtatgtttttgcagtggctggtaccggttgttcctttccacgtttagtgcttccttcaggagctcttttagggcaggcctggtgttgacaaaatctctcagcatttgcttgtctgtaaaggattttatttctccttcgcttatgaagcttagtttggctggatatgaaattctgggttgaaaattcttttctttaagaatgttgaatattggcccccactctcttctggcttgtagagtttctgccgagagatctgctgttattctgatgggcttcccgttgtgggtaacccgacctttctctctggctgcccttaactttatttccttcatttcagctttggtgaatctgacaattatgtgtcttggagttgctcttctcgaggagtatctttgtggtgttctctgtacttcctgaatttgaatgttggcctgccttgctagattgaggaagttctcctggataatatcctgcagggtgttttccagctgggttccattctccctgtcactttcaggtacaccaatcagacatagatttggtcttttcacataggcccatatttcttgggggctttgttcttttctttttattcttttttctctgaacttctcttctcacttcatttcattcatttcattcatttcatcttccatcactgataccctttcttccagttgatcgcgtcggctactgaggcttgtgcattcatcacatagttctcatgccatggttttcagctccatcaggtcgtttaaagacttctctgcattggttattttatttagccattcatctaattttttttcaaggtttttaacttctttgccatgggttcgaacttcctcctttagctcggagtagtttgatcgtctgaagccttcttctctcaactcgtcaaagtcattctccatccagctttgttccattgctggtgaggagctgcattcctttggaggaggagaggtgctctgactttcagagtttccagtttttctgctctgttttttccccatctttgtggttttgtctacttttggtctttgatgatggtgacgtacagatggggttttggtgtggatgtcatttttgtttgttagtgttccttctaacagtcaggaccctcagctgcaggtctgttggagtttgctggaggtccactccaggccctgtttgcctgagtatcagcagcggaggctgcagagcagaacagcggctactggtgaacagcaaatgttgctgcctgattgttcctctggaagttttgtctcagaggggtaccaggccatgtgaggtatcagtctgcccctactggggggtgcctcccagttaggctactcaggggtcagggacccacttgaggaggcaatctgtccattctcagatctccaactgcatgctgggaaccactactctcttcaaagctgtcagacaggtacatttaagtctgcagagttttctgctgccttttgtatggctatgccctgcccccagatgtggagtctacagaggcaggcaggcctccttgagctgtggtgggctccacccaattttggccgctttgtttacctactcaagcctgggcaattgtgggtgcccctcccccagccttgctgccaccttgcagtttgatctcagactgctgtgctagcaatgagtgaggctccgtgggcataggaccctctgagccaggtgctggatataatctcctggtgtcctgtttgctaagacagttggaaaagcacagtattagggtgggagtgacccgattttccaggtgccgtctgtcacccctttctttgactaggaaagggaattccctgaccccttacacttcccggttgaggcgatgcctcgccttgcttcagctcatgctcagtgcgctgcacccactgtctgacactccccagggagatgaacctggtatctcagttggaaaagtagaaatcacctctcttgtgcattgctcactgggagctgtagactggagctgttcctatttggccatcttcaatatttctaacatattagaatctatttgattttttaaatctacataaactcgtgtactaacagttattttatttgtaaaacacttttttttcctatagtatgttggacttatcaatattttgaatatgtaagtcttaccctttggagtttactgtccaaagggcaaaccttatatattttaaatgtatagcttctaatgttctgattatagaacagttatgcatgggatataagcaacaatttgtcttccaaatatgtcatatttgccactgttttcatggattatatgaaacctgtgaataattgcttttgtgtatattgattcttcagttacattcagtggtggtaactacttgaaaatatttctgataactaagtttgaaattagattttaactgttcctgtaagtccctcattcagtgacttattgtgtaatgctattttattgcttctatacatcctatttcttatgtaatcatgcatgtaagatttaatcttgaatctttgaatatgtgaacctcactttattctactctcttgattgatagtttactgtagaataaatttgattggttgaaagtaattttctctcagagttttaaagtcattgttctattattttatggaatccaacattacttatgagaataataccaaccatttcaatgtgtctttgtaaataagctgtttttttttcccaatgggagaaacttaggatcaactcaatgtttttgctgctctagaaagtctagaaaaatgtggctaggttttttacaacatactattcattgagataccaagacaattaatactgtaagtcttcatctctaggaaattatgtttgattcttacaattgtgataattgttatccttcgttttctctattccagtgaacgaagtaccagtgatggtcactggggagggagttttaatcaacagcactaaggttcatggtagctgcttcagtttttcccaaatgattacttgaaaaataacttttgttttgttttgaaagtgggaagtttaaattggatgttagtgattttattgaggatgatggaagagtgcagttgatgagaatattttcatttgatcatcttattttcagcctttttactgtctgtaatttttgatttttcaggtctgcctcccaaccctctaagtgtattttaggaaagatctatgcccccttaacttcagtcctcttcataaatatttctggctgcaactacttgcactgtgttttattagcgcatgcctttttacatgccttccagaaatatgttggaatctctagtctgctaatgactaccaattgttcttttaattttaatagcttatagctcttaaaactgcctttaatctcaccgtttaggtctcatatgaggagaaaatttaaaaaattatattttctagtccatattcttcaaccgctgtttccttaaaatgattcattgacacaaaaaatggcatttggatatgcgaatggattccatcaaagccttcaaaatgggaggtctggcaaacaatttattttttcttacaatatatacctattcccaaaagttatttgactactttgtttatatattttgtgcttatttgactattctattccttagcctactttttctttacccactcttctcttgcctatctcatagcctatttcagaaatatgtttatgcagatttttcatctaaatcttttttcctgtcttttccagagtatttcttcagaatttcactttcttctgaagtagcttattcacatatttcctaaataccttttcttcccccccaaaattatattaataacttttatttaagttgtttgttttaaacctgttccattaaaaattccaaggctttgtttgtactactatgcaaactctactgcatattactcagcaatattggctttagctgattatatccagcaatgaatgcttcttcacctctaagacataaactgttttctgcagaaaggccttacatcagatggacagaaagtctcacaactttctgtaccttacagttatggttctccaaatgcagcatcgttcaaagtcacctgaagaacttggtaaagcactggtttttaggtccaatcttgtaatttctgattcaataggcctgcatgaaagccaagaatttccattcctattaagttcctaggtaattctgatactgctgatctgagagctgtagtattagaaccattgcctggagaaccactattccattggtaaaagggtaactcacatgtccttactctgaaagatggaaagatttatagaaagtccaaacaagtcaatagtttctgaaagcactaccttgtataattatgacatgctaataattttgtaggtagtcaacataaaagaaagatgtttgaggaggatataacagaaaactgggtttatttatatgtctgttggctttaccaatatctcacagtcttgggtaaactgatcaaagcacacataagttctaactctaatttttgcaaatactatagattctaaagagaaaaacaatgaaatgattatgaatctcatcctctttgtcagcatgcgtgtgtattgtctacctgtatgcccaatatttatgagttattatgtgctaatatgaaagaaatatttattaaatgtgctatgtttaacaaaataatgcagttcttccctaagcaatcacaaagtatgtatcattggctgaaatacaatcagatttgtcaattttccattttgtatagtagtgacatatgtgctacttatggaagaataaagataaattataaagggatttttattagtaaagaataaacttgcaaagtttcagatttatatttttttttcaaaaactgactatatcttatgctttaacttttaagaaatgttagatagcattgacaaatgtctacttcctgaaagtttgaattaatgaaaactgtttcttgaccatatatagccttcaaatagtcttcagaggtgtatatgggttgtgtgtgtgcgtgtatatgtgtgtgtttgtaatgatgtagtgaatacagaacactttttaaagtattagaaacaataaaagggtgcattagaatggatggcatctgcatcatatatatcacaagcttttaatatctgataatcagtatttttattatgtccagtgtgataataaaatgaatcctatgttgtttgttaattaccttttgtaaaatatcattttacattatactatcagcatttttatgccatcaaatatgcttctgaaaaattatttttattgtgtcatatgaaggtggcacaaatttagcttgtccctcaattaatgggaatttaaaaaaatttgttttctaagagggaaattgccaagttaaagtgtataaatatatttatggctcctaataatttttttataaagccattatactcctacctgaggtttcattttacattttaaagtatgcttgttacataaatagtctatggttatttatatttttaccaatttggtaggtaaaattataatatgttatatagttttaatcggcatttttgtaactttgtttggaatagaagtttttaacatccttttttgctacttgtatttgaaagtgaagaataaagcatttatggctttagtgggtataatctatcctgtcaaagcagaaaaataattactaaaattttgtaaaggttatttttatactattttcctattttaaatctaaagatatggggtaaatacatgcattattgttatagttacttttagtattttagatttacagacatttctctttctctttccttttttctcttctactttgtatgcccttaagaatgacttatttaaactcatttgtcaaaatcagaattagtgcataaatagttctatggataagaaaaactctgttttatatgtgatccaaaatgcaatatatgaatgttatattgcctagaataaacgttcttaattttttagggaatggaactcattatgaaacatacaaacatgtttacctgtttgacagtttaccataccagaatcgtttcttttgcaaattgaagtataatgaattagtacaatctctgagaacacagagatatcacatgagaatgaaatctacagcatttaactttcagatttattctttcacttattctaggtgtatatatatcatttgtaaagtgagtgactcttcactttttaaatctaggaataatatcagtttttttttcaggaagaaacttcctccagtcaactcattactaaatatttgtgtgagtgtgtgtgggctcgtgtgggtttgtgtgggcttgatgtgcttttctcttagttgaataacagtatcagtcctataagcatgtaatgatacaagaagacaaccaaaaaagatctggaggcatccttgttatacaattagacaaagaaaatgtgtgtgtgtgtgtgtgtctgtgtgtgtgtgtgagagagagagagaaggagggagtatttaacgagtagcttctaaaattttgagatgggatagattaaatggagctaaatgttgaatttataattactaaatatctatgtaattattaaagataaaatttaaaataaaaatagggcatagtctttttttattatacttcaagttttagggtacatgtgcacaacgtgcaggttagttacatatgtatacatgtgccatgttggtgtgctgcacccagtaactcatcgtttaacattaggcatatctccaaaatggaaagctaaaataacctttacattttaagaagtgactgaattttagtttatgattgactgtcttctagcggtagaattgacatagttcagaaagggagctaaatgtgcctccactgtgataagaaatgggaagaaaatagaaaaagtaattgctttagcaatgatctagtatgaaagtgatggattctttcaggtagaatttggtaggctttcagtggctggcacattcttcggagcactcaatgaggtcaaatatctcagtgtaggaaggtgtaaactgtttagaaacctgctaccatccaacaaattgaaactgaactgatgttagtgtagctgtgcactaaggcatgtttttctgtgtccatgagtatgagatgaagagggactatctcttaaagatttttctatctgatactcttcaggatctaatgagatcagccagctacagataaacaaactgatgctgaacctgcaattggccatctcctctcagctaacccatttgtctttagctgttctcacagagggaatgacagtgcatttatttagggcaaaagaaatacctatttttatataactatttgagaaaagaatcaagatgagtcaataaagatgtagcaaagtttggcttttggatccgtcctgttttgcttctctggccagctacacacgtttggggaactaatcatttactttgacagagtttcctgcatcacaccttctactgaattttctaaaaaagcaaaaagtattttgtcctccagcattcaaacaccaggtggtctaatttttgcctgttggctcaaaatatgtgtttggagattttctccctgacctgaatcgatcctctaactgacagagcaatgtaaatcttggacataaacaacaaagagtgtgtttctactggcaaagacagtgtaaattatggaggatttatgtactatggtaataaattaagttcctacaagtgcttttgtttgaatagaaatatcaaaatcccaaggcctgttgctttagacatatacgtgatttttttagtccaactttgattattagcttatatccctttactcccctgatgcttcattcatttcagaattagtacttggggaatctcctacttcagtcccagaagaaactgggttagtcacagatagttcttcatagcatgcttcttctcacagtggtaccaacgaagcatggcaatgcaatacattttgtcctccaaatcatcagccatgaaaattggtccttaattttgtctttactttccattatttatataaacctataagaaaagtacttgttttataagcttgatgtcatttcgtgtagtgtgtactagaaaagtattgccttccaggtaaaagagaagaagagtttgtttcttttttatagtagtacctaattgtatttcagttctggagtgcccacatattctgtagctttgaaaattacttggcaaatccattttcagattatgtatactgattatgatttttacaaggtttggttcttatttactttcagtaatttcctttcctgttagaaaaatctaaatattgctttgttcttctaaaggaaactctttaaccaattttctctggaggattcttagttttctgacatctttttgaaattaaggactagaaccacactatctattagaagtacatatattctatgtatgtagagataatgttttctgatgttttcactactgtttattatttccatggttgtcatcactacaacagaatcatccattttaaatgagccttaagttttctacttattaaatatcttgttttttgaataaaaggaacttaacaatagattttatgttgttctatataaaattgttctccaaaaattcgcaaaattttttatttatttatttatttatttatttatttattttgagacaggatctcactttttcacccaggctgtgcagtggcgcagtcacacctcgctgcagcctggaccttaagcaattctctcatctcagcctcctgaggagcttggactacaggtacactccaccacaactggctaatttttttgtattttttgctgagacagggtttcaacatgttgcccaggctggtctcaagcgatgcaccctgcttagcctcccaaagtgtgtgactaaagttatgggccactgtgcccatccaaatttttacttttacataggtaataccaccataagttcaaatattaaaaagcataaattcatgccaagccattagttttgcaccaaactgtgtgacccaaacacccaattcctcttccaaaattggtatagattcatatgcaaatactaattttctatcctttctaaattgaaattatatatgcattgtattgcacctttcttcaagtgtttaatatgttttggataacaatcttttattaatcttttattcctaaagagttccatattctttttatggctgtgtattatttcattacatggatatgctatctcacctaagtcttattgattgatagataaggctttcctaatatttttatattaaaaacaatgattcagtgaaacactgtgtacatgtcccttcacatatgtgcaagtataagaaaaaaataaaatctcaaaagttaaattgtttgatcaaagggtaaatgcattcatattttgccaaattgccctccaaaggatttgtaccaatgtggacttagcccggtgatatttgagagcacctgatttctacatactcattaagtgccctaacaaatttgtaaatctttattattctgataggtaaacatgttttctctcttaaataatttgtagcatccatacatgttattttctttgaactgtttacatatttttatcataatatttcattgtgttctttttatcaatcgtagacgacctttattcattgaggataatagatctctatgagattgctttattctgctttcttaaacacattcagaaattatgatcaaaacatgaatggtttgaaattattacaataactcagattgtttttgcagaaatatttcatattttgtgcttctcctcatgttttttaaatctcatttctgtttctacacaaaaggttcatagtctagtacaattatattaagaggtggtatttggtagctatatgaagaaagttgtgggtgatgaaatcagtgatagcatagtgactaaacataactgaattgcctaactcaaagtttaatccaatttttgaataagtcaagtagtagtatctttctcacctgcacatttggaattcccatgtttcaggcttcttttgtcattgtattttatttcctaattcagtaaaacctgtaattgaatgtattcgtttcctacgactgccataacacaatatcacaaatggagtggcttaaaacaacaaaaatgtactgtctcacagctcttagagcgagaagtgaaaaatcacggagtcagcagaggtatgctgccactgaaacatgtaagagagaaatctttgccacttcctagcttctggtgatggtcatcaactggcatttttttttactttcagctacattactccaatctctgccactgtcctcataaggcattctccctgtgtgtgtgtccacatttccctcttcttagtacaccaacagtcgtattggatttgggcccactctaatgatctcacctttatttgatcacgtatacagagaacttctttacaaataaggtcacattcagagggactgggagttaggcttcaatatattttgagtttggggaagccaattcaacctataacattgagtaatagcaggtaaccacaatgctttagtgatcttataaaaatgatgtcgaaaagtaagctctgtgttctagagtttgttttcattataaagattacattcactgaaagctctatgcatataatgtatctttagatgatagtctactataaatgttgatgctcttagctttagaaaaattcagtaaattctaaaaactttcttcaaattgagctgaactcatctgtgatctcactatttctgtgtcacaatcaatttgggaaataaacatattttaatattatattttctctttgttcatgacgggcatagtcaagtgatgattagtttatgtgattcattttattgcatttaatagaaattactaaccagaattacagctcaagtctctcgacagggaacaaatcacagcaaatgaatccaacaggaatcaatatgatgattcattagcaatgagctctcactgagagtcccaacaagctgaagacttcataccatatttttttatgaaccaaatgtcaatagcgaaattaactactaaaaagtatcacagaaatgtgctttattttaatatcatatttcacaattttttaaacaactgaaacaagtttatgtatttcacttttgcttctacaaattattttaaaatagtttccacatctcaaatatcatattggaataattattagaattttataaagtctgtttcccaaaatatttactaaatattttgtcctcataatctcactagaagattacattccattatatgatattttaacagttttctcattggtttaactgtggcatgtatgcacaaatacacatgcacatgaatccatgtgcagacacacacatatatgcacagcacaaggtcgaaagcacattaaaagatttctcaaatatagatatatcaatatataaatatgaaaaaagcatactatgtgtgtgtgtgtatatatgtatacacacaaacatatacacacacatatatatatacaaacacatacacacatatatatacaaacacaaatatgcacacatcaactttttggatatgacatctaattcaactccaaatttccccagttatactgtcatgaccttagaaatgaagtaggtagactgggggatcttgggataaggagtataacactgtttctgcagttttattttattttattttattttattttttgagacggagtctcactctgtcgcccagactggagtgcagtggagcgatctcgactcactgcaagctccacctcccaggttcgcgccattctcctgcctcagcctcccaagtagctgggactacaggtgccagccaccatgcccggctaatttttttttttaattttcttttttttttattattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaagagtccccagagtgtgatgttcccctttctgtgtccatgtgatctcattgttcaattcccacctatgagtgagaatatgcggtgtttggttttttgttcttgcgatagtttactgagaatgatgatttccaatttcatccatgtccctacaaaggagatgaactcatcattttttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgggagatggtatctcattgtggatttgatttgcatttctctgatggccagtgatgatgagcattttttcatgtgtctgttggctgcataaatgtcttcttttgagaagtgtctgttcatgtcctttgcccactttttgatggcgttgtttgtttttttcttgtaaatttgtttgagttcattgtagattctggatattagccctttgtcagatgagtaggttgtgaaaattttctcccattttgtaggttgcctgttctctctgatggtagtttcttttgctgtgcagaagctctttagtttaattagaccccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccattttgaattgatttttgtataaggtgtaaggaagggatccagtttcagctttctacatatggctagccagttttcccagcaccatttattaaatagggaatcctttccccattgcttgtttttctcagtagagataggatttcaccgtgttagccaggatgttctctatctcctgacctcgtgatctgcccacttcggcctcacaaagtgctgggatcacaggcatgagccactgcgcctggactttctggagctcttaaaaaataaactttatttagaaagaaaacaaaaaacaaaaacaatttttggaacagttgtaggttcacagcaaaactgagcagaagttacagagatttcctatatacttcctgttcccatattaatataccatctgtcattaacaacatcttcctagagaacagtgcacttgctacaattgatgaagataacttgacacatcattaccaacccgggttcacagttaaagttagaactcacttttggtcttattgagtctatgggcttggacacatttttaatgacatatatgcacaattatggtattatgcagaatagtttcaccactcaaaatcctctggattctccttatgtatccctccctatccctaacccttgaaacgactagccttactgtatccacagtttcacctcttccagaatgtgatatactcatttatgtttcttccatgtcttttcatggcttgatagctcatttttttagtgctaaataatattccactctctagatgtgccataatttatcaattctccaacatctgtttcttccaagttttggcaattataaataaagctactataagcatcaattttcaggtttttgtctgaacataagttttcatctcctttggataaatagcaatgagcagtatggctggatcctacggtacgagtatgtttcattttctaagaagctgcctgtttttcatagcagctgtaacaatttgcattcccagtggtaatgaatgaaagttcttgttggttcacatcctccccagcatttggtattatcagcgttctggatttggctattctaataggtttgtagaaatatctaattgttgttttaattttaatttgcatttccctaatgacatatgatgtggagcatattttatgtgcttgtttgccatctgtatatcttctttggtgaggtatcttttaatgtatttggctcattttttgtttgttttctttttgttgaattttaagcattccttgtaaattttgtataatagccctctatcagatatgtcttttgcacgtattttctctcagtctgttgcttgttttatcattctcttgacagtatctttcacagagcagaaattcttaattttaattaagtccaagttatcaaatttttctttcatgaatcatgcctttgttgtagtatctgaaacgttaccatcaaacccaaggtcatatgatttttttttctatgttatgttgtaggagtttaatatttttgcattttgcatttaggcctgtgattcacttcaagttaatttttgtaaaaggtgtaaggtttatgtttagattcatttttctccaggtggttgtctagttgttccagcactgttttttgaaaaaatttccttttctccactgtattgtcttttcgcctttgtcaaagattggtatactgtacttatgtaggtctctttctggactcttttctgttccattgatctatttgtctgttctcttaccaataccacactctcttgaccactgtagctttataacaaacttttgagtcaggtagtatcagtcttccattttttttttcttcaactttaacattgtgctagctatactgaatattttgccacttcataaaaacttccgaatcatttagtagatatctacaaaataacttcctgtaattttgattggggttgtatattatttatagatcaaattgggaagaattgacatattgaaaatattgaatctttttgtccataaacataaaatatttatccatttattcagtcctttttatatctttcattagagatttgtagttttcctcatatagattctgtgcatattttgttacatttatatttaaatatttccttttggggatgctaatgtaaatagtgtgtgttcttggtttcagattcctcttgttcattcatggcatataggaaagtgattaacttgtgtatattaactttgcattctgccacactgctataatcacttgttagtttcaggaacttttgttgttgttgtcgattgttttggatttcctacataatgatatcacctgtgtacaaagacacttttaattcttctacaccagtaagtatacctttatttctctttgtataattgtgctaggactttcagtaaaatcttgaaaaaagagtggtgagagttaaccttgcctacttcctgatcttagttagaaagcttccagttttccacaatcaagcatgatgttggccatcagttcctttgtagatgtctttatcagtttgagcaagttctattcttagttgactgagagattttatgatgaatgactgagagattttatgatgattttatgatgaatttttggattttgtcagatgctttttctacatctattgatacagttttgtgatctttcttatttagcttgttgatatgatggaccatattaattgattctggaatattgaaccagccttgtatatccgggataaatcccacttggtcatggcatacaattctttttatacattgttggatttgatttgctaatattttgttgaagatatttgcatctatgtccacaacatatattggtgtgtagtttccttttcttataatgtctttatctgattttagtattcaggtaatgctgacttcatagaatgagttagaaagtattcactctgtttccaccctcagaaagacattatagaaaattggtataatttcttccttgaatgtgtggtagaattcatgagtgaacccatctgggccttgtactttctgtttggaaagttattcatttttgattcaatttgtttggtaaatattcacctattcagattgccatttcttcttgggtgagatttagcagattgtgtctttcaaggagtaggtctgtttcaactaggttatcaaatttgtggtcatggagttgtttacaatattcctttattatcatttgcatgtccattagatctgtagtgatgtgtcttctttcatttctgatgttagtaatttgagtccactcttcttttttttttttttttttccttagcctggctaaaggcatacagattttattgattttttttttttttcccaaaagactgacttttgatttcactgaatttctctattggcttcctgttttctactccattgatttctactctggtttttagtactactattattacttccagttactttttatttaatttcctctccttttcctagtttcctaagatgaaaacttagattattaatgttagatctttcttcgtctctatacaatcaatgttataaatatccctgtaagcactgctttcattacatcttacaaattgttatgttgtgttttcatttttatgtagttcaattttttttttaattttctgttaagatgtcttctttgacctgtatgctatttaaaagtgtgtttgtaatgccccgtaaccttcagcaatcccactgttgggtataaacccaaaggattataaaccattctactataaagacacattcacatttatgtttattgcagcactattcacaatagcaaagacttggaaccaacccaaatgcccatcaattatagactggataaataaaatctggcatatatacaccatggaatacaatgcagccataaaaaaggattagtccatgtcctttgcagggacatggatgaagctggaagccatcattctcagcaaactatgcaggaacagaaaatcaaacaccacatgttctcattcataagtgggagatgaacaatgagaacacatggacacagggaggggaacatctcacactggggcctattgggggatagggtagctagggtagagatagcattaggagaaatacctaatgtagatgatgggttgatgagtgcatcaaaccaccatggcacatgtgtacctatgtaacaaacctgcatgttctgcacatgtatcccagaacttaaagtataatttaaaaaaaaaggagagaagagaaaaaaaggggtgtatttgtttaatttctatctattttgaaaattttcagctatctttctgttatggatttctggtttaattttattgtggtctgagaacaaacattgtttgattcctattctttcaaatttgttaaaatatgttttatggcccagaatgtggtttaccttggtgaattttccatgttagcttgagaggcatgcttttctgatgttgaatgaagtacccaatagaggtcaattatattcagttcattgatggtgctgtagagttcaaatatatccttacttatttcctgcctgttggacctgtccatttctgatagaggggtgctgaagtttccaaatataatagcaggtttatctatttcttctttcagttatattagttgttccctgatgtattccgatgcaatgctgttaagtatgtacatattaaggactgtcatgtcttcttaaaggattcatccctttatcatgtaatgctcctccttatctctgatactatccttgctctgacgtcggctctgtctgaaatttgttttgatgattgttagcataatatatatttccccattcatttactgttaacttatatgtatttatatttagggtaagtttcttgcagacaaaatatagtcttgcttattgatccactctgtcaatcttatcttttaattgatatatttataccatgatgtttaaaataagtattgatatagttgggttaatatttatcttatttatgactatcttctatttgttgcctgtgatcctggttcctttttttgtcttctactctttccgcattttatgaatttaattgatcactttatattattccatttcatcttctttttatcttagcatatcagttatatatttttccttggtttcttataagttatttttagtggttgctctgaagtttgcaatataaatttacaactaatccaagtccaccttcaagtaacactatgctgcttcataggtagtgcaggtaccttacaataactccctaaaaataatacttaatatttctaacttcttaaaaaataataattaccccctccattctttgtatcattgctgttattcatttcacatatacgtaagcatacacatatatatgcatttttaataaaaacattgtttctgttattaatttgaacaaattattgtccatttgataaattaagaaaaaggtatttattttactttcacttactcattttctgatgctctttctttatgttgatacaagtttctgatctatttcagttttcttttctctgaagttcttcttttggggtttcttgcagggagggtctgctgacaacacatcccctcaaatttttttttttttttggtctaagaaaattcttatttctctttcacattttaaggataatttcacaggttacagaattttaggttgatgatattttcctcttaatattaaatatttcatttaattcttttcttgctttcatagtttctgataagtcagatataattttatcttagtgagtgctttttttctttctctctagtttctctcaggatttttgtttctttattttgattttcttcaatttaaatatgatttgtctaggtgtaggttttcttagcatttatcttgcttgctgttctctgaggttcctgaatctttggtttggtgtcagacataacttgaagaaattcttggtcgtgggtgattcaaatatttcttctctttttttttaattcttcttctgatagtctcattacatatatgttacactatttgcagttttctcacaattcttggatattctgtgttgttgatggtttttttaatctttttttatttttcttttttggcaataacaattgaaatatccttaagctcaggtagtcttctctcaaccatgaccgatctactaatatgcccaagaaaggcattctttattacttttacagtgtttttgagctctagaatttctttttgtttctgtctgagaatttccgtctctctgcctacattgcccatctgttcttacatgctgtctcctttatacattaaagttcttagcatataaactgtagctttaaaaattcccagtctgataattctaacatccctgccttatctgagtatggttctgacacttactgtgtctcttcaaactgtgtgtgtgtgtttctttttttagtatgccttgtttttttaatatatatctgaacatgatgtagtgggtaagtagaactgttgtaaatagacctttagtaatgtggtggtaaggtgtggtccttaatcataggtctggtcctatgattgagactcggtcttttagtgagcctgtgcctctggactgcaaccttcacaagtgcttctctgttccccctcccaccctcttttacctttaataggatagctagaatgggctgacgttgagtattttccttctcccagttggaaggctagagcctgctggagttgggcatttccctttcccaggtcatgtagactcgaattaacccccagtaggttaggttcaagttaaacagtttccccagggacagacattgtgaagaagaaaagaatagtgtatttcaaaatggttactttctcccttcccctgctggaagcatgaagggatttttttttcctctaatattcactgtgggaatctagttcctcaaggcaaaactcacataagtatgggcacccgcctatgactagatccccctagagtttttgactctcagaattttccacactgagtctccagcaagtcatcaaatacagttcaggttttcctatagcccagcaatagttcccacagaggtttctggtccagtaagttgcaattctccttacaggcgtatcttgccttagagacattgaaggttcagttccagatcacagccacaaagtgaatactgcaataaagcaagccacacatttttttgtttcccagtacatatcaaagttatgtttccactgtgctatagtctcttaagtatgcaatagcactatgtctaaaaaaacaacatgaataccttaatttaaaatacttcatttctaaaaatgctaacaatcttctgggccttcagcgtgtcataatccttttgctggtggagagtcttgcctgggtattgatggttggtgcctgattagggtggtggttgctaactgaggcaatttcttaaagtaaaacaacaatgcagtttgccttatcaattgcctctttgtttcacaaaagatttctctatagcatgccatgctgtttaatagaattttacccatggtagaacttctttcaaaattggagtaaatcctcttatccctgctgctgatatatcaactaggtttatgtaatattcgaaatcctttgttgtcatttcaacaaggtccatagcatcttcaaaaggagattccatctcaagaaaccactgtctttgttcctccataagaagcaactcctcattattttcattctcattttattgtcagattgtagcaatttggtcacatcttcaggctctacttctaatactatttctcttgttatttttaccacaactgcagttacttcttccactgaagtattgaactcctcacggtcattcatgaaagttggcattaaattctttcagacttctgctcatgttgattatgttgatcacctcccatgaatcacaaatgttctaaatttcatctagattggtgaatcctttccagaatattttcaatttactttacccagacccattggaaaaattgctatctatgacagctgtagccttacaacatgcatttcttagataatatgacttgagagttgaaactactctttgacccataggctgcagaatggatgttgtgttcacaggcataaaatcaatattaatttccttgtgaatctcgatcagagctcttgggtaaccaggtgcattgtcaataagcagtcataatttcaaagtaatattgttttctgagcaccagttcgcagcagtggccttaaaatattcaggaaaccatgctgtaaacagatgtgctgtcatccaagctttgttgttccattaataggacacagggaggatagatttaacagaattcttaagagctctaggatttttggaaaagtaaatgagcattggcttcaacttaaagtcagcagctgcattagcccctaacaagagagtcagtctgtcctttgaagctttaaagctaggccttgttttgtcctctctagctatgaaagtcccagggggcatcttcttccaatataaggctgctttatcttcactaaaaatatgttgtttaaatgagaacacatggacaagggaggggaacatcacacaccgggccctgtcaggcataggggacaagaggagggagagcattagaacaaatgtacatgggggttaaagcctagatgacaggttgatgggtgccacaaaccaccatggcacatgtatacctatgtaacaaaacagcaccttctacacatatatcccagaacttaaagtaaattaaaaaataaaaatctgttgtttagggcagccccctttgtcaatgctttcagctagatcttctgaataacttgttgtagcttctacatcagcacttgctgcttcctcttgtacttttacattatggagaagacttttctccttaagcctcatgaacaaacctctgctggcttctattttttcatctgaagctttctgacctctctcagacttcagagaattgaaaagacttagggcctttccttagattttgctttggcttaaagaaagatagtggctggtttgatctattcagaccactgaaactttctccatatcagcaaaaaagacttctttgttttctcaccatccgtgtgttcactataatagtacatttaatttctttcatgaacttttcttttacatttacaacttgctcaactcctcgatgcaagaggcctagctttcagcttatctttgctttcaacctgtgttcctcatcaagcctaatattttctaaattttgatttaaagtgagagaggtgggacgcttcctttcacttgagcatgtagagaccatttgcagagttattaattggcttaatttcaatattgttgcatctcagggaatactgggaggggggaattggggatgaagcaatcagaacacatgtggtgtttattgattaagatcgattcattttgccatcttttatgggcatgatttgtgtcccctccaaacagtaacatcaaaaatcactgactatagatcaccataagagatataacaacaatgaaaaagtttgaaatatattgagaattaccaaagtgtgacacagagacataaaaagtaagcacttgctgttggaaaaattgtgcaaatagacttgtttgatacagggttgccataaacattcaatttgtaaaaaaaaaaaaaaaaaaaaaaaaaaaaaaaaaaaaaaacacacaacatctgggaaatgcaacaaagatgaagtgtaataaaatgaggtatggctatatctgctcctgtctccaaaattttgagagtagatgtttaccttgcaatctcacttctattatgggtctaagaagagttgctggccttctgtgtgttcagctttttacttattgttgcaatggagtgatgatttccaagttcttacatttggggcaggaaattggaagtccaaatatagtattttcaaatgacagaagagcatattttcttcaaaaatatagccagtatcaatttaaaactcaaatgtttaaattcccagatgacgaaattttgtatattttctcttattctgatttgctgacttattcttttacaatatttatactgacaaccaagccctcctccaagtatagccaggagaatttagtcttctgaccaaattcttgttcattgattgaaatttataaagttcataccttttgccaaaaaccaggctcattcttagaaacagaaagacttacaggacaataaacttgccagattatgtggcagattcaggaggaaactctcacaatgtcttttgtgatatgaatctgtatctgaagaagtattcatggacttccacgctatgcaagacattctgacaggtactatggaagttaacagaaaacaaagggcaaggcctctgccctcaaaagtccattatttagttggggagaaaagcctgaaactgaaacatcaagtcatgacataagaaaaatgcaggatgttaaggagtagttgccttataaggtataaaagtggtatgataatacttgccaggagttcatgtgaggggtcgacccttcggccaaaaaggataaggtggaccacaaaaaggacaaagcccttgacctactttttggaagaaatataatttggatacaatgttatgctcatgattcacattatgctatctcacatccagatttcagtgggctctgatatagcttggctgtgtccccacccaaatctcaccttgaattgtaataatccccacgtgtcaagggcagggccaggtggaaataattgaaccatgggtgcagtttcccctatactgttctcatggtggtgaataagtctcacaagatctgatgttttcataaataggagttcccctgcacaaactctcttgcctgccactgtgtaagacatgtctttttctttcttcaccttttgccatgattgtgaggcctccccagacatgtggaactgagtcattaaacctctttttctgcataaattactcagtctcgggtatgtccttattagcagtgtgaaaatgaaccaataaaggctctgtgtgtctttctcttttgaaagtatagaaaataattagagctaactttaattagtaacttactatattaggtattatcctaaacaatacaatgattatgaggttgatctgatataggcaccgttgtcatgatcattttcggatgagaaattgagatactgagagattatgcaattctccttgattcacacaggtcagaagggatgagcataatcaaacctaggcagcctaattacaagtgtacccactttatatgtactctccacttaaggcaacaaactgataagggaggtcagtatgttccaattagcatttaaaatcagcatctccctctaataaatgtctaaattatattaaatctgggagccttgtgaattgtagtggattcattgagcaaactaattaagcatggttcaccatttgctggattgattttatatcacagaaatcaacctttcaaataattatgaaacaccaaattgaatataaactaaaccaggtaataaaaacacactccgatgcttcacagtaaaattcaattattattgctttttgaaactaaaataaattgggcaaagtgtttttgtatttagtctataggaaaatttcttgtttattattcatttgtttatcttagctctgtagcttttatttatttatatgtgtcatttttttaaaaaaatattttttaccagtaaaggaagaatcattaattctaggaaattgctggaaagcaagctctttattgtattctgtactacctgattttatgacttcagatctctcctgaagcatttcgtgagttctaatataaattcaaattcaactgtgatgtattttagttctataatgaaaataaagatgagctgtctttcaatttctggagttaattatctttgttgagttcaggattatgaaaatatattgtagaatgtggagggacaagactgtgcacaagcgagggtatagctattggatagctccaacaaaacatctttcagtgagcagcaataattctccttgaaatcttcactggccctccactccgaagtaatctctcctttctctgaatgtggaaagcggtgcaggatgtatctctattagcattctatcactacttaggttatttgcttacctcttattcataatgaatgtaagcatgagtgcaggaaccttgtgcgtctattttctagaacaccattaggcctgatgtctagagcatcaggctacaaaaacattttggagtataatttatcagtgcccaccttgcatagaaaagttttgatttatcaacatagaagcagagctaagtaataaaactatcacctatgttcatgaggctcagctagtgtgatgaactctggtgatagtcattattcccctaattttcacaacctctaaggtagatacaatctccattttacagattaacaaacataagttattaattttattaattaaatttgttggttaaaactcaggctttatttaaaaaaatagtatcactatttgttgagagacacagttcccaagtcatcaattttactattctggattgcatgtctggcctttgaatttgttcagtaataattagtgttgaacctcaaagccaagctattaggctacctaaatctagcaaaaaccacctctttttaaaatataaatatatgcagaacacatttatttactttaagaggatcacaaagtctagtttcattgatacatctcatgtttctcagtattttttatttattccttaatttatggaggtaatttagaaaacttaaaaaatacatcattcaatggctttaatagattcacatagttgtacaaacattgccacattgtaattttagaacagtttttctttttttactgcaaaggaacttcatgcccattaatagtcactcttcatttactccacccacgtcccctagccctaggcaaccactaatctactttctgtctctattatgtatttgtggtctttttgactggctgttttcacttactataatcaaaaacttgtgaagtttatttaaaaacatgtatttctatacagacacacacattcattctaatgatattacccaaagaaaaccattgttgtttattgtttggccatttcatattgtggtccatttccatgtgttcaaaaataaggctgtatttgatataacagagtttttacttaattacactgaacttgagattattcaagctaatataaggcaatagtagcataggttatgatcaagtcacttacatttacctttgggatatactatgtgtagttttgacagcgtgtttgcttaaataattatgttcagctagagtaaagtcaaattatttttgaattcccctagcacatgtcaactaggactagatagagatggatgtaaagtgtcatgtcaagcagaagtcaccataagattaaagtcttattataaataatccacaatgtgaacaatccaactatagataaagaattttgactgcatgttgtataactgccttattagatgctgaaaaatgtggacattaatacttggatggaaattgttatcatgattaataacaatgagttgtggcaattttacaattaagagaatgttttggggatccatgttatataatgagggtctttgtggaactttgataaaattcattcttctagatggaattacaactgataatcataatatagctaacatgtattgagtaattacattcccaggcactgctgtaatggttttacatgcactcagtaatttaatcttcctcataacgctatgagactcagattaaagaaagtaaatttcctatagaccaccagcaagcattggtggatgtgcaaaatttcttaattccatactttcgttttcaatgtgtttttgacataggataattagattattaaaaattgttttctctagtgaagaaatgctactattcctagtaccaatagaaacccttgtttccctttgaaagaaatatggagcgcctgaggactagataaccaaggttgcctgaggaaaggatcacaataacagtaggcaattctgtcccaagaatgagtgcttcttaaaacataaaatagttttaaaaatttcttaagatagaaaatgtattctcagtcagattttttaattttgactttggttaatcctaaaatttccgggctaacaatggaaaaatgtttcttaaaattctagccaaatgttttcatttattcaacagagttagttagtttgaaattcttcttgaatgtctcagtattgctcaatcaaatggaatctaggttagactaacaaatattgttgacattgagtaagaatgccatagagtgcagagatgtggtaggagctcagattccactaatccacaatattatgagtcatttaacacaaattatcgtcatttcagcagaaagtgtttgtacttaattgaagtaagtggtcccattcaaaatctttctttattcagtctcttcaatcaccaaagcaaaacaggatatatgcatctttgaataaatatctgatttattgtgtatctgttaatttatatagaatatattaatgttaaatggcaaaaactgcaattacttttgcgtcaacctaataatagattgtttaataaataatagtgcacatatttgtgataactataaagacaaaatagctaaaactaaatcgatgatatttgacctatgtagctaaattaagcctgtgtctttcatgtttcatacataaattctgagagcacatatctagaatatgatatcataaacatcaaaaatttgaaaatcactttcgtgttagtctttagaaatagtgagaaactgtgttttagaaataattttgttaaattccattagtgcactgatataaagctaactgatagaattatttccaaatatttatgtttagtcaggatctgagctacaattcagtaatggaaaaggaatcgttggtaatatgaaaatatttatcagtgtgtatttcataatattacagtgcttttgacattgataaagtaccccttgctttactacatgttgcttatcactggtaagtagtgtgttaattagcattgcatatatatatatatacacacacattgcatatatatgtatatatacatcgtgcgtgtatgtgtgtctgtgtgtgtattgttaaagctttttttaaaaaaaaaaatttgtacagaagaagactcagacttggctcatactcctgggctcaaatgatattctcgctttggcccctcaaaatgttgggattacaggcatgagccactgtgcccagatcatcttaaagctttaaactaaataagtagcaatgataggataagctttagaaataaatctctgtagggagcattctcataatgtgttctgtcttgattaaccactaaagaattttcttaatgcatattttaagcaggaagagcagggacataggcactttatacaaaaataaattacatatatttagtacagatttttatgttgcaatcaaatcctagatagttacacagaagtaataagggtgcagttgtcagttaaaattgctagtttttttccttttatttttagttgacatgtaataattgtacatacacagttatattttaatatatgtgtatatgtgtaatgatcaaatcagagtaattacatagccatcaactcaaacatttatcatttctctgtgtgtgaacatttaaaatcctcttttctagcttttcaaaaatatacactaaattattgttaatcgtattcatgctgcagtgctacagaacacttgaatttattccttccatttagctgtaagtttgtattcattaattcacctctccctacccccactcctcccattcttcccagtctataataaccacaattctgctccctgcttccatgagctcaattttctttagctcccacataggagtgagaatttgtggtattatctttctgtgcctgacttatttcacttatataatgtcctccagcctcatccacattgctacaaataatgggatttcattttttcaggcagaatagtattctattgtgtatatgtaccacattctctttattcattcatctgctgattaacacttaggttgactccacatcttggctattgagaataatgctgcaattaaaaggggggtactgtttctcttttatatgctgatttccattcctttggataaatacccaatagtagtggagttactggactgtaggatagtcctacttttagtttttttttctcagaaacttccatactgttctccatagcagctgtactaatttacattcttgtcaacagtgtataagatttctcttttcgcttcacctttgctagcatttttttttttttgtctttctgataacagctatcctaactggggtgagatgatatctcattatggttttgatttgcattttcctgatgattagtgatgaacagcatttttccctatacttgttggccatttctttaaatagattaagaagacaaaattttaagaagatatttagagaaaatgtagaaatatagagtaaaatatttgactgtgggggacatgaataaacgtaaaatataaaaacatggtttatgaataacagataatgtaacacaatttggtgctcttttcagtaaaatatatgtctgtatccaatataatttaagtgtactatgatcctagtaaaaatatttaaagatcttatttatctcagttttctagctctctcaggaaaataatttttttttttatttttaattttaagttcaggggtgcaagttcaggtttgttacataggtaatcgtgtcatgggggtttgttgtacagattatctcatcacccaggtattaagcctagtacccactggttacttttcctgatcctctccctcctcccaccttccaccctctgaaaggccctagtgtgtgttgttttcctctatgtgtttatgtgttctcatcatttagcccccacttataagtgataacatgcaatatttggttttgctgttcctgtgttagttggctaagataatgacctccagctctatctatgtccctgcaaaggaaatgatctcagtcttttttatggctgcatagtattccatggtgtaagtgtaacacaatttttttaatccagtctatcgttgatgggaatttgggttgattccatgtctttgttactgtgaatagtgttgcaatgaacatatgcgtggatgtgtctttataatagaatgatttatattcctttgcacatgtgccaagtaatgggattgctgggtcaaatggtatttctgtttttaagggtgtaaattaattcagccattgtggaagacagtgtggtgattcctcaaagacctaaggagaaataatattcaatttcttggaaagagggagacactctgctcttcccatctatattttcccaccttgatgtttaaatagaagagggataatgaaattatataaggaagcaggtgagtttggatcccatactctcataagaacagagaaatagttacaataggtggcatttatggaatggtatctatataaacatagtatgctctttgttttacatgccttaactcataagtcagtattgctaaagagaattcagtttcatagctgttgtgtaaatgagaaaatactattctacctctattatttattaattcataaaggggaagcaattagtttatatgccagtgaattaggtttcgactggaacaagtgtaggaagattaagagcaccagaacctgaaaactaaaatggaagtagccataccaatgtgagatgtgaaagtggagataatttattttataaggtaaactgtgataattagttacttctttatatttagcaaatattaaatgatacttattagtaattatttagaatactaaatcttatttttaaatgactgggaattgtaatacaccttctagacactttgcttttatcatgtgttgattaatgggatcttattaaactaaagagcttctgcacagcaaaagaaactatcatcagagtgaacaggcaacctacagaatgggagaaaatttttgcaatctatctatctgacaaaaggcaaaatccaaaatctacaaaacttaaacaaatttaccagaaagatacaaacaaccccatcaaaaaataggcaaaggctatgaacgacacttttcaaaagaagacatttatgcaaccaacagacataggaaaaaatgctcatcatcactggtcattggagaaatgcaaatcaaaaccacaataagataccatctcacgccagttagaatggcgatcattaagaagtcaggaaacaacagatgctggagaggttgtggaaaaataggaacgcttttacactgttggtgggagtgtaaattagttcaaccattgtggaagacagtgtggcaattcctcaaggatctagaactagaaataccatttgacccagcaatcccattactaggcatatacccaaaggattataaatcattctacgataaagacacatgtacatgtatctttattgtggcactgttcacaatagcaaagacttggaatcaacccaaatgtccatcaatgatagactggattaagaaaagatggcacatatacaccatggaatactttgcagccataaaaaaggatgagttaatgtccattgcagggacatggatgaagctggaaaccatcattctcagcaaactatcacaagatcagaaaaccatctgcatgttctcactcataggtgggaggtgaacaatgagaacacatggacacaggaagggaaacatcacacaccagaacgtgtcgcgggggtaggggggtaggggaggaataacattaggagaaatacctaatgcaggtgatgggttgatgggttcagcaaaccaccagggcacgtgtacatctatgtaacaaaactgcacgttctgcacatgtaacccagaactgaaagtataattaaacaaacaaaacaaacaacaaaaaaagtgttgattaacaggccgggagcggcggctcacgcctgtaatcccagcactttgggaggccgaggcgggcggatcacaaggtcaggagatctacaccatcctggctaacacggtgaaaccccgtctctactaaaaatacaaaaaattagccgggcatggtggcaggtgcctgcagtcccagctcctagggaggctgaggcaggagaatggcgtgaacccggggtgtggagcttgcagtgagcagagatcgcaccactgcactccagcctgggcgacagagtgagattccgcctcaaaaaaaaaaaaaaaaaaaaaggtgttgattaacatctagcttattatttatatatgtgcatatatataatatgttgagcaagtagaataaaacatttctgtaagacgtgaaactgattttatattaatacttttttttctttaaaactgtttttcaaaactctgttataatgggatacttctagtaggcaatcttcaattccttaagatacttggttagaccattgtcatcatggatggaacaggcttgaagagagagttgcaatttgccttcctaacctataatggccacaacattagtatcattacttatatgtatcagtacttatcaatgaaaaatacatctatgtcatttattgtatcatatgatgtataccacatcagaatcattacttgaattaaactagtggtgattcaaccttctctgtcacctcactttttctttttatcgtgagaaatttccatgaacttattttgcaaattaagtgctttttacaatcaatgattagactattattagtaacaacttgcttgtcataagttttacaacttatcatagcacagcagcatatcaagaaatttgagcactgcaactctaggttacaaattattatcaacaaatgtagataatgtcaagagaatacgaatttaatatttaacaatgaaacatggagtgttttgatagcaaagaaactaacattctcttctgctcctaaggtgtaggcagtctacttacaagcagagaagaagcaaatttacatgactatatgtgtatatacacagacacatatacatatatgatatttgtgtctttgttgtactcattgaactgcatacaagtgctttttcttaagccaagttttcattaattaatatactagattaaattagtgaacattaccatatataagcagagaatatccagttttcaattacttgtttttattcttctactcaatcatagactgttgattatttagaagacactataaatatttcaccttggtcataataaataatgatctggtcaagtaaaaataaaaattaactgatagctaatcttgttatagtaataaacaatggacatagataaaatacatatgtgaaaaaatgaataaacaaatgatgcagtgtgtagaaatacccactacaaatttaaatcattttcgtagtgaatatatgatatatatctcatgcatgtctgttgtacctatcaattcatgaatagtgagatacagagacagatacacatgtacatttatgcagttgtagcaattgaacctgtgctgtgtgtgttctataacaatattatattaagtgaatatagtcaactcttgattttatatatatatacccttttatgatcaattttaattttaattctgggatattttgccctaagtatataatacatttctggcacactattcccacttcccaacttgcctattgtcagtcagagactacaaggcaatttagtatcaccaaagcaaaacaagattacaaaaatgaaaaatctgccatttggtattatctctatacttctccctatattagcagagaaaattgacttgatgtctattgctgactcttccagaattgtggcttcagcatagctgagtgatttcatggatatattagccagttggcttgaatattttacagcaaataagcaaaaactctcagtattagctttttcattattcattatctttatgaaatcatacactcttacattaaagtaggaacccatgttacgacacttactttactcatgaagaaactgagactcacagattagcatccatgactgactaaagtacaatttataatagcagatctgagagtagaactcatttttttcatctctatgcaattcattcaacaatcaatcagtaaatatttatagaaagtaatatgtattgggctctgggaaactcatctattattacaagaatcagaaagctaaaatgtaagcaaatatatttggaagataattacgtattaaaatatgtactatgcaggaagctaacaaggtaatttgtaaaaagtgcgattaacaggagaagttgtggtgatgcagacctactgaataatgggagacattttccctaaggagatgacatttgatgggagaaccgaaaagcaaaaagtagtcaaccacaaaaatttctgggagaggtacattctacatcaaaggaacaggaaatacaagggttcaaggttaagaaagaacatggggacttcaagaaacagaagagaaattaatataactggcatattgtgatgggggcatagtagaagatgaaaatggagaagcaggcatgagccagatctttgaagcccttcatgccctggtaaaaaatatagattttattcagtgtgaaatgggaatcctctaaagatctttaagcatacattatctgatttgaattttatagagaatgttctgactacaatttgaagaatcaattgtaggaagcaggagtgaaaaccattgctgtaatgtggatgtgaaattaagacttggactatggggttgacaatagagttggagagaagtcaagatatatgtttggatttaaaatcaataggatttcctggtcaggtggatatggagagcaagataaaaggaaatcaagggtgatttccatatttctagtctgagcaattagatagctacaatgtcagttattgagaaggaaaagactaggagaaaaacagaaatgggagagttattgatacagaattattttcacagtatgtgaagatgctaggtcaagagaaaatgtcaagtagtcagctggaagctcagagacagggaaatcttgcacaagttatacatttggtagtattgctagacaaagtcctcattaagatcaccaagggatagtctatataagtaagagaaggtgattcacgaccaatccataggtattttgtaattaaagaattagagtgtgcctatggaaagggcacacatgaaaggaaaataagaaaggatagccaaaggtgttggaggaaaccaagacgcactgaatgtttctcttcattccttttccctttattgtcctagaacaattattaaataattactgaaacatttttccacagtttgatttcagtaattattaaataattactgaaacatttttccacagtttgatttctaactctcattcctttattcctgtttattctctttaagaacctctataagaggaagttcattattcttgtccattattgtagtctcaccttcagtgcagtatctggaacatagcagacactcaagaactatttggtcaagaaacttatttccatttttgctgctgttgtttttattcctactttgtttcttttctcaggttatcctgtttcaagacctctaatggtctgatctaggtctcaggggtcccctctggcttgttttctttccctagcaggtataaaacaaattatggatgttgttagttaagagctacacttaaacagattaaaaatgaaggagaaatttagaaaagagcacaattcatgatttcactagtaaaatattattttgtttctttctaaattatgtaaattatatctaaggctgtgtacagttgctcatgcctgtaatcctggcactttgggaggccgagataggagaatcacctggggcccgagaccagttgggctgcaacatagtgagaccctgtctctacaaataaaaaattagccagacatggtggtgcatacctatagtcccagctacttgggaggctgaggtgggaggatcacttgagctcaggagtttgaggctgaagacctatgattgcacccctgcactccagccctggtggctgagagagaccttgtctctaaaaaataaaaataaaaatgaaaataaaaataaattatactcgtgctgtccgacattataaccactaggcatatgtagctattggtcacttgatatgtggctagtacaaattgtgatgggtcattgtacaaaatattccagatttgaaggcattactaacaaaaaaacctaaaatatgtcattattaattgaatattatatgctgaaaaggtaatattctggatacatttaacaattactaaaattaattgcaacttctaaaatttgtttaatgtggatactagatatttaaaatcaaatatgtagctccctttataatttattataattataataaacagtatttggatagtactgttctatacttttgatacacagagcaaggaccttagatgatttaggtacgactcagtgtattggtaggcatgtaaaatctcaggtcgtttttcaggcctatgaataaaattctgtgttttaagaagatccccacataatttgaatgcatgctgaagtttgcaaaatgctgctgtatatattgttgctgtctccaaagagcaaggtgtgattttgccttcgaacaatgacatatccaacctcatttccgatgtaattcagactaaaatctaaaaactgcaaatcctacagtgatgcacagaaaggttaatatcaagtgtgaacccagcttacaagccatagttctgcattttcaactacaagggttcatgtgccatactttggaattagtgcaagcaaaagccagctcacattgcttgtgcattttgttacctagagagatttgcatttagcaaatttagctcagctggcacttataaaaaagccattgccagaatgcctgagaaatttagtctcttgtatggtacttagagtggtcagcaggaatgttagcagacaacatctcatttttgcaattaatctgctttatcactacagtgtaatttaaaagaattttgtctagcaggagtctttttatttgctgggttgtgattttttccaggttatatgttattcccatgctaatatttgccttaataataatgtgtggactttaatataaatatgattttgcagcagcatattaattacaaatatgttgcaataacttcaagaacccaatttttgactattttatctttacatttgatttattagttttgtagattcttgatttgtttagatagggttgggagagtagagttcctttttaaaaatattaagtctatgtaaacatagtcatgccatctacttatttgcacttgaggttcagaaaaaaaatgttatgagaatttaaaattttgacttaattaatttatttgtataatattttaccttaaaaataattgaagataattgtgatatatcatatagatcacatttcaccatttaatatgattcagtacttaggcaatggaagcagaatttagaaacctctctttattggaattgaattatattaaaagaaatgaaaaataagttattaacacatttcctagaatatgcatcccttatatatttgttgttatgtagtagaggctgtcatttatcaattaccctctgtagtagacagaactaggttttaggagtcataatttttatcatttgttttgtttttcacaatacaaatgtgcaaatgtcaaactcctagaaaaatacattattcttcatatatattatatcaatgatataaaaactgagaattattagacctatgtgcaatgtagaaaagcattgaaactcatttcaaacatagcataaatgtattcaaagcattattgaggaagaatgaataatatgggtttgaaaatgtggcaaattatcccaaaaatatgtagctacttacccagctggcatcatggccacacaaacaaaacactgttcccacattgtttcacttactttccatggcaagtctcaagggcagtcatatcttcattcttatattaaagctgaatttcagaaaagccaagcaaattacccaagggcaaataggtaactgaaataaaaaatataattcatttctgtctcatttcaatgttgataatttgctcattacccatgcctcaataccagtcaaaactcaatatttctgtatctttggtgtcattttaaaatacttccagtatgtatgtataatttagtaggaaagtttgctgaattatacctatatatatgtgtgtgtgtgcatacgtcttaagatattgacagtcccaatagaataataattatttagttcatttttcataaaacattaaaatcactgccaaagtcactgatgtaaacactttgtgacataataaccactctgttccttagatgtagcagttaatgcgtgcgtattattgatcattatctagttgtaacagtaaaagtaattgtacacttgagtaattcttgtaattattattagatgtattccatgtctacacttgtaaatgtggaaagcatcaatagttcaaaagttttaatcaagggcagagagattatatctgcggctaaccctcatttccaaggcctccatctctttatattgtatctttatggattaaaagttaatgcagtttctcagtgcctgcatcaccaacaaatcacatacagtgagttgaagctggatttgtgggaacaattactgttggttgtatttattatataaatacatttgatgattcccaacagttctggagagacatggtcttaataattcaggaaaatattgggaatgcattctctaaaaacacagctaatcaatacaatatagagactaataacaaaatgaataactttttaaaaattatttccattttaattctttgttaaactgggaaaacgcacatctatgcagatcaacaactgtaaatgattttaaattgtgcaatgtggaagtgaacgttgctgagtttgcccaggacaaactgtgctgacatatgggaaatttagtttatttcagtttttacagaaaagtatcttcacagtctaaagtactggtaaaaaaaaaaaaaaaaaaaaaaagaaaaagaaaaaagaaaaaggtgactcaggaatcaacacctatatgtgataagtaggagtctcatttttactcccctactcaactttctctctgttagatgtgataatgaactgtgaaatggtcaaaatgagaggaagaaaaaaggatgcggctaatttccaaactagatagtgtcaaattcagagttgtctacagtaacattagctcttgatatttgtgataaacatgtgatgttgcaaagtatataatattaccagttgaatagatgtagttatatgaatattacatgtaaatttcttttaatcattttagatttaaaaagttgaggtacgttcagattaatttatgaaaatgtcattttagcaatgacatattatttgagtgattaaaaattactcaaattcaattgaataacctacataagttctaaaatcatcagaataattcttcacacttcccattttatcagtttacacacctgatttggtcccaaattctgattcttctgctctgccctttcatcctcaccatcaatgccttagttcattttctcatcatctttcaccaggatttttgcaatagtcttctgcctcctctcaaacattctttactcatttgattccccacattgcctccatggacattcagattccacttattgtaaagtctgctttttcatagttctttggctaaggtgttgtgtagggtaataaagagagaaataaaataataatagatgttaagcagagccatgtattaaaagttgcagattattttaagaaataatttctacttttttaatttaacaaacactcattaagactcattaaccgttctcattaacctttagaggatacataaattatactatatatcctattctgaagacctccaagtagagaggaagcatgtattattgccaatgccaaaaaatagaaactatgtatcaaactgggtcagctctgattataggaagccaagtatctaccgtcaatcagagataggaaggaaaatctccctcatgtgaaaactaatggtggttttaggaatattcctatctgggagtggatggagaagagtgtatcaattaaataaagtgatttggcacacaaaatacaacaatattgatatataacagaatacaagaggatgggtaattaatcatgaacagaaatttatttcctacgtttgctcttggaaaatccaagagcaagttcccagcacctggagaggaactttttactgtgtcattacatggctgaaggtgaaagggcatgcaggagtcagttccatttttaagtgcctttttaaggttacctaagcccattcacaagaaaggaaccctcatgatctattcagctcttaatggccccacctcttaatgtcatcacattagcaatacctgaattttggtgaggacatattcaaaccacagcagtaatctcatgatgcatttacatcatttgacatatctcatttttttgtcttcaaattatcaaatattcttttataaacatatagtatatgattatgaaattttcataatttctaattcattttagtctcataagcaagaaggaataattcattattataatttcttatatatttcagttagaaccctttaagatggaaaacacctatagttagtgcctacatagataaattaagtagaaataagtcaagttttacagatttgccttatttgcctcctcttctaactccaactgtccaattagtctctactataagggcacactgaaataaaggtaggaaggctttactgtcagaactctgtatatgtttattttatgtcaatgctaagggggttcttttaggtctagtgaactaatagaaaacaaaactaaacttgaagaaagaagcaatagcctgtaataggacagagactgggattttgtgccgataactcaacatgtaactttggacagggtacataacctctttggccctcagtgtttttgattgataaaataagaaacttcaatttgatcatctgtgatgtttcttctaattcaaataaagtacagctataaatatttttcataatgaaccaaaattgactttcacaattagccagtttacatgatatataaaaacattgtcatccttctatttttctcatatgtacttgtctcttttttctaaattactggaaactcatactattcctctactacatttttcctctgccaccatagagttacatcagtctttgaacagaaacagaaagtgcagaaagcctgtcactaacgtgacctcctcacagattttgaattattacctcaagaagagggaaagttggaacagcttatatcattgcagaaagatattttacctgtctacatacaatttttctgtgatatagcttgtttactctttgttagagaaagactggcttgtatctttgtgtcttggacacagtacagttgctccatcatttgcagtacagctaatactcatttgggtaccatgcatggatacatctattatctcactttgttttcaccataaacctccgaggtagagatgaccattttcctcatttcgagtaaggaatccatggccaagagaagtgaatagcctactgattccattagctaaactaaagactatttgaatttcaccagatgtccttttctgttctagaatctgacattgcacattgtgtttggtctctggagtctcctccaatattcaacttctttttttttttttcccagtcttgacaattttaatgagtagtagtcagctagcttctttgttgagtctttttcaatattagctttaaaattaaatttggattatacagtatgggcaataaaatatcatagaaatgatattttttctctcactgcttcttggtaggactacataatattaacaagtcttattactgattgtattaaccttgactaactacgtttaacagtttttctttactgtaacactgtgattctcctctttgtattggaaaaacatatgagggggaagtttttgagactgtaacaacagcctgataccttgtttctcctcaaatgtttgctcactgatttcagcatccaatgatagtctcatctgcaacaattattaccgtggtttttgccaaatgatattttatttttataatttcttatatatttaatccaaaataagggtaattttttttttttttttgagacggagtctcgctctgtctcccaggctggactgcagtggcgcgatctcagctcactgcaagctccgcctcccgggttcccgccattcttctgcctcagcctcagctgaggactggcctcagctgcgactacaggcgcccgccaccatgccgggctaaatttttttgtattttttagtagagacggggtttcaccgtgttagccaggatggtctcgatctcctgacgtcgtgatctgcccgcctcagccttccaaagtgctgggattacaggcgtaagccaccgcgtccggccggtaaaaatattttttatatggtctcctttatctctagtcaacgttcttctctcccctcttctctcctgaaagcatgacaaaaaaatgatttactgcatgatttttatttccagaatgaatgaaggtaacatttttgatgactttgtcctttaaaggggttaagatattacactcttttcaatacccaaaggcgaactgtaacattcccacaaatttgagaaatattccgcttatgattgagtcagatgttgtcactcagccacaagttatcttccagagtttgaacttcctattgaagttatacatcaattatagaagctgactgaaatattgccatagattatatatgtgataggttctacatctgaggaggaaagcatctataatacattttcattaaagcagctctcaattcaccgtctgcttaattcctacattctcatgcatataacttatgagcagttttcaaaaaatgaaagaaaattgaaaatgtagcacagccaaggcatgcattggtggaacaggtaaaattgatttttatatttgcttggggacatggatcacttccctgaatctggtttgcattgatcagtgttgatggactatagattaaatgtcatacataagcccccattttcaaattcattatcctcaagggaaaagtatctgaagaaggatggactatatttataatccatgccaatatcaagatgaaatttgatacatctgaaagtgagaaactctaggaagaatactatttgtattaataagaggtaaaatattttcaataaagagtctattttttgattaaatcagccaataagtcaagaaaaagtgaaaaatatatgtgttgagggtctactttatacctctctgcacaatgagatatagggtttaaccacagaaattctttctatttaaatgttggtcatggtaggcacaggaaaacaaggaaagtggcaaatactgaaagtcagggttacttcctcccaaccctagaaaactactttggtagcacaccactggcgaatagtgtagcaatgttaactttctggtttccatgattgtgctaaggttgtgtaatttattaatataaaggaatgctgcctagggggtatatatgaactgtgcactgtatttgcaactttcctgtaagtctaaaattatttcaaaatacagacttttttaaaaagctgtaacagaacaggactaaatattataaatactgtataacaataaaataatttatatttttaagttcttatgttctgaagataacgtaaagataaataaagtccttgtcctcaaagattcattgcttaacatagttgagagctcttagaaaatgtggacagcttggtgagttgacagaaactgagtggtatagggtctttccttccttctttttgtcccccaaaagcctcaaacctgaaatattccaggagttaatagaaaaataatgtatacccttgaacaaagttttatgtgtgaaatttcagagtagattcttaacaaaggatggaaactgtgcaaatattattgtgtctatttataactgatttacattaattttcatttatcaagtactgattttttgccagctctcctggttcagaaaggaaattactgttatactaaacttacgagtaagaaatcagaatctctaaaatacggtgactgataaaatttttttttagtaatgggaaatggaactaagatttgaacttcctcaccattaaagaaggtacaggcaatgttgatagccacagcacaagacagaagggtaactcttcatgtaatggcttcactgagaaattgtagtgcagcctaaatggtgtacactcagtgaaattgccagaacagtgaggttcctttgtttcaacaactattatttataatgttgtgggggtgggaggaggggagagggatagcattagggagatatacctaatgttaaatgatgagttaatgggtgcagcacaccaacatggcacatgtatatatatgtaacaaacctgcacgttgtgcacatgtaccctaaaacttaaagtataattaaaaaaaaataaaaataagaaataaataaatgaaaagaaaaaataaatcctattgatgctagaaaaagtaattatagttttttcttctaatgagatgatatggtttttgaaatattttattgaatgaatttagacttagagattgtcatttttttcagaatattaaaacaaaaaatatatacttgtagaacttggcaaatgccaactctctctaattataactgttaaaatacaaatactatatggtaccgagaatgggagtaataaggcaatatttaattagatatctgctaatatcacatagatgttatgttttgtgcttcctcatgagatgtttgagggatttcagtgatatgacattttttcttcagtgcatattgtgttacagacttaaaatttacattaattgatcaattcaattatttatttattcaattcatttattcaataactattcatattggttatctatggctgtgtcacacattattccaaaattcagcaacttaaaaccacaaacatattaccttatagtttttttgagttaaaaatccaggaatggctcagctgggtgcttctggctcagggttcattacagaagctataatccagatatcagtaagggcttcagccatctcaaggctcaactggggaagcatcaactcttaagctcaaacaggtggtaggcagggttttgctcttcaaggactgttgtactaaggcttcagttccttgctgcttggtggctgaaaaccagtgtgaatcgctctctaaggcagttcactacatagcaactgatttccttgagtgtgggcaagtcagacagcaagaaaaaggaagcaagacaaaagccagactcttcttgtaatctaatcttggaagtggcatcccttatttctgctatattttatccattagaaacaggtcactagatccagatctcacttgaagagagaggattgcacaaccatgaatcagagatcattggggacaatcctacaggctgcttatcatggtatttattacattttaactggattacccaatttatagacacgaaaaagattgatcatggttttatggaatggcttaacttatggtccctatcctagaagtaattaaaatccctggaagaatatagaaaaataaatggataaattctaacaataatatgataaatagcataattgtggaataaacaaactgacaaaggaaaacatgtggtgtgttattcactctatttgggaactgtaaggtctaaagagaaaatggcataactgatacatgaagagaaacagcctcataattagtatcaaggtattctgtgtttcctataatattttaggtcaacttcaatttctaaacatataaacaatgatctttaagtatatataaaaatccctggccaggtgcagtggctcaagcctgtaatcccaggcatgggaagccgaagcgggcagatcacgaggtccggagatggagaccatcctgactaacacggtgaaaccccatctctactaaaaatacaaaaaattagccgggtgtggtggcacacgcctgtagtcccagctactcgggaggctgaggcagaagaatggcgtgaacccgggaggcggaggttgcagtgagccaagaccatgccactgcactccagcctgggtgacagagcgagactccatctcaaaaaaaaaaaaaaaaaaaaaaaaaataataataataatcccatagctattttatatgtgtgtgcatgtttatgtgtgtgtatatatgtatatgtacacatatgtatgtatatgtaaacatgcaaaatattccacaaaatagaatgagagggacatgaagttaatgcagcttttatgaaggaggtggtgactccttcaccgagatggcttatcatataagttagattttctcaaggtttgcatcccaataaaaaaaaggtacgataggttttaagctgtataagtgaatgtataactagtatttgatgtcattttactaattatcaacacagctgctctggtctgaaatttttaatgtcatgacagagctaattttaataaaaggtaacattttatgaccccaaataaattacacaccaatatatgcatctgctgcactaaagtaccataatattaacctgttaacaattgagccaaaatctttcacacaattcatcataatttatctgggtgacatatgactttcagatgctacatctctttactgaatgttttgaaaattgagctaagacaaaaacatccgtttatatgaaagaaagaaaaaacatacagaaatattgtaagattctaagaacatttatttaaaatgttcactttattaagaactaggcatcaggaattgaaagaaaaacctagatgggaggaatttactgaaatctccgtgttaaaaaagagagcatagcacttgtctggctttggaaaatactttcacagtaatcaaacaaaataaagacatttgatagcaaacacttggaagtggaaataggctaagttctttaattttttatgtaaccttctttatgttggtgtatagcaaaaatacatgggtccaaaatagagtggcattcatcttaacattttctgtgtgtgtgtgtgtgtgtgtgtgtgtgtgtgtgtgtgtgtgtgtgtgtgtgatatatgtatatatatatgtacgtagatatgtgtgtgtatatatatatatatatatgtgtgtgtgtgtgtgtgtgtgtataattttttttgagatagagtcttgatctgtcacccaggttggctcactgccacctgggttcaagtgattctcctgggttcaagagattctcctgtcagcctcctgagtagctgggattacaggtgcacgccaccacatcctactaatttttgtatttttagtagagacggtgcggggattcatcacgttagccaggctggtgttgaactcctgactacaggtgatctacccgcctcagcttcccaaagtgctgggatgacaggggtgagccaccacacccatcacattttctggccatttttaatgtgttagtaaatgctacgtatatttacattgcaaatattataccctgtatcatgataatttgaaatgactgaagaaaaaaaaatgaagtccaatactttcacagacacagagacctaaatgaaagaacaaaagatgacagccctagaaacggatttgatggtgactactgaaaatatacaaacacaatttccattgccctctagaaaagtaaaaacataagcatgatagctctaaaaaagacaagtctgaatgtactttagttcaaattattctagcacacatattgtagtattgttactaaagaatactataacaaaattactattatgaaaagtgggcaataatgatgataatggtagccatcttgaatgtcagctcaatatgccaagaattacactaaactctttatatattttctgcattacggacaatgactctgtgaatagggtattattgtttcattattttttatgaatttaaattacctgagatttatgaatattaagcattaacccaagtcacacagagaattggtgtgaaaccctgactttgtttaaattttaaagctcagaatcttgcagggctgtaataatcatggtttgcaatactcttgaagattcaataaaagggatttataaaggacatatacagactatcaggacactcttggcaaaacataaaagtaggccaaaaaaattactgtagtctttgtttttgaatctcagagtaaagcatagtaagctatcaaactgacgataagtgtgaaatcatgaattggaataaatgtggtgtaaatgagatatcattatctgacgaagtccacaccatagaaattaataaaccatctccgtgcaaataattaatgctgtttaaccacccaaagggtaaatagaatgtgaatcgaatgtctcaagttggttttatttataagcagtaaacaaagttaaagaatgttgctaagtataggataggcaacaattaaaaagcaaggaaaatgcttttctgagatctgctacacatttgtagatctgagtttcttaaaaaggattttatcgcttgccaaacgttgtagaaaattaatgaataaaaactaaatttaaaacaactaaaaagtatcaggagactgacagctgcacctgcgagtaatttaggcctgagtacaaatacacaaaagttaggaattaaatccaaatgacattttgaaatttactcttaaaccaaaacaaacaaacaaaacacattaccacattacaggatacataggagtgatatttttgaagtttttttaaatacaaaaatgtattttccaatactttatatcaacgtatgtgaggggaataagaggtacattggcaaaggtaaattgcactgtctcgtagccctgcacctttgtaacatttcaggaaagtcagtggggatacccagtaacgatgactccttttctgtacaaagttgcatcaggtagaagaaggcaaacccagtttaaagaactgggttgcctgtaagaccatgtatctttacattttcactatttatctcagaggatgagccattctcataaggtaaatacgggacttttccaaaccacttttatgagtgggtcaaaggttaaccacaaaatttaggtcagaggggggcattatagtgatgtctctgagaatggatgataaatattgtttcatggcaacttcagatttatttaccacaactcctcatcatttctaggtgcacaaataatgcaacaattctatgacccctggagcctcaaatgtgttgaattattttatataatagctaggcactgatagtatagttttgtagttttaaagtattatctggagttattttatttggggtattatctttataaaatgcaatgtatcttttccattttcctttatcttcagtattatattttgcaatttcatattgtgacttctatataataaggaataattagtgcacattagtgaaactcatctttatttgtgagaatttccatttaagcttggatcaaacatgctggcacatgactgcctttgattttacctgtaaaacaatagatttttgtagtccagtgagcaataaatgcttcctgcctctcctctatatttaccagtagataataatgaaatgtcacagacttgaacattattaaacttatatttgagatgcctttcagaatttttcacgtttcctgctgctgtctgccttttctcctctttgttgtgtctcataaatttttatgacctctttgcgttggaaatctgtaatttttcccagagctctgctaggtaccttctagcagtaataaaactcttgtcactttccattgcagctactttcagagtgaggcttactggcttcactctgcagcatattagataaaataatcaatatgctcaggttgaaaaattaaatgcagcatttgtgtatccatcgaattacagtgctttgagcttggaacagatggccttgcgagacatttgctagcttacttgagagtggctatttttttttcttctttttgtttgtacttgattttgcatttacaataataataataaaagaattgcccaagatgattggtataaaattcatttggctattcttgaaaaacaaagcattgtaagtaccaaaaataatagtagcattaaaaaaaaaaaacaaaaaactttctgttgaatgcagttactttctgagtaaatttacagtattctcttcccttacatttgtgaactttatgtgtgcttgtccctacttacctcacctctgtttcttacccaatgtgaacttatgtgtggatgtaatatttctattataaaactattaaataatagggaatacaaaatttttcaatattgtggagttatgcctatatttctttttacccaaaataaattaatgttaaaattaatctccatctcttctcccatatttctctttcaatctagtcatgatactgtgttctttacataggcaatttggagaggatggttaggtgtttaagaaaatgactgacccattgtttccacatagatctcaggtcactgattattctgtgaaatttggacaacctcaaagactacagagcattgaattaacttacttgttcaacactatttgttaagtatctattatgagtcaggtagacatttgttggagggtcctagatataaagcagtttataagacttgtgatcttaagagtgtggctataatttaaatatgatataagtcacatttatgttttcttgtatccttgttcccaggattgtttcagtaaagatctttaaattataaacattactgaatagaactgatttgtttttccagtcagcatatcatttcaggggccagtagaagcaaacccctgttctgttcctcatcttttatccagtgtctgaggatacaatgagattgtctttgaaggttgcaggtgtttgaagatatgtcctttgcagtttgaaggacatggaaaccaatccagaattgcatttaaataaggaaattagaatagatgcagaaatggaggaaggaaaaaagcaaactgaaacatagcaatgaggcccaaaagatgtagggctacataaatagatttaaaaccttatattccaatttgtttgttttataaactcagtgatcttaatattagacaacaaatccttagaatcatgtaacatgtttcgcactttaagttattgtttttgtttgtttgtttgtttgtttgttttgagacggagttttgctcttgttacccaggctggagtgcaacggcgggatcttggctcactgcaacctctgcctcctgggttcaggtgattctcctacctcagcctcccaagtaggggaatttttttgtatttttagtagtgatgggatttcaccatgttggccaggctgctcttgaactgctggtctcaagtgatctgcctgcctcggcctcccaaagtgctgagattacaggcatgagccaccatgcccaccctatcattgttcttaattcttatattttacaagaaaagctggctctcaattgatgttcaacacatgcaacatatagaactgggaccccaaattgatcaataactcaagttgatgaaaggccatgttttaaaggcaaacaccacacagtctttcacattggtgccaacgaaggcattttggtatattccctggatgcaaccaaatcctgtggtgagaacctggtgaatgagaacctatgctacagtgtatgttggagccagctcacacaggcatatttcccaactctgtttggtgacttcacatcgatagccagccacagtgggagtatttacactacagaaatcaataaattctgcaaacatgtattttttttttctaagaaagctggttgttaaacagccaacacacaactgtccttggaggaataaaaggtttgcctttgcctttctcacaagttctatttcagaattgcagccaaagcatatcatctcagcccttagctctagagacctccctcctctagtgggcagagacatttcttccttctcagtgtatacaaattttatgcttatcagtagaggtgagattattggctcacttttcctcacaagtggatacatctctcttctttattctctctctccctcctctaattctctcctttcatatgtgtcattaaaaatgtgtttgtgcatttgagtggcattgtgggaagatggagtgaggagggagaaaactcaaattatattgcacattggccactggcacacactgtgttagatgctttatatattctctttttaattatttttactatttgaaacccaaaaggatcataccattgtgagaagagctagttttctagaaaaagagatatggaattttaatatatcttgaaaagctaaagaggtgattttaactgaagtgaagtaataaggtagggccttgtataagtaagagtttcacaataccaaaatttatattgtaataataacattgtaatagtaaaaatgtaatagtattaatgtattcagttttttattctctgaactatatatggcattactttgatatcatttcatgtcatctggaaatgactactattgctacagtatgccaaaatatctgggcacaataaacaattatagcattttctctatcttttagacttctcagataatgctacaatatgttaaagtatctgggcttgattaaaaatgcaagcatttctcctatctttttgatttcttggttttggaagacttgatattctactgatcattgctattccatactgtaatgacacctgtcatgattttaaacagtttttttttttctattctaaacatggtaacatagagttatgtcattaaaacattaatcttggccaggcacagtggctcatgcctgtaatcccagcactttgggaggctgaagtgggtggatcacctgaggtcaggagtttgaaatcagcctggccaatgtggtgaaaccctgtctctactagaaatacaaaaattagccaggcatggtagcaggagcctataatcccagcaacttgggaggctgaggcaggggaatggcttgaacctgggaagcagaggttgcagtgagccaagattatgccactgcactacagcctcgttgacagaacaagactctctctctttctaaaaaaaaaaataaaaaaaataaaaaataataatcttatttcgatgtttgctactaaaaggtttttaattatttatttttatcatatcatattatacatatgtttgcccaagcactcacgtgtgtgtatatgcatgtatgtttctttaactcatggctgaaacagtaacacagaagacataaacctcaaatctgtgtctgggtctgtaacatggggaaacaggtcaaccttaacactacagtgtacatttgcattgcattgtacattactgatgtcttcaggagattgatgtgctgaaaatcctcattctacatgttggagatggggaatgagaagtcaggagccggaaaattctaaactcttttagatcactcagattccatctagtaaattacctttctctgagatattttcaaggtctgaaatgatagtgtacttacaagaggtcattatgacttctggcacccgttggagcaggcctaatgtcttgtagcaaatataagagtctaaatgcattgctataagtgtcaggctggcagcaaatgcattatgcttctccagttgaccctttctgctcctgtctctcacactcttaccagatagacagttagcaagcagcctgtcctatccagaggattatctcataacaaatatggctatttaaaagtgaaccatgttgctaaaactctgaaagccttgaaagaggtttatccatcatacgttaggtaccaactgctgtcttgatgattatcaaaaagcatcatcatgtttgacatcttatatctttaaaataatatttctatattcacttcaggtgttttgcctattaataattgagatgtagtaggtgatacagtaggagttatgtggcaacatttaggcttaacactaccacaacaaaatcattatgtgtcaaggctgtgaaagagctagtgtgttaggaagcattatccttgagtgaaaggagttcatgtctactcataatgtgtgagctgaaagtttgatatagtcagaagagtaagatacaggaacccaaggaacctgagctctgatcctaagactctctctaagtctgtgtaaccctatgtgataaaataacttggagtgggagagggttcctcataagatcagagaccctagtgcagcagtccttggagatataaattattaactcatgaaaagcaaggagacacacattattttgttttgatagtgttagaaagaaacagtttcttggaagaaattgttatagcacatccttaacctcaggtagctgagggaagttgaagaggatatggattgtgtctctgctgactgaaatgaaggcagtggtctggcctcacagcagtgaaggcctaatggttttaggaaacactgagaaaataattttatcgctctgattctcagtttcttcttttataaaataatggttttcaagtaatcctataggcttcagagtttgaagtcctgcattgaaattttagctttgtcacttactagttgtgtgataccagcacagcagttaagacccttcatgttgaaaaatatcagaaaatctaactcttagtggctcatggaaaaaattaaaagaacagcaaaacataatgaaatgtatttattactcacatatcgtgaattccaggaaaatttgtcaaatcacatatcagacatatcttatggagtccttcttggtggctcctaaaagctatggctttattttcccttaagttcaaatactttggaataattagactaacttgattcatatactcccctgaaccaatcctatggttatgtagacatttgggttgacagttcatactctactctaaaaactccagaacttgctcccttgaaattaatgaaactaggcaaacattgaaatcatttcttaatttctcataatcaattatttggaatatacattacattgaaatcatttcattattaaaataactatctttccttggttaccttttattggcttacagtattatttatttatgtattttgaactattttcactgatcttaatcaaagaaaattatattctctacatcataatgaaatagaagttctgaacatgttctttctgtgttttcctggattttcaaattaaagtatgagttgcttcgaaatttaattgaggctattgggactacagagttcttgcctttaagaaagttaagtttccaaatgtgtgtggtttcagttaattgcagtgtagtaccacatgcatgagattttatattcagaagggaggaaattgattttctttggcatgtttatagcaaatatattcagtattattgttcaaacaagctgaaattatttacagaatgttatatgtgtatgtgttttctgggaagagggtccatagctcttgtcagatttttttttttcaagagggtccatgactatagaatcattaagaattaatgtatgggataatttctttttcttctaaaacccaataagctcactttttaaaaatttgatggcgttttatttatgttaaagaggatcatttaaaaaaatattatttaactaatattcacattaattgcaatcatttcatggtaaagctatgcttagatttaaaatttcccttctagaatttatttttttggactcagagactgctatggtgatcaataatgatttgtagaaaattatgatatagcttgaggtcttttattttaaaatgttctttgtgacaatattcttggctggtccttattgtattggtgtctcaaactgttgctcaaaatttaagtgtgtttttaatgtactatttttttccataggaaatgaaagctcattgtataaaacttttaatacatagaaaggtaggaaaatagaaaatcatccttaattcttagcctagccactgtcaaaatttgcatgcgttattcttgtgtacttttctatgcagtgcaaacatgtatgacatttgtaattgcaccatgtatagaactttgtcttcatttattaattaatttatcaaacatttgtcagaggcttacaaagtaaagtaaccaattttcccagtttgcctggaactttcctgcttttaacagatttttaacaggatactcaccttctgggaaacctgttagtccttggcaaactgggatagttggtcaccctctgataaagataaagatgaataaaaacagactatagactatcaaggttagtgtgggagtaatatatattctaaagttgctatatcttatattttttacttattagtatttttcaggttactgcataattttattagtccttttataaaagtaaacttcaacaggttgaatgcaaaatgagttataaatctattcctttagcatagattttttgaatcatttcctagttttgctatcataaacaacaaagaaataaaatctctgatcacagcttcttttgaccgttatatatttttttcaagacagccataagatatataattgctgggattaagagcataaatttgttagattgctgatacatgctgtcgaattgctctccaaaaagattttactagtttatattttcattagagatatatttaaaatatgacaggattttattattctcagctagatacgaactttattcatcaggaacagtttgtcctatattggtcaaataatattctcccaggtattctgaaagagaattctaaagaataataaaaaggaaacttgtttgcatttttatatgagaatttcagttaaatgtaacaatctcattggagaaaaataaaaatattttgtatcctcagggctttaagaaaggtgcttccattggccgagatgcttaatgtatagtcttttgtgaaaaattctcgtacttagaagagttaataactcagtaactatttaatttactaacttgggaaataatatatgtattagtgagaatagtaacagtgttttgtttgtttgtttgttttgtcatcaaagacactattagccagggtctttacataattcttaacataataattatatttaaaataatctgacatcagattttcaaaataaatttaagacatgctgagaattattgaataccatgattggagctattagatgaagtttctgatataccttttttgttgttgctgccctcttgccctttctggcagaacttttattttactagaagaaaaatctatagcttattaaaaataatctaaccccaatatgatcaaataaaggtatcatcctttgattcaaagaagcatagtaacttataaaaaattaaaatgttattttgttaatagtgctctagcacagcagaataaccttgtaactattttatatattaaaaactaataatttgatttaatagcaatttacctataatatttttctatatatgtttcatactttgttaaaccataataagtatgtcaagtagtttttattttttatcaattaaatattccattaagggtacacatggacataaagatggaaataatagacactggggactctaaaattggggagggtgggtgggagaagggggttgaaaaactatctattggatgctaagttcactatttgggtgaagtccaaacctcagtaatacacaatacacccatgtaacaaaccatgtaactaaatataccctgtgaatctaaaataaaataaaataattttgagagaagcaaaaaagtaataagtagataaataaaataaatagcagtatttcattaaattagaaaatacaagagtaaaatgattttgctagtaattaaacatctagctcctgatgaaaacatatttatttggcttaataatgttatgtcagcaaatacatgtttaatattacacaatgattacaatttttcctccctatattcagcatacactttaatttcaaattaatatttacatatcatgaaactataatttatttaaaaaataaaaatgttatgtgtaaacacacaagtatataagctgtcttttttgttttatgaaatacaatcacagtaaacttcatttcaacacacgccctccaatttcattagtgatgattatataagcttatgatagaacaaggagagaggaaccaagtgtcacagttaggctacggaattttggttggattaatatgtaaatgaataatatgaattattataggagtcaaagctattgtactatctgctagaacttgctacttataggaataaataagatatcaaatactttgcataatagtgagtgttttacttgttaaatctgcataaaagcaaaattaaaattttcctgtatttagctggtactgtgaaaactatacaaagtatttagagatatttatagtatttgtattgaaacatttaatatccaaatgaatgatggtcatgggttaaaggaaagagagggaagcaaatgtttacagagaatctgccattatcagctgtgtgctgggtcagtaaattcattcaacatttcaatgaactattactagtctcaatgcattaacaagaaaactaaaattcacaggagctaagcaaaattttcaattttccatgctagtgaatggcatgtctgtctcatgagttcatattttattttgtatatcacaaaattataaaggatagacaccagggtaattattttaggccaattctacatttttcaattttttttcaagcagtgatcaaacaaaaaattttacacacttttttgtgcaggtatctaagtaattctgtaagctagtttctaagaaataaaatttttagaacaaggtgaatgttttaacttttcatatacgtggtacagctacattgtttttcccatggtcttaccaatgtacattcacatagtatggaagagtgactattttcctcaatcttacaaataataaataaaaattatgataattttatcctttttttctgctatatgtgaaaaatgacacctcataatttaacattttatggaaaaaattaattttagtatacaaaacaaatccaatattcgatttttattatagctggccaaattaaaattaaccatgatgttctactgtaatacaaaatatacttgctaggccaaattaataatgtagagacaaagaccttgtttaccgtagccaaaaaaaacatagttgatgggccgatgacttcattctggtcatgttttccatctttgttttaagtattgttgacactaaatatttacaggtctaaaccttctcggtgtcatacattcctggaaattagaaaataatttatcccatctgcaaagagtaaatttggtcaaaagagaaaatatcaaattaagtagatgaaaaatgattttctgctttgttttctatttttccccccggtacttgaaagtagtcaaataaaaaatagattcagagttgatttgttcatataaacagagccaatataaaattatgatgattagactatttcctatgatggctgtaacaaattaccacaggctctgtggcataaaacagtgctttattttcttacatttctggagatcagaattccaacatttatgtcaacagggctggcttcttttggaggctgtaggggagaatccatttcttcatcttttctaacttctagaggtcacctgccttccttgtttgctgacacctttcacacacgactacatccttttccttccatcttcacgtctcctaattgtttttatgttgtcagatctctctctgcctctctcttattagaacacttgtgattacattttggatccacctggataatcaaagacaatctccacatcccaagaatcttaatcacattggcagtgtcttttgctatataaaataacatccataggtccaagatgttagcatttaaatatctttgtggttattcagcctaccaaaatgatacaaactgccagtctatagaattatttatttaatctttttattcagtaaagttattctcaaagggcagattttacagggcaattttttgaaaaataaaacttgtaaaaggtttaattgattaattactgtttacagccatgaattcagacatgcatagtcatttaaacattttgatttctttaacatattttacaactggaaacctgtctaacacaaatggtcctactgctttatatctttttctgcctacatctatctaaattgagaaatatatggcatgaataagtatattcagtttccatggctatggctaaacaattactggaagcattttatatgggaataatttacatacatttgtgatattacttttcttatctctcctcactattttgagcaatctttgacttgctcttcaatcctagtttatggaaaaattagtctggccatgttaatagcggtgctggtgtcagggtaccttgaagaaatgtttgtttaggagttagagataaacagctgtgtctttatagaatgcttatgctaatgtgcatcagaaatctccaggaatatgacttagtatgtggtgtttctaaaactctatttaatcagagacacttttgtacttggagtttcaacatcttcagcaactagtgggccaaggaaatactgaacattaaacatccacaggactttacaattgtgaaatttgaaagtttctgaaaactaaaagtgtgttgactttttaaaaataaaagccaaaccaaaatgtaaggcttgtgtgtgggtggatttgtgtgtatttacaatacttagtgtgactattgatatctttgctaaggaaacataagaaaatatgcttgattatgggatgctgccccaagactttcctggtagtgttatataaaatgtggtatatgcaaaatattgccaggatttcaaatattagacatatcacattttaggagaggctgataaaagattatgaacctgtattacaagaagcacctgtattctttccacagtgaccaaaaaaagtcttttttttttcacctttagatttgatcatggtctaatgaccattatctcaagtgggtccacaaccctaatcaacaacgtgcctatagtttcttagagttcttcattttatttggaaaatagaagcaactggtagagtcctgcctccttttcccatcaccagcaccatcagcctagctatatctgtgcctatgcactttatttaccacctatggcaaagcctaaactatcttcatgtacttaaagccttgctgccatttgtacactgttcctgcaattatccccctacaagtgtgtgtgcacacacttatgaatcccgagtttctccttttctacagcatccttcccaatagcaggcaaaagtgttgttctacctcttattttatatcacgacactcttatatcaatgaagaccatgtactcttctaatgagtgtcacatcttccactccccctcagagcagaactcctaaatgagctgtcctgactcatattctctactccttcacttgtgtttctctcttcagccaactctagtccactgaaattgtacttatcaaggttgctaataatctccattgtgacaaattcaatggccagttctctgtccttatattatattagaatttggcccaagcaattcattagtcaatcatgaaagtatttttttcactttgcttcccattttagtttcagtttttggttttgtttctttgtctttgttttttctgtctacctcaaggcctatctcttgcatctctttcttacttctacatgatctagggacctagcctttagggcactcactgcttatgtgattccatctgttccagtgatttgtaaatttaccagtgtttctactgtgctccagattcactcattcaacacccatctcatggggatgtctaacaagaatagacagaatagacagtttcaaaataggaactgttgactttcctttataaacctgttcctctcttaattttttaaattttttatctcaatagataacatggtcattcatcaaaatgttcagtccacaaatttaggagttattcttgaatgataatttatcatatattctcactaactcactcaataagtgctgctggtgctgcctacagactttataccaaattctctgactttccactgtgaatcctgctactgtcctagtccacatctttgtagtatgtcacttagagtactgcaataacctcctgcttccccgtttcccagctttcattctttcagcagcagcaagcatgatcttttcaaaatggatactttcctcggaactctcaaataacttatcactttcaaatagaaacttatactcaaaataattgaaaacaggtatgcaaataaatacttttacatgaatgttcatagtagcactattcaaaatgaccaataaataaaaagaaccccaagtctttcaactgattaatcattaaaaagtcatagtatatacatgcaatggaatagtatttgaccattaaaaggaatgatacactgatacctgctacaatgtggatgaacatcgaaaactaagtgaaagaagtcagccacaaaaggttgcacgttgtacgtttctttttatatgaaatatccagaatggttaaatccatagatacagaaaacaagcctcctacctagcttataaatttcattatctaccactctccatttacatctcccattttaaccacgctggtctctttgcttatttttagtctcagcatattctaacttagtttatttatgattgcttttctatttgcttggatttctcctaaatcaaatcctagagtggcctattctagcatttctttaaagtagcgtcttaaaatatcacctctcacaaacaccttcccttccactctatccaagtctacacagacatctctaaaaaccatgtagattataagcagcataactacccacaaaaacatttttagcataactaaaatacattcaatacaacaaatttaaaattacctcagcaaagtatataaatgacacctgtaacaatagttctggctctggagcccacactgaattagaaagacagacagagactgtgcatcaggaggagagggggagacctagcagcggctgagagtggataaaatcagacccacaaatgagaatcccatagtgatactgagaataggtctaaggaaatattgagcacagatataagaacagatgaaatagaaaagaaggtgtttgaaattatgtgagactaaatataacagtcttgggaagatatggtttctggggcaaattagaagtgtatggaaaattctttggtggctctgtggctaaaggaaaaataaaagaatgaaaaggttaaaattaaaggccctactgaaaaaaaaaagagagtcactatatcagaaaaccgtataatatcaaaatataaaaacacccccaattaaataagtttttttttcattaactacacaagacaatgttcatgaagaagaaatctataaaggcaataaaattttctctgaccttccaccggtggttgcttgtttaggaaaaccttagtacctcaaaatgaacagaaaatcattggcaatacctatacaaatttatagaaagaaaaaaaaacagacagcaaaaattttcaactgatgaaatttctcttccttccaaaagtaagtaaaaaaacagcaaccaagaaacaacaacaacaaaaataaacaaaaaaccctgtcttaaatatatttttaaagaattacctggaaatattaaaaaattatatttctaatcagtgaaacaaaaaatagcaatggagaaagcatacaaagatgtgaaatgaaatctaaaaaggtcagaaaagagaagaaaaagaaaaacaaactcagcagcaaagcatcagccattaggtagctacagaagaatagattctaatgagtattttataaatggcatataagtgccactggggaaggaaatgaagaaaattcaaacaacacaacagaaaaaattataaaggttataactgaagaaagttttttagaaataaggatcttcagccacatgttgaaaagtcacattttggtaattcttaaatatgttctagaaaaatttttagttcttaaggatattttaaaaaaaaacctctggactttcaggcaaacagatcaaattacttacaaaggaaaaaagaaaattaggttgtcgtgagaaatcttcacagcaatagtcaaaataaagcagcagtaaagccttttttaaaaaatgcaaggaaagactatatgagctaaggtacctttctggcatcaagattataaagacatagttttaaacttaaaattattttgtgaatactatactcacaagagaatgagtatatctaacttagggattattaaataaacttgacaaaggaagatagtgaacactgaatatatttaatcgtagatcccaggctaaaacaaaggtgttaaaaggggtagaatgataaatatgttctgacaaattagaattttgcagttcaaactaatggataaagaaaataaaatgaccaggcacagtggctcatgcctgtaatcccagcactttgggaggctgggcccagtggatcacttgaggtcaggagttggagaccatcctggccaacatggtgaaaccccatctctactaaaaatacaaaaattagctggccatcatggtgggcacctataatcccagctactcaggagactgaggcaggagaactgcccaggaagtggaggttgcagtgagccaagatcgtgccattacacttcagcctgggcaacagggtgagactgtcacaaaaaaaaaaaaaaaaaaaaatccttgattttcatgtaggtaatagatggcagtcaatttaaagctcaattagtagcctaaataacggaaacaatggactaaatggactaagagctttgtaaaatcttaactttctctcaaagagctgatggtactctctgcaaaattcttctaaagtggcgtaaaaaatgagggtgactaaattcttgggaggatttctatattaaaatattgaaaattttaccataaatttaggaatctgttgaaattctgagcaagaaaacctatactgtatgtgcaagaactctgctgaaacagtatggtagagttgtaaaatgtatagaaacttgtatatgcctttgcaaatgaagtaacagcctttgaagtctccttagttcaaatcccaatctatatagttgaattttctttctttctgactttctcttcctttccttttctttttcttttcaaaatgaatgtgttttttaaactgttcctgcaagttgtgtctgtttgtaaatatgtggggttttcttcagtttttttgttgttgcttgcgtgttttgatggaagtggtgtttgtgtgttttgatggtagtagacatggcagtattgctggagatagttgatgtaaatcatctacttccaaatgcattttacaatgtggtatatatcaatttttgcttttgtgatcttttgcatcggccatagatagctgtttttcattttttttgcttaatgaagtaaaaagcaatataaataaaatttctccttccaaatgaatctcattcagctgcgttcaactatgaaagagctctcaaaaaagactactcattaattttcatttcaaaaatattttgtaaagtggttcataggcctttgttaatggcttgcctaatgtccttggatcaccatatgttctcttcacaaagtataggcccatagagaaataaatttccctcttagttttttaggttagattgttggaaaaatatcaataattcaaatcagatgattgtatttctaatcaaaattttttgggatttttgatggcatgaaaacaaagaaatgtttttaacttttttactgcattggcaatatatgaataaaagaatggagatgaggaaatgaaggaatctactgaattaactgcatgatcctctctatactttccctactgcaagagaaaacaatatacacatggccttctaatcacttggttggttccccttgaaagcagccctcagtagtttcttactacactgctatcactctgaacataagctggagacaaagggctgctttgtacggagtgaaaaataatcagggtctggtgagaggatagatagaaggatgctcaacaccaacctcaccatcaggaggagaccacagtcattccttttgtaataaaacatacaaagccagaacctgaatggaacgcaaggactctctttggagaaaaatcttccttattctctttaatgtatgacattttcataatcttcttgattttcatttttccttgtggggccaaaatcagtaatttgaattaaatctcctatttattctaacatatgtagttgaagtccattttatcccctctcccacaatatctgaattcaggaattttttattgttgtttgtttgtttgtttgtggtctttttgcccttagcagctagaagtggagaccttggtttctctgattctatttccaagtatttctggaagatcagcattctactctctcttctaagacagtgttgtcttatattaaaatttatgattttggtgagatgcttaagcctttaccccaattcaaggtggtgccctgattcttcaaagtcctcctgcctttactaagatagatcttctcaagtgctttacctttagttttccctagggctccctgctcattattttggcctctttctgtccataagtaatgttaattatgataatactgctaagatattagtaggaagtatcaaggtcctgtcaactaacctttattctacagtatttgaagcagtcagatggaaaggagaagagtcaagccattaagtgccacttttgatatgcgtagtaggaggttattcactttggtttatttgacagtaacttacttaaaaaaattttttttatcattttagatttctgttactggctactaaagagtcgatgatagatgattatatgatacagtttcattccaccatctttacctacatttttcttttaaatatttatatcaatcattaatatttttgagagagatgtgtgtatacatacacatatatatgcatatgtgtatgtgtacacaatcatttgctggaatggctcacagaacttaggaaaaccgtttgcttactagattacgggtttattgcaaaaggatacaactcaggaacagcggaatggaagagctgcactggggaaggtacatggaaaggggagctgagcctccatgttctctccaggcatcccatcctcccagcacttgcacttataatcttgacgccagaaaggtaccttagcacatatagactttccttgcattttttaaaaaaggctttactgctgccttattttgactattgctgtgaagatttctcacaacaacctaattttcttttttcctttgtaagtaattgatctgtttgcctgaaactccagaggattttttttaaaatatccttaagaactaaaaatttttctagaacatatttaagaattaccaaaatgtgacttttcaacatgtggctgaagatccttatttctgaaaaactttcttcagttataacctttataattttttctgttgtgttgtttgagttttcttcatttccttcttcaatggcacttatatgccatttataaaatactcattagaatctattcttctgtagccacctaatggctgatgctttgctgctgagtttgtttttctttttcttctcttttctgacctttttagatttcatttcacatctttgtatgctttctccattgctattttttgtttcactgattagaaatataattttttaatatgtccaggtaattttttaaaaatatatttaagacaggttttttttttgtttcttttttgttgttgtttcttggttgctgttttttttaattacttttggaaggaagagaattttcatcagttgaaaatttttgctgtctgtgttttttctttctataaatttgtataggtattgccaatgattttctgttcattttgaggtactaaggttttcctaaacaagcagaagctctcagaaactcatcttttgggggttttagagaggcctcaatacacaggcctgattcattatatcacctgccagtagtgataaaaaaattcaggccatttcttctccccagaggtgttgtgtgggacactggggtgtctgaaattggtaaagttctaatcacttggttggttcccctggaaaccagcccccatgcttgggctttccaggagcccccagcccccagcaatctcattagcatatgaaaatacttaccatttcagagattgcaagaatttaaaagctgtgtgtcaggaaatgggaaaagagaccaaacatatttcttaccatgtcacattgacaattattttgtatatttaagtttctcaggcatcacatcgagatgtatcatgttccaaacaagaaaacggaacacaataggagctttgagactgggagatggcttagtttttatccacctaaagttaattataacttctggagctgcttctggagttagacatatattgctatccaatagaaagaacagcactggaattctcactagcttgttttgtcatttaagcttcctaaatcggatctgcttctagcttcggttttataatgtacaatgatatgtactatagaacatagacaatacttaagtaccttccctttaccccatccctaaatgagacctgagccataggaatgatgactagcactgaaatagttggtcacctggaaactctgtgaactctgaaatttccccatattgtattatcaggctgaaaaaaaaaaaaaaaaacatgtatagtgacacctgtaagtgtacttcagataagaagagattaaggagtaatagttccctggtgcaggttttaccattattcttccaattttttcattctagatgaaggtaaaccaattggaacaccacttatttttgcacttccctctttgccctctcttcgttttgtctctccttcaaatcagcagaggcagaaatgtgtttttagtcaaaactgcagattcacatacacactcacacacagacatccatttattccttagcatcacccccatatactatacctaaggtctctctttgtctacattttgattatccacaccaaaataaaatctatgaaaacacctgtacaacagaattagtctactgaggcctagggcaacgtggtgtaaatctactgtgcatttgataggtggtggtagcttattgccacatcatgatggatgatgtgtatcatccagagctggactctggagttgtcccttgtgaacattaattagtaaggcaaaatggcttgagtttttggatcaaaagagactgtactaataaaaagagcaaaggatactataaggataaaaaaaaacctgtgctattaaaatctctacaagttatgcaaaaacataagaactgaatgaaattgcctttaaatagttgggttctttgaattgcttacctaaagttattcttactatggagaaataaaaacttactctgcagaaatgagaaatttattatagctgagccagattatacatatgcatgtgtatacgtgggaatatatatgacatatatctatgaatatatatgacatatatatataaaacatttatcattgaacatgacattgaaataattagaatctaaaactcctttaatatttaatatactgatggctttgctaaaattcatatgggatattttatgcataattacttaccaggcaggattaatatgaggattactatttatgtgacagaaacatttgtaaaccaccttgaccttctcaaagaaaggttgcactagtgattacagagtaatgtctgctttccttttaatcacaatctaagatcaggtcttcatttcacagtggtagaggaagttgacataacgaaaaacatctaaataagtaggtggatgatctcgagagatggtatggatgattatttaagagttttatagccttcttttgttggttgagtttttttaatctgtatttattgaggataactttatgtttattgacaccatatgttaatactatgtaaacacaggatgtcttcatatttagttaatattccatgtgcggaacttcttaaagatttcaaataagcctacatacactatccatatgttgctttttagcaagggtgctaaaaattgtaaagattttaacttagcatggggatttatgtatttatatatatatacccacacacacatacatattttagggggttatgtattaaatactattcctgtattagaggttcgtgcttgtcatcagtcagtatttttagtatacatgtatgtattgcctttactgtcaccactaattcatactttgtgactcccccttgcatatatcctacctatgtaaatctgtatttgcacaaagaagttactagaaattttgattacttcttaatcattcttaatcagaattatttaactaatccacttttaatgtttaaaattaaaggatatatatatatctcacatattcatttattttaataaacattatttgaggggcaattatgaactagtattttataaagcatattgtaggattagggaaagaagtggaagggagaaataaaagatgataaaatattgaataatatttacctggttctccagaagatcaaatttcatggtaaagactgaatccaagagatgtacctataaaacaatttatatgataattgaacaagcataaagtaagatatttgagcactttgtggagagaaagggaataaattaattctgctcatgtgtcagttgaaaggcttatagaaatatgggtgttctacatgctaaagtgttttagtttgttcaggctgctatgacaaaataccacagacttggtggcttataaaccaaagaaatttatttctcaagtttctggaaactgcatgcctgatcaccacccagaagccctacctctaatgccatcatcttcaggaatactatttcaaaatatgaatttaagaggaaaacaaacattcagcccacagcacagagataagtgggcattcttagcagagggaaatgtacacagataataatatgaataacacagagttatcttaaggaaaaatcacgtagtttgctggggctggaactacagcataaagaaccagggtggtaaattgaggctggtatatgaagaattattacatagagacaatccaggcccccacagaaaatttcagctggagtagacacatgagaaatttttgtttcagaaaggtcacttttgatgacaatactgaagacatgctgtgagattagcaaggaagataatttatgtagtggccaatataatattaatgagatttccatgacaaatggcttatggtcaaatgtaattgtgaaattctcagtcaatagaagcattttataaaagattgactaatgggtcacttggaattttaatatgttaatatgcactgcgatacacacacgtgcattaatagtgtctacatcattatcctaacttgttttgctgtaagaacaaagaactgtacgttgctcaaggctaatgaaatagtggatctggggggtctattccatatctatttaatacaaaagtgttattcactactctagattcatttcactggaaaaataaaaagatggtgagtgatattcttagtcagtggcagagggatgggaagaaagagaaaacttcaagaggtgattaaaataaatgaccaacagaatttgttaaatgcttaatgtaaggttcttaacagagaggcttcatgaggtaaacgaatctccctatgttgggtgtgaaaccatgcttccatacacattggtgcttcattctgaaaaaaaggtattttaacttttggcagctgtctgtaaccactaaaagattaaaacccattggtaatgggccaaaaatggaactctggcatagactagatagatctaaagaaggggaaaatggaaatgagagagacaatcttgagaaagcaatgttctgaagtcaaagcaacaaggaagctactatacagcaagggaatgaagagcacagatgctggagccacattgtgtgggcacaagtcttggtcctacccatagctaagattttgtttgggaaatttagctcttttatgaaagctatccacatttataatgcaaataaaaatagcagacaacctcatagggttgtagtgatcatcaaatggttttatacatgctaattgcttagataagtgctcaacacataggaaatgaaaatcatgaacaaggaccttcctggtgatttatatatgctattaatcctcacagcaacatcaggtggtgctattatgaattttcatcatggaacacaaaaactgtcatgaaaacttagtagacccacaattctgttttactcctaaactcaagctcctttaagtacactacatggacgtgacagactttcaaaacagggagtttggaacctggataatcttggcaaatcctacagaggaaaaatacaaaaagtagctactagatcagtgtttcttatagcaggcaaacctcaaccccccaaacaaaacaaaacaatttcataagaatggacttgttgatggcagattgcaatacaagataagcacatgtaaataacaaatacaaaccaaagttggatgaattatcacaataaaggggaagaagcagataggtagtatctacaaagagttaagataatgtgtttttttttggggagggggaagtgtgtgtgtgagtgtgtgtgtgtgtgtgtgtgtttaaatgtttacctttatgtgtgtttggaagatgagaggcttgagcatactagcatgttcagggaaaggaaccattgaaaagaaaaaaggtaataatactaaagaaagagggaataatactaacggatgtatcaaaaattggaatagaaaatatcattaaatagggaaggatgtctagcttcctaaaacaggagggaagttaaggaatgaagtgacctctattcacctctgaacccagggattcggtaacatagatcagtaactcttcctgagtgcttacaatgcactgtgcactattttaagcgctttctgtaaattaatttatgttgctttgaggtagctagtataaccaagaggatagtagagtaaagagaggtcctccagtggctgttctgggccatgaatttgacagttagtctttagaatccatgtactttactccatgcactgcctctctgcccatcccctctctgggcagttggaagtgggaggctggatcagcgtctttgaatgtggtggaatgtagaggtgtccaaagaaggagcaagggaaagaatctaacacatacagataggacaaagtgaaaatgggagcagcaagaaacaaaatagaagacagaaaactagcaaaagattatagaaagaggggaggcttagaaaaagaaaagataaatgaagacaaatgcaagccatattagatatcaagtcaagtgcattattaaaattcaactactttagtcattttgagcacacttgtttttagaataagttatcacattattaggtttgaaattttgtctattttttttaaatgactttcttgagtagctaaaaccgttgcttaaaaaaattctcttctatgatgcttctgtcacgttttggggtaattgcacagaaaagatgaattcatgttgagacagaattgggtggaaatgtctagttgaagggataaaaactgaaaattatcaataatgaaatttggaagtcttgtcaataattctttaatcccctaaacagattgtatcttttaaaacttatctacatttcaaaggtaatattttgtttcccatggggattttttaaaaaatttgggcaaaaccaagaataggaatgttattatacaaattactcaatagcaattttgctcatggacattgttaactatgtatgtaggttaaataatttttttcctataagaaaataaaatacagttttagattctaaatagccaatttgttgtatgtagttgacagggtagccttttttagtatagctactttattttcagcctaacctatatttaagtatgaaatttattggagaatgaaaagttaacttttgctgctgctactttcaaaaaaattttgtagaaaagagtattagtgataaaatacttaataatctttttctttctttctccgtacttcacctgagttctatatatatatggccacgcgcagtggctcacacctataaccccagcacttttgggagcccgattctagtggatcacttgaggtcaggagttcgagaccaacacaatgaagccctgtgtctactagaaatacaaaaattaaccaggcatggtgttaggcgcttgtgatcccagctattcaggaggctgaggcttgaacccagaaggtggaggttgcagtgagccaagattgcaccactgcactccagccaggactccagccaggacagagcaaggctccttttcaagaaaaaaaaaaaaaaaagaaaagaaaagaaaaaataaattgcaaataatatgtgcaccaagacataagacagtaagctttttttttttttttttttactcctatgtcagttcctgaacagtttggtagaacatctccttaatcatcaattaaccaacaggttacagaaattgagtgagagaggacttcttggaggattacaatctaattacgtaacaggaagaaaacacaaactgatttttattatgtcctacagtttttcactgttcagtataaattatactttttctcaaggaaagagagatagatataatggataggctatgaaatgttgggagatactgagaacaaaattttgctgcaatttatgaagaataattgttttattttaattttaagttcccagtgtattttgttgaaaaaaaaaaaaaaaacctacaaggaagtttcagttactcagggactaatcagttagctggccacttttttatataaaatggcattttcttctaggtttgcctttagttttcaccataacagtgtcattacttattacaacttcatcctgagtagaaagagaaacagaactagctaatatcagcttgtttggctttatgcttggtgagagatgttggcattgtggtttaaagtggaggttttatttattttgagtcgttattcatccatcactggttttcactaacgaaaagttagctgtgcttatctactgagagatcaattccattttaagagcaatttataaagcttgaagacagccatgaatataaaatagcacaattcaccaggtcttcacaaagaatactcaaaattgagtatatcaatttcaaaattgagtatatcaataatcaaaatctaattttaccactggtgtaaagagaaagtaagttaaaaaatcccaaatcctttctttgttggattaggttcctgcctttcttattattctttgctttcatctattgtatccagcaaagtggtatcatatcaatgaaaagctaaaactcctagtaacttgtaggagcacattgacataggtgtaaaaaagagagacttcaactcaaaacaaaacttttacattaaaagtaaaaggcctactcagaagtggaaataatctagatccacttcccttaaataccagtccttatcagaaaatgcatatttagtagtattttatttcacaatatgtgagttatctagctcaagaaggaataaagggagtctttagttaaatcagaggatgttgtgaaatagcactgcagtgttcataatgaaattctttatattcatcaatgtttttcagactgagttccaatatatattctctaggatctaaaagtctccatgatatttcatttataaattatgtcagtgttcctacacattcatatacacacacatacatgtacacatatacatactagaagaattagatgacagtcttacagccaaataccacaattttttttattacttacatttgcttctatcttggagccaaatgaagaataaatgtttttgttttcttgtcagtttgagtttttcaagctgtcttctaagaccatattcttggggcctgaagtttttcaagtttaagaaaccctgagataggtgactcttatttaaccaattgctgtgatcagttctatgaccttggcattaagacctgggtgaaatgatcaaaaatgatctacattttggttattaacatatcttccatgttcacatccttttcctttcagaattcgtagccttaaaaataataaaaaagggcagaagatagtcagactagtaggactcttgaggaggctctcctaccctcactcacatcacagctgctgctttcctaatggtcaggattacatgcccaaagccttagaaaattatcttaaaaggatgccttcccttcacctttttcctcttattggctccagatgctctcttttttgtataaaattcaaaacttggtcatcgttttaagagagatattaaagggtaacacattgtatgatcgtatcaaagtatcacatgtacctcatgtacagccattatacatccataaaaattacaaattaaaaaaacttttaaaacaatactttaaagaatagtaaatgatagcatagaggtaagagaatgcattgtggaatccgattgcctgtgttcagattcttcattctactacttattaattctgtgacactggacatgatatttgacttcttagtgccacagttcacaatttataaaacgggaatgaaaatagcacttactttgtgtgtattgttgatgaattcacaaaccagtaattaatcatatttgatatttacaagtaacaatctgaaactaaaattaaagttttattgaggtaatatttgagtgcaatgtcatattacaattagtatcatgtcttcatgaaaaaagtaatggtctatgaatttaccaaggataaatggctggtctgttccgacatccctatgaatttttcttttcagcctaatagatgacttttattttaatatttttagctgtaataaaattttaaaattctatgaaaaaatgcaaagaaatcctgctgttcatatacagttattaattaataacatgattgtatcactagattattaaaagttcacatacatatgccactgtggcaaaaggattctcattattgaaaagaacaccaataaatggtaaaaaaacatagttttgcataactttgctgatcatgaatagtcaaagactaatgtgggtttaaaatgtgggtttaaaatggaattatttttagtaatatcaaagaaaatctgaaatcatatggcattcagtctttcatattctggggaaaccttaagaaataaaagacttgtgacaacttttctttattacccaatgtctat

SEQ ID NO: 26 - DNA, 34699 bp, Homo sapiens
taaattgctattttaagattttttaagataggtcattagaaatttgtatgaccattataaatattcaacgtattaaacgtttctcttatatttgaggcaaatatttctcccaactatgtttttcttatttatttataagaaaacaaactaaactatatatagttatatttattaactaaatataaatagttaggtctatttatatttccctatgtgattctgactcaattcctctacatttagaaaaattcctccccctctacagattagacatgcaccatctaaaacatagtacttgctttttaattattattgttagaattaaatgaaactgaaacttgttaatgaaattagctaacaaaattttccactgctgaccagatattataaaaaacattgaacctatcatgtttaatagtgcatagattttcccaagctggataactgtgaaatagagtgtaaccaatgatttgagtgtaactgtgattaaactttccaatgttggaagacacttttaatggaagctattatctatatttatagcagtttcattttttacttcagctgttacttactcaatttttttcttctcttttttgcaattgatttgcaaaatattccattaattgccttataactgttatacatatggaaaattgttagcatgccttaaagtgatcaagaaagctcttgagtgttgaaatatactaagtcttattttagatctacatttctcctctgggttctgcttaggcaaaactagttacatttaatgacgctttcatgcatttgctattaaattatattagtctaggtcagtcagaaccttgagatacgtttgtctcttgaggctccttgtctggactagatgtccatgcaattcttgttcagctccaagtccagccagaggcatttaatgtggccaacaacaatggtctcatgccttgattctaacatgtatctgggggtctgagcttaagaatggagaaacagaatgtaagtggtcctgtcagttgttaaactactctttccctgcatccccagtcttgcctcatagatatcctcggaataaaatatcatgatttttaagcatctcagtttgtactaggattgcattgatgggtggcttttccaacagaggaggaatagagatgggagggactgagatgcctatattcgagaaaaactatttctaggcagatagccaaatcttgatccatcaaaatactaaattagtaatatattaaaacatttttaaagggaattctgttattattatgaagaaaatgagaaaagaataatattccatactgatatcttctatcatttggaaatacctactttcttccaagaactgtataatgtactagagacataagattaaaatatatggtccctgtttccaaatagctcatagcatggagaccaggctgaccaggaaacagtatcagctatgaaacggaagtactgaattacaaggagtagatggaatgactgcctagctgaaactgtaaacatcaagaagaattcctggataatgtgccctatgaattgagttttacaggaagagaatctcaggcagaagaaagcatattagaaggcccaatgctgtgagaaataacctatttacctccctgcaagtatttcagcaaaggtcttaattggtcagtgacaattaagtaaaatgaagggcttaggaggtccagatgattaaggtttttattcggcttgctaaggattttggactttatgctaagccaataaaaaggtattgaaagactttaagtagtcaaggatgtatgatcagatttgcattttagaaaaatttctctggccacaattacgtaaaaaacagagaaggatggggcgggggacacattagcacaaaagaatagttagaggacaattcttggccattcaggaaagaaatgaggagggtcttaagtagagagagtgtttctgaagaaagatattaaagagccataagaggcaacatatgatcactgattataaggttggagagacagggataaagaaaagggtgaaggcaacccagctttctggcttttacaaccaggtaaaatgtgatgacgttcacagaagcagggagtaacagtgtgaaagaaggcttgattgaaggtagaatacaaatagcttgagttacctgtgaaatgcacaagtggatacacagggctgggactagggtgaagtgagtgatgcatggaattggatgcaaaatttaagaaacaaaaactctttgaaaaaatgcattttattttaagtctgggatacataagtaggatgtgcaggtttgttacacaggtaaacgtctgtcatggtggtttgctgcacctatcaacccatcacctaggtattaagccccgcatgtattagctatttgatattgatgctctctctttccctgccccctactcctgacaggccccagtgtgtgttgttcccctccctgtatccatctgttctcatcgttcagctcccacttacaagtgagaacatgcggtctttgattttctgttcctgtgttagtttgctgaggataatgacgcagtggtaacacatggaagcctcctttctttaaggaactattactgagagagaggcagaaggtttaaaggttgtgtttttatttatttatttttacttttctctcatgaaataagaaactggaacatgtttatttgctgaggctaaaaggaactggcaatggagaagggacgtgggaaggaacaaatcagagaagatagatgccaaaacaaagacagacagaggctgaagaaaaggaggctcagatgggattattgtagacagtttactgaatacaggccttcaaaactggggggcttccacccaggaagtgaaaccatatgacccagcaatccctcttctggttatacacccaaaaggaagtgaaatcagcaccttgtagaaatatccgcacgccaatgttcgttgcagcactattcacaatagccaagatatgaaagcaacctaagtgtccctcaagggatgaatggataaagaaaatgcataatatatacaaaagagaatactgttcagcctttaaaaaaaaaaagaaaattctgcaatttgtgacaaaatggacaaacctggaagacattatgctaagtgaaataagccaggcacagaaagacaaatactgtatgttctcacttatgtgtggaattaaaaaaaaaaaaaaaaagtcaagcccatagaaaaagatagtacaacagtggttatcagggacaaggaggggatggggaatggagaaatgcacgtcaatgggtacaaagttgcagttacataaacaactgaaataagtaagtctcaagagctaatgtacagcatgaggactacagctaataattttgtattatatactagaaactggctaagacagcagattttaggtgctgttaccaccaaaaaataaaaaagaaggtaattacgtgacatgatggatatgttaatgtgcttgaccttagtatatttcactaaatatatatgtaatatacatttatcaaagcatcatgttgtatgccttaaatatacacaataaaagaaggaaagtaatgcacttttattgcctggacaacacattaacacatctccccattgtgggtcatttttttttcttttgaaatgtttataacatttactcacatctttccatatttctgcccatccccaaatttaaggaaattagtatgcaatacttatctgcctgtaatcccttctctttggggcattaatcagcagttactaatctgaagatttaacaagggaagaacaaagaagcattaaaaacactatttgctgaaaatatagaaggggtgcctaagtgttgctcacatctcttcaaccttcaggtggaaattatactcaaggctgcaatggctggaaccccaagttcactgaaatctgcatcttgaaggaatttttgcacaaaacagttctttcatttcagaaataaaatatttactaaaaagttgagaaacaatgcaagcaaatgcagtaaatatttgttcttcatggaagcaagttattcctttacatactcctattgtctcagtgaagttctggaggtttatacaaatggaatagattgtggaactacccctgagaactactcttaaacatgctacgtattcaggatgtcaaattaaaggagtctctgaggctgccgcttctctggtcatctttaattagacaatactctggtgaaaccctcacaattaatattaagagttgttcttcttctacagtaagtggaaggggaattatgtagtggcttgttctttgttataattttattgagagggttgtggaggaaggattggaatataatagaattgttctattttctaccatttacagaaaactagatgaatcacaaaattgaagaaaaaatgatgcttatcttttaaatatgtattttataaatatttaacttatattaaaattactttccacatattacaaaatgctctaggcatatcagtgcatgtgtgctactcattaaatgttactatgtctttctaccacagagatttatttaggagggagattgtcatgttatttcctatacctggaatgactcacacttctgtgcctgttaacattttatccatctgatacaatctagaccgtgaaacctttcctaatcaagctattttttcataaatttaacaactgtcataaatgaattgtctgtcatgaatgaatgaagcaacaaaacaatgaatgactcagtgtgggttggttctaagagttgcataccttcgtaaccccaatagagcttgttggggtgcctggaatattaacaagccaaaaaaatacttactttattattaattatgtaggcaatgcataaattgaaatacatttatatttctctcaagaaattctctctaaattatattagcttctgaggagaaagtgtctttctagcaacctggcttttaaaaccatcataggcactttctctgtaaaggtaaataaactttctttggaatgtggtgaaagaagctgttagataatttctgaatgtctggttttataataaggagggtcactgtcctcaaagtttagcaatcactagaccctgagggacttttatctaatcttaaccctgcacctgactgccaggcagagctaatcacttaacctcccagtgaattaatgggttcatctgtaaaacacgattgccatcaaaggcatgaaaggaaaagactaatgatagacggaatgaggttagatttaaagattcaacaaagccatcaaaattcacagcaaagccattttccattatttccctcaattgtaactatactgcttttataagaagtgaattcgacaaaaataagtttataagagttctgttgtgctagtttttatctgctggactgatgcagtatgtaagaaaattctcttgctttcaaaaatgtaaaatttaaagcacattgaaaattcatgatatttcatgagatgcctaaggatttgagactctgacagacaaaaaaatcccctgtgattttgataagactgctaaataaaaaagcagttcatacattatttttatcaccttcctcttctatttcctctttcatttttctattacattttgattttgacttttatgtttctgcatctttacttttctccacccctggagcaatgggaagtatttttttgcaggctacaaggtaccattttcagtgtctgatgaagttctccctttggtgtgtgtcaaacaatcatttccagcctccagataaagagacagagtggcccagaaatgccctaagcccactagaggcatgcttgcctaagctggctgcatctctccagttgcaatgcacattttttgggacaataataaatactggctcaaaagagaatgatggaaagtacatttttaggagatatgagatctaggtctattgatggataaactgatttttttccagtcactataacatctgttcagagtaagtaagcatcactgcacagggagatggaggatgttaactgatattgggactacaattagatagaagaaaaccagaaccaaggcacacacactgttcagatagttcatagggttattttaatcactgattcaactttacagaatgaagtttctccattcaatttcacatcagtaactgcaggttgtattatgtctaagattggtatagaacaacagcaatttcacaatatctagacaatgaatgaatattaaaaatctatttcattaaaaagctctttcagatactggtatctgaaagaaaccatgttggacgcaaaatatatcaagaaatcaagaactcaatataatgaaaataaggctgaagactgcaacagatttgaatacagcatgcctctatattctagttattaatgattgatttttaagaaaacctgtttcagtgaaaagggcaagtaatcttttttaatctcactttaaaatatttcctagaactttctcattcattagctcacttgattctcaaaacaatgattctcattcattagctcacttgattctcatattctcataatcctaaaataaatgttattataatctgtattttaaagtttaatattttgaaagaaataaattacataatttgatgagggtgataaattgggactccagtcccaatttagttcaccctgagcaggtccattctcacatcaacctgttacaccatttaaagaaataaaaaatgtccattacatatatttttaagttacattcagtcaaacaagcagttaccttagcactcagatgtgtaaaaaccagtgcaacaaaatttcagtttttaacaagtcatctgaaacaacagaggacataattttgtcctgttcccaagatactttgtgtttatgttcctaaatcctaaattcctaaaattgcatcctgataaagaacagtaaatttgtttctctactatatttaccatattgcctcattacttgatccctccttccttccctccctctccccttctcttccattccttcttttcttccttccttcttttaataaatgtatatatatatgtgtgtatatatatataaccaataattaccaagcacttacagtacactgggcagagtgctaggctcttcactgaaaacacttcaaagtataataagagaaacaggaagcaatgaaatgagtcagctagttttggaatcaggttagtcacagttgatctcagctgcaggcccggaaggttgggggtgggctgccttgtattgcaaacacatgcatcacatcacacagacatcctgcacgctggagcacagtagcctgtcagttcccactgctgagtcatttacagcttttatcgtagttaatgccaatgattatatatgttaaaagtacttattaatccttgtaccaaatatagaagagggctcagacgcttcttatctcatggttcttaaatctaaccatgcgccatactcactggtagttttacaaggaatggattcttgagctcctctaaagaaatcagtagctccaagagagatgtttttaaaaatctgtttctagtaaactctcccagtgattgctgagtaacctacttaaaatgacattggaaaaccatacactagaaccctgcttttgatttttgttacaagatctagaatcaagttcaaatagtctagatagtaaaatattgtgagaatttttttttagttttagaaatcctacaagaagtataaaactattgttatagtccatgcaaccaaaattcttacccaactactggaaaatgaaggagtaaaaagagttggccagggtagagacatctggatccctcttcggcaacctaagaagataagtctgtcagagaatagtgattataatgagttaatgactatatgcctggtttgctttagacagccccatgtcatgccttctgtcttagtataattattaatcatgctacccatttctttctccgaagtgtccctatttgaacaacaagttatttggtcaccccaactaaaagggaatcttgtcagagaccaatgagtgtcgtttagtgaatatagaaataataagcaggctctatttattcatttattcaactcaattcagcaacacatttgtgctagcattcgcacatgccaagtcctgcataagtgaggaaagccccttgccttgtggagcttacagtccagcagtggaagactcacacagtatacaaatgaaaaacaaattaaaaaggatagagattacaataactgctattatgggaataaagaggatgatataataggatttcatgggatggacaggtgtaatgaggggaggccttctggcagaccatcatctgtttcaacctcattttgcataccttcttgtactccagaaactggaaagctaaaagctatgtttcatatcctcctccgcagctagggatctggatttagacacagacaaccagatatactcatgcgaagcactgattcagaactaaactgtagaaggacgacgcagtggcagagaaggtgtctacttcactggcacagaagtccagtctccttattgtcagacagcacataagatgtgttcctgaaggtaatggttctgaccccacttcctgatcccctactcatggttatagtagtacaaccctgaagccagcagttgggacagcagtcttctaactccccagcttcctgatgaggcagatgtagagggccagttctgtggtggtgttcttggagtctggaatagttccacatcaagagctattcccaagaccttctaaaaaattgtaagcactaacttaccatgttaagttcccttctgattaaaatggagtggtttctgttatctgtcacagaatgctaagtgataaagacctaaagaatgaaaaggagtcatgtggcaaataaggggaagagaattccagaccgagaaaatagcaagcgtacagggtcaaggctgggaaaagacttggcacgttcaagccacaagaataaagtcactgttgctggaggaatgaagaggtgggaatgcggaaaatgagacactgtgggagtctgattagggccatgtcagtgagagacaagttcagatttttcctagtatattgggaattcattgaggagtttcaatcaggcatgatctagttttaagaatattagactagatgccttgcagaaaaggaattaaagcaggaagattagtataggactatgtcagtagtactagcaggggtgaggaaaaggaggaattaaattcttggctttcagctagatcagaaggtagatgtgctgtaattcattaaaacagagacgaataggatagaataaacatatgtttgaagcatcaagagtttgttttcgttttgtttttgggtatctttggttgcacaagtcaaagttgagatgcaaaccagacaaaagactttgacaaggagagttttataaataagaatctgcaaaggaacagtcagttttccatggaaatcctcatctaaaccaggtcctagggtcaagacgttttaacataagagtcagaaacaaaacctcagagcacagtgcatccaagcacctttttcgttttttatacgaggtctcgtctttatcactcaggctgaagtgcagtggtatgatcacagctcactgcagcctcaaactcctggccttgagcgaccctcttgcctcaatctttcaagtgtctaggactacaggtgtgctctgccatacctggctaatttttaaaatttttttcttgagacagagtcttgctatgttgcccagtctggtctcaaactcttgggctcaagcaatcctccagccttggccccccagcgtgctgagattataggcttaagccaccacacctggccaccaaagcacctctttcttatgttggctgttaccaaagcctatcagacattccctctattaaccctacaaccacagaccctgtccttacctgcaaattcacgaacacttcctcaggcccaggaagaactggacgacttctgtctacctatactaccagcaaatgattaagtcagactgtcaggacgtctacaaccctcttattatatgtttcctatattctttcaactctgatcagttgttgggggaagtcagggaccccgaatggagggactggttgaagccatggcagaagaatgtgaattgtgaagatttcatggacatttattagttccccaaattaatacttttataatttcttatgcctgtctttactgcaatctctaaacataaattgtgaagatttcatggacacttatcacttccccaatcaatatccttgtgatttcctatgcctgtctttactttaatctcttaatcccatcattttcataaattgaggaggatgtatgtcacctcagtaccctgtgatgattgtgttaactgcacaaattgtagagcatgtgtgtttgaacaatatgaaatctgggcacctcgataaaagaacaggataacagcaatgttcagggaataaaagagataaccttaaactctgaccaccagtgagccgggcggaacagagccctatttctcttctttcaaaagcaaatgggagaaatatcactgaattctttttctcagcaaggaacatccctgagaaagagaatgcgcccctgaggataggtctctgaaatggacccttgggtctggctgtcttctatggtcgagctgtagggatgaaataagccccagtctcccatagcactcccaggcttattaggaagaggaaattcccgcccaataaatttttaacagactggttgctctcaaaccctgtctcctgataagatgttatcaatgacaatggtgcccgaaacttcattagcaattttaatttcaccccgtcctgtcctgtggtcctgtgatctcgccctgcctccatttgccttgtgatagtctattaccttgtgaagtacgtgatctctgtgacccacaccctatttgtacgctccctccccttttgaaaatccctaataaaaacttgctggttttgcagcttgaggggcatcacggaacctactgacatgtgatgtctcccctggacgcccagctttaaaatttctctcttttgtactctgtccctttatttctcaatccggccgatgcttagggaaaatagaaaagaacctacatgactatcgggggcaggttccccaataatcagtagccctgagactataagttgaagtctgcttactttgctataattactatctggaaagctgacttgctattcttataaatataatcctagcattgcaggataccatgggccatcttgccaatctccttgctgcacaaacttgctaagcccattacatatgcaagttttatcattataatcataatcatcaataccattgtggctgaggttgatgttatgattgccatacattgaaaagtagctatgtaagtcactaaacaaacattttatctccacttaaatatatttgtttgtctgaaataattacagagagaatatacatagatctatgtgtggacaagcctatctgtgtacgtgtgtgtacatatatttgtgcacaggcctaaacaaatatatatgtatggacgtatatgaaactaatatgtaatcagttaaaaagttaggttaatatacataggttaacatgtatgtatattaaactaacaggttatcatgaatgtgttatttgaactcatagtcattaagagatgtaaaactgttaagatttttcactgttggaaaacattggagagcctcaaaatatttaaacatctaatctttaagttgaaatgattcacactaaaagaaaataaaaatatctgagcatatttattcaggagcagcagtaaattaagaaaccaagagtttttttaatgagttttcactatattaatttcaagctatttattatgttatgggctgtctggtttgttaaagcctaattaatgtaagtaaagaagacccaagtaatcattaaatatatcactatgaaatgaattttagataaaagtaccattactttaagagaggaaagaacacataattgccatggttgatattaattttaatgtcatggaaaatttatttagtaggaagatgcttgcaagtaacatctgaatttttctctttgtttcaatatccatgtaaacctgagagaaattgcctagtagattttaaaaatctatagtataggtgttttaatcaggggtctccagagaaacagaaccaataagccaattccttataataaatacaatttgatataaagaatggctcacattattatggtgactgacaaatcccaaggtctacagggtgagttggccagctggagacccaggagtgctaatggtctagttcctgtccaaaggtcagtaagtttgagtctcaggaagagcttatttttcagttcaaatcagaaggcagagaaaagccaatgtcccagtttgaagtcagtaaggtggggggaaatctttccttggagaaggtcagccattttgtcttattcaggctgtcaaccgtatgaatgaggcccataacattaggaagagtagtctgccttactcagtctaccaatttaaaggtaaatctcaacctaaaacaccctcatagaaatgctgagaatgatgtttaacctgggcactttgtggtccagtcaagttaacacataaaatgatcaccacattaggtcaactctcagaatgcagaatgttttgcctttactaataattcatgctaaaggaaaaagtgaacatgagtagttacagccacagataatataagatactgtaagtctggtttcaaaaagcattatgtgaattcttcacatgttattttcaatggtcctccttattcaatagttttaatatatacctggtatctgccatgtctaccacaaaggtagacaaaatgctcactggggtcctagtcctttttacctcatgcctacctggccaccttatagctgctctctcttcaagacaatctactttctacatatttactacataaatattcctggctgggtatcgcagctcatgcctgtaatcctagcaatttgagagggaaaggtgggcagatcgcttgagtccaggaattcaagactagcctgggcaacatggcaaaaccctatctctatttttttttaaatgtctaatgaaaaaagaaatcctaaaacactgttattattacaatgctcccctggctcaggaacctaccatggctcaccagagaaacaaaggtagattaactttcacctccacaaaaagactatagctattattgtgtacaagtatttttttttaaataaggctaaagtttctacactgactttcagaatttcagagaggagtccaagttgtaagccagctggaaacaagatgactactataatggcatgagagtgttcattaagcaaattgtatcttgccttaaggtatgtatgtggggaagggggtgtatagtattagacaatgcttcatttaactagactttcttttcttcatcagatttgtttacttctcctatactctaggtctacgctaggctctagagtttcaacgcattaaaggtacagccccctgatggaactaaatagagaacccagaaataaacccattcatatatggtcaactgatactcaacaataaggaaagaaagtctcttttataaattacatttgaaacactatctacatgagaaagacatttgccctttatcttacaccatacacaaaaatcaactcaaaatggattgaagatctaaatgtaagacttgaaaccattaaaagcctaggaaaaaaacatggagaaaatctccttgacattggtcttgacaatggttttttggctagaacaccaagagcacaggcaagaagagcaaacaataccaagtgggactgtatcaaactaaaaagcttctacacagcaaaggaaagagtcaacaaaatgaaaaggcaacatgtaatgagagaaaacatctgcaaaccacatatctaatattcaaattatatgagaaattcatacaactaaatagtaagaaaatgaagaatccaattaaaaaatggacaaaagacctgaataggcatttccaaaagaagatatacagatgttcaataggtatatgaaaaaatgttcaacatcactaatcctcagagaaatacaaattaaaatcataatgaggtatcactacacaccttttagaatatctattatcaaaaatgaaagataaatgctgtcagaaatgtggaaaaatgaaacttttgtacatagttcgtgggaatgtaaattagtgtaaccattacagaaaacagtagggaggtttctcaaaaaattaaaaatagaactaccatatgatccaacaaatcactactaggtgtatttccaaaggaatgaaatcagtttattaaatagatatctgcactgtcatgttcattgcagcattattcacaatagtgaagatatggaatcagcctaagtgtctgtcaatggatgaaatggatgaagaaaatgtgatatgtatatatctatatatatgattctatatatataaaatatcatatatagattatatatcacatagagagagctccatatatatatatggaggctgaatagtacatacagtagagtactattctaaggaaattctgtcatttgcaataacatggatgaacatggaggacattaagtgaaataaggcaggcacaaaaaaaatacctcataaactcagttatatgtggaatctacaagagttgaactcatggaggtagagagtacaatggtggttacaccaggggctggaatacttgggaaacgaaggatgtggggagcagttggggagatgttggtgaggggattcaaaattttagacaggaagattaaattttaagatgtttattgtaaaacatggtgatatagttaataaaatgtattctacccttgaaaactccataaaaagtagaatttgtgttctcactgcaaaatatgtgaagtaatgcatatgttaattagctcaatttaaccattccatgatgtatgtgtattacaaacaatatgttatacaaaataaatatataaaattttttgtcaaataaaaagttttgaaaaaacaaggaaaggctctgaatagacgtatttccaaagaaaatagacaaatgtctaacaggtacatgaaaagatgctcaacattaataatcattagagaaatgcaaattaaaactgcaatgaaatatcacctcacacctattaagatagctgctatgaaaaagacaagaagctaggtgagtagctcatgcctgtaatcccagctatgcagaaggctgaagtgggaggattgtgtcagcccaggagtttcagaccagcctaggcaatatagcaagatctcatctctgtttaagaaaaaagaaaaagaagaaaaagaagaggaggaggaggaggaggaagaagaggaagaagaggacgaaaaagaggaagaggaagaagaagaaggaggagggaggaggaggagaaataatagaagacataagtgttgcaaagggtgtggagaaaatgaatccttgtacactgttggtgggaatgtactagaacagctattactgaaaacagtacagaggttcctttaaaaatttaaaacagagctaccatatgaaccagcaatcccactttgggtatatatctaaaaaataaaataaatattttggggagatatctattcctccttttccattgtagcattatttacaatagggaagctatgaaaacaacctaagtgtccatggacagaagaataagtaaagaaattgaggtacatatatacaatggaatattattcaaacattaaaaaaagaaaactcgtcacttgcaacaacgcggatgaactcaggggacataatgctatgtaaaataagtcaggcacagaaagacaaataccattatgttctcacttacacaggcataccttgtaaacattgcaggtccagttccaaatcaccacaatacactgaatatcacaatacagtgagtcacacaaatattctggtttcccacataaaagttagttttatactctataatagtctactaagtgtatagcagcattatgtctaagaaagtgcataatttattttaaaaatattttattgcttaaaatgctaattatcatctgaggcttcagcaaatcataatcttttggctagtggagggtcttgcctcaatgttgatggctgctgactgatcagagtggcggttgctgaaggttggaattgtgtggcaatttcataaacgagacaacaataaagtacggcattgattgacatatccttttatgaaagatttctctgtaacatgttatgctgtttaatagcattttgcccagaatagaacttctttcaaaattggagtcaatcctttcaagccctgctgctgccttattaactaagtttatataatattctaaatcctttgttgtcatttcaataatgttcacagcaccttcaacagaagtagattctatctcaagaaaccactttctttgatcatccataagaaggtactcttcctccattcaaatttgattatggaattacagcaattcagtcacatcctcaggctctactttctaattctagatctcttgctatttttaccacatttacagttacttcctccactgaagtcttgaaccctttaaattcatccatgagggttggaatcaatttctgccaaacttctgttaatgtttatattttgggctccttccattaatcgtgaatgttcttaatggcatctagaatggtgaatttttttcagaaggtgttcaatttcctttgcctggatccataagaagaatcacaatctatggcagctatagccttataaaatacatttcttggctgggtacatggctcatgcctgtaatcccagtattttgggaggccaaggcaggtggatcacttgaggccaggagtttgagacaggcctggccaacacagtgaaaccctgtctctactaaaaatagaaaaaaattacctgggcatggtggtgcatacctgcaatcccagctactcaggaggctgaggcatgagaatcgcttgaacccaggaggtggaggttgtggtgagcccagattgtgccactgcactccagcctggatatcacagtgagactgtctcaaaaacataaagtaaaataaaatatatttcttaaatagtaagacttgaaagtcaaaatactgcttgatccatgggctgaagaacagatgttatgttagcagtcaagaaaacaacattaaagtccttgtatatcttcatcagatcttttgggtgaccaggtatattttcaatgagcattaatgttttgaaaactatcttcttttctgagcagtaggtctcaacactgggctgaaaatattcagtaaatcatgctataaacaaatatgatatcaactaggcattgtttgcactgacagactagatttagcataattcttaagagccctagggttttcagaatagtcaatgagcattggcttcaatttaaagtcactagctgcattagcccctaacaagagagtcagactgtcttttgaagctttgaggccaggcattgacttctttctggctatgaatttctagatgacatcctcttccaagagaaggctgattgacctacactgaaaatctgttatttagcatggccaccttcatcaatgatcttagttagatctttgggataacttgctgaagcttctatatcagcatttgctgctcaccttgcacttttatgttatggagatggccttttttcttaaacctcatgaaccaacctctgcagcttcctctccactatcagccttcatagaattgaagagagcagggcttcgctctggattaggctttggtataaaggaatgttgtgactggtttgatcttctatacagatgaatcaaaactttataagcaataagactgtttcactttctcatcatttgtgtgttcactggagtagcacttttaattttctttaagaacttttcctttgctttcacaagttggctagctggcacaagaggcttagctttcgccctgtctcagctttcaacatggcttccttactaagcttttgacttaaagtgattcttcctttcaattgaacacttagaagtcattgtagggttattaattaaccttatttcaatattgtgatggcttacagaatacggaggcccaaagagagaaagagagatgggagaatagcaggttggtggagaagtcagaacacacacaaaatttattaagtttcccatcttatatagatgaggtttataatgctccaaaacaattataataataatatcaaagatcactgatcacaggtcaccataagagatgtaataataaaaacttttgaaatattgtgagaattaccaaaatgttaaacagagatacaaagtaaacacatgatgttggaaaaacagcacccaccgacttgaaatagagttctcacaaaaatgcaatttgtaagaaacacagtacctgtgaggcgcaataaaacatggtacaccaaaagcaactgcaacaaaagccaaaactgacaaatgggatctaattaaactaaagagcttctgctcagcaaaggaaactatcatcagagtgaacaggcaacctacagaatgggagaaaaattttgcaatctatccatctgacaaaggtctaatatccagaatctacaaggaatttaaacaaatttacaagaaaaaaaccccatcaaaaagtgggcaaaggatatgaatagacacttctcaaaagaagacatttatgcggctaagaaacatgtgggaaaaaaaagctcatcatcacttgttgatagagaaatgcaaatcaaaaccacaacgagacaccatctcacgccagttagaatggtgatcattaaaaagtcaggaaaacagacgctggtgaggatgtggaaaaataggaacacttttacactgttttggtgggagtgtaaattaattcaactattgtggaaggcagtgtggtggttcctcaaggatctagaaccagaaataccatttgacccagtaatcccattactgagtatatacccaaaggattataaatcattctgctataaagacacatgcacgtgaatgtttattacagtactattcacaataacaaagacttggaaccaaatcaaatgcccatcaatgatagactacataaagaaaatgtggcacgtacacaccatggaatactatgcagtcataaaaaagaatgagttcatatcctctgcagggacagggatgaagctgggtaccatcattctcagcaaactaacacaagaacagaaaaccaaataccacatgttctcactcataagtgggagttgagcagtgagaacacatggacacagggaggggaacattacacaccaggcctgttggcaggtagggaacaaggggagggagagcattaggacaaacacctaatgcatgcagggtttaaaacctagctgattgggttgatgggtgcagcaaaccaccatggcacatgtatacttatgtaacaaacatgcacattctgcacatgtatccaagaacttaaagtaaaaaaaaaaaaaaaaaaggtatgcctgtatgtgaaatctaaaaatgctgagctcatagaagcagataatacagtggcattcttcaaaggctagtgggtggggaaaatgagtaggtgttagtcaaaggatataaactttcagttataatgaatatgtttgatgatctagggtacagcatgggtggggatggatgtgttagtttaattgtggtaaccactacacactgtatatgtatatctaatcatcacattgtacacattgtacaccttgaatatattcaatctttcttaattaaacatttttaaattaaataaataaatgcatagcctctttcatgaagctcagaaacaagcagaaggtaattcaataatgatagtattggctgggcacggtggctcacacctgtaatcccagcactttgggaggtcgaggcgggcggatcacttgaggtaaggagtccaagtacagcctggccaacattgtgaaacctcatctttactaaaaaaaaaaatacaaaaattagctgggtgtggtgatgtatgcctgtagttccagctacttgggaggctgaggcagggggattgcttgaagccaggaggcagaggttgtggtgagcctagatcgtgccactctactcccgtctgggtgacagagcaagactccatctcaaataataataataataataataataataataataataataataataaatagtatctacctacaaagtgcttactttgtgccagatgttgtgcttggcactttacacatttaagtcatttaatttccacaatagtcctatcaaggaggttctcttattatctccattttacacatggaaaaaacctaagttacagaaaagctgaataatttgcttaatgtcattcactaagtggtgtaaccagaatttgaaccagacagtctggcttcaaatcctgtgcttttaaccatgagattctactgtaaaatttatcaaagaaaggtttcctagaagtgtaatgggagcccagatgaaatgcaatataggcagtggcttcacggaaaagatcatcccctttttcatatatacagttgacactcaaacaatgcagaaatctgcatataacttttggctccccaaaaagttaactacttatagcctgctgttgaccagaagccttactggtaacatatacaatcgattaacacatattttatatgatatatatgtgtatatatatatataaacacactctattcttacaataaagtaagctagagaaaaaatggtattaagaaaatcataaggaagagaaaattcattcatagaactgtattgtatttatcgatatcataagtgtatgtcatctgttgtcaaggtgaaacttctatctgaaatggtaggcaaccacggctgcagatctcaatctatggtacatatcaagcaagccaactttttcctgtaatgtcgtgacttttctctgtttcttgggagcacttcaagcattactactggcactttgtatgggtcccatggtgctttcaaggtttacagtattgcactaaatgcaatgaaaaatgcaagaacgttgacacatcactttttattgctatacacaatttactggagagatgaaattgctcatgtggagatgattagcatcacaaggcattttaagcagatactcacaacacttgagctcaccacaatagcagcagcaggtggttacaaaattattacagtagtacatatgtattactgttcatttcatgcagttatgatttaatgctgcacccttaagtttgtttacatttctctcaactgtaaacggcaccatgtatggtctgaaagtgtgtaagttttgatgaactttaacttttataatagattcatgtatattttatggcagtaaataataaaataggctagaatctacattttttacatttgtggtatacctacctttctgattttttgctacttctaagctacataatttatctgtgaattatctcaaattgtcacaaatctccaaaaaaatttccaatacatttattgaaaaaaattcgtggataaatggatccatgcagctcaaatccatgttgtttaaggatctactgtatttgtttgcacccatctctatctctccaacaccaatattcaaatatagctaggccatgtttctatagctaaaattttgcttttgtaggctgaggtaaccttactcctatcttttcaaataccctttctatcactgccaatggcttttctgtcccatttcctttatggataattccaaccaaaactgattttattttttctgaccaccatgataggttattaactgagcatgtattttcacagttgcttataattgaactctgttctctaattttttttcacatgcataagtcctttcacctaaaatagattttatatcacctaggcataaatatatttgcatcctctagagcagacagacatatagtaagtgcttaataatactcagtttgacacaatttaattgaattaagaagcatttaaatttaggcaggaaaactgaataaacattgaataaacacttttttttctctctctaaaatgctcatctggcttctttttcaaaacagtttttttttttccttacatatagtcagggtcttagactcctgaattgtagtctaattggcctaatttgagactcatgttggcagcaacaatttctgtaactatctggagttgtgaagcagttagccagagaagtatatttgacagctaagttatttctctacagaaaaaaaaaaaagtgttgaaattcagaaagggatcagttaggcttgtaatagttactgtttttctataacaccctttgctccccgtggcatctgcctatgtcattctccttgggtgctgagggtgggtgctgctagaacgtatgacttcatgatgcatcactcaggattccttccctaaattcccctatgaaatgttggttttcacctccatcatcctgatgcatgctctcttttgtccaaaacttctactctgttgtgtattctatgtgtgcctgtgcccagaaacttcaagagccaaggactttcattctccctgaggatgtttctaaggatctctctactctcatgtatgattttttacaatgtttgtaggtagaaaataaattatcggtgaggagagagaaaatgaagaaatgggagtgattgagaggaaagcatgagggagaagaggaagaatcatgaacatgagtggaggggttattctctaagaggccagcatgctcttcttccaccagtagggaggaataataaacatgtcaagaggagcagaaaaaagataagagttccttaaaatcttttgaggtggagaaaaggaactacatgaaagatgatggtaaagagcctaaaacttttccctgaagaaatagggagtaagatcatttgcctgagagatgcagcagattatgaaaatgacttgggaccatctttgtgagatttgggcatctattagagggtcatgattgtggtgagcacctgaatgaaagtggctggcacaaatgtattatggtatagtcactgaaatctatggccctcaggcaactctggatagggaagagagagaaagtatggacaatggagctgatccctgaggcaaataattctagaagggtggagatggaaagcactggtgtgactgacaggaaggtcgaggcttgtggggtggagggtgaaataagagttgtggagatttcatgtagcatgcatgtgagccatccagggacacgagtgctgggagtaagcgggctcaccagacacagccatccttcaccctccttcacaccaggagggcagctcaaacatgtttgggacatacaactatggactttgggacatacaactatggacaaagcttccccaaaaagagacaattaggaaaagtaatacaggccaataaccatgctttctctacatactatttcaaataagtagactttgtagtgtaacctgcatttctacttcaaataattgtggaatctaacattttaaaatacattccctttatattacatattaccaatttacatacttgtaaaaacataaaaatttaggaggcaataatttatttactcaaaattataacaggacttaaattaccaattattttggttaatatcggaataattttatggacaaaaaatcatttacttagaaaccgtgctaagaacataaatttaacatcatctaaactctttgcttatttctaggagtaactctttcataagtacatagttagataggttccttagtttgaatggtgatgtctttaataacttcggtgttggccgggcgtggtggctcacacctgtaatctcagcactttgggaggccaaggccggcggatcacaaggtcaggagatcgagaccaccctggccaacacggtgaaaccccgtctctactaaaaaaaaaatacaaaaaattagcagggcgtggtggcaggcgcctgtagccccagctactcgggaggctgaggcaggagaatggcgtgaatccaggagtgggagcttgcagtgagccgagatcacgccactgcactcagtgtgacagagtgagactctgtctcaaaaataataataataataataacttcagtgtttttttctctatttactcagttttccagagggaaggctaagcttgttccatattaggaggttaaaaaaatgcgtacttcagtgaccaagagtgtttatacctgactattttaggctcaagctctagggtgggggtatagttgattcacagattttttggattttgattctgaaatttcatatcctggggtgagttatttgcaagaatttgtagtgatgagcttttgtctccctgtgctagtgagttgttttgctgctgtgtggtggaggccaggacttttcagggtgatgcctccactagctactttgcagggcatcatagccaactgagagtcaaaggtagatgtaaccacatgtgaacttcagactttccatttgacttgcatctccagccctctagaattattcactgcagggatcagctccattgttcatgctttctatctcttccatgtccagaacggcctgagtgccacgaggttccagttactgcactattatatgttcgtgtcagccactttcacttgggctctcaccatgattatgaactccttagagatactcaaatacatttctcatgagggtagctccaaatcattttcataatctgccatactttccagctaaataaccttactatctacttctttaaggaaaaatattagggtctgtaccattatctttcatatagttacttttatatactttggaaataatttaatgtaaaatcaatactgcatattgtgggacaatggaattacctgggttttggagtcaaacacatgtgagttcaattcttagattagctactgaaaaggtgggagggtttagaaaaattattaaagctctgtgaactccagatctttttttacctaagtgtgtattataataatagacactttgcaaagttatcataaaatataaattaataaatgagataatattgatgggataaaagtattttgcataatttttggcacacaataaattatcacagtatgcattaatcgttttaacttactgagtgatataaaaggatattttgaaagtagttgttattaacacaaacatagatttcactttctaaactacattaagtggtcaaaataaaatgtttactcaataaagtattcatcagcatgtttttaaacctataggaattctgctgcaatcatattccagtaactgggtaggtctggttcaggtattgtactaaaaggagtcatgaactaggttgtaaatgattttgtcaaggtgtcagtcatgtcatacatgaaagtatgctgttgtaagtctgtgagagtcaacatgtgtgaaaaataacaatgaagggccaaggaaccaccacgacaccttacagaggtgtattattggacagccctgtgatagctgtgatagctgaagtttgcccaggctgtgatccactagtttttagcagggtaatctttctgtgcaaaaatgccacacaattcaccaggcctccagggagctgggaaatcacaaatagacagagacttgaagagtgggtggatttttttttttttctttaaagcagcagctgttagtttaaaagatagtctttagtcttgaaaaaaaaaaaaaagaaatacaaggtatttactgatttctatagcaagttctatattttttcttttcccttacttcttctaattccaatgttatgttttttaaagtaatagtgataattttatcagtgtctctaatttataatgtctctagtaagagtagctgttatatcaatatactataaacataccctttcttacttgtcactccctcctctccttctgcttcttaccttcctttcttgtctctctcttcctgttcttcctttattatgtatatttaactcatgttattctcacaattttttttttttttttgagatgggatctggctctgtcacccagaccggagtacagtggcataatcattgcagcctcaacttcctgggctcaagtaatcctccttcttcggccttctgagtagctgggactacaggcatgtgccaccaaacctggataattttttaaatttttttttgtagagacagggtctatgtggcccaggctgttctcaaagtcccaggctcaagcgatcctcctgcctcagctgggattacaggtgtgagcaactgtgcctgaccacaagttgcctcttaaatgaataagtggttattagagcagtcatcattcttctgacagaaaaccttcctgacaagggtttcatatgtgaatataatgaaagcaaaatttaacttttaaccaaaaatgttgcagtatattcatttgaaaaggatgacacagaaaggataagtagattatttctgagaccccatacacactgtctttacaattccaagattcataattctaatatactaataaaatataaaacttttagtgtttataaatagacaaaaatacatgtggatctcttataccaactgaattttatatattaatacttcctcgaccaaaggtatttctttgtaatttttgtcttacttttacaaaacaggaaaatgagaaaaaagtaaactttcactagacagaggtagaattttcattggcatctctaagaagagtatggggagactcagagctttcagatggcttttgaggaaactgctttgtgtttattttgctgccttccttcactttttccctctagcaaacacagagattaaagatcagtgtgttggccattctactgtcatcacaacataaaatgttttctgctctcttgagctgacatctcatcagcactaacagcttgaccctacaccccaatggtatataggatatacctgtctttaaaatgtgtgaacagaatgttatctgcagtgatttttctttttatcctttgatctgtcactatttcttcacaatgtcaaaagcctcagggcttggcttgaatggtgatcaaacccaaaggcacacaattttgggtctaatcctgaatctacacaatcaaaaatcttttcaattcagacccaaacaccatactttgtcttacaatactgaagtgcagccatcactaaagcactgctttcccctttgagctttttaaagaatgaatataatgaggttataaagaaatgaaacatttcttttaccaactgtactataataatacatgcatctaaagaaatgcatgcttccatgacctttcagaagattaaactctttcttggtgttgttgccattgcccacaacacttattgtgaaatttctttgaaatctacttcaaagatattttcccaggttcatcaaaaaaatcaaagtgatcaatttattttcacagaacattcaatttacctaatactttcttcctttcattctttctttacctccttctacttagacttgacctctcctgcactcctctgattgttgattcgctttcatttaacaaatgttaattgaaaatcaagctctgtctgtgaagatgacttccctctacctgtattaaactgtactgtcgaaaacttcctctaagtctctctaccccattctccaactttgcaaggaacaacactcctgatggtgcctcttttaataggcctaatcctcacctcattttgtagaccctctagctgttctgatttttttgttgttgtttgcttttttgaagattaggctaggacaagacctcctaatcccaggatttgaaagacaaagttgtaccaatgaacacttaagcagagggacatcaggaggtgactaatttatatgcatgtttctaataaaattatgaactatgactgggtatcatgaataactagaagatactgttccatcaaatctgcacggacactctattctttaactttcctcctgggcgtcataaaaatttttaatcttatttccaactggacctctccagaaccctgcatgaggaactcaacccaacatgtttaaaactaagtgtattttctctctacagagtgcccttcctcttatatttattttaattagcaacacttccatcacctaaaggaaagtgagttagcctagattctattttgttatccctttcatctagccaagtatcaccaagtgtcatacaatctatctcctacatacttcttgaatcagcctcaggttctgcatctagtaccacagctctcatcatcatccactagatgaatgtcatagccttttagatctttctgcctcaggatcatctctctccaatcagcccttcatgggactatgaagatgatctttctaaaaaacaaactatttatgtcactgtgtagcttaaaaagtctttcttgtttcctatagccttgaagataattttccaactctctgctactgcttatattttgagcagctaatgctacccttttctcactaaagaaaccaagcacaagcaagaatgcatccatgataacatgttctcccttctcatcttctgttttgagcagtcttcttacgtatcacaataataattgtgggtcatttctatcacagcactgtcacattataacttgttctcttgaatgaacttcataatctttaaggagaggggctatcacccaatatttggcacagtgcttgtgataggcagaatcatgcctaatcctgagagcctgtgaaaaaaaatatatataattatatatataatatgttatatataatatatatgttatagataatatataatatatgtaaatatataatttacatatattatatataatttatatatataatttacatatatataaattatatatataaatcaaatcagacaaggctgtgcatttgcaggttttctttggagggtgcttttccctttattaataaagaacagatcaccttatttcctcaggaagaggtagaaattgaagggctgtaataacgcccctttctctgcctcttcatctagatgaaagcagatctaactgcgggtggcattaaaaaacatgatgtgaagaggtataagaaatatcttcttcacaattatgcctccttcatgagacctcttacatttctttatttcacctatatttagaaattatgtcaattaagaatccccatttgctgttagctgttggcttcatttgagaagttactacagatgtagacctgcggccaacggaacaggcctgggtggaggaaatagaggcccgcaaactgatctggaataaagaatgaataagccaagaattaaagacccccatggatgctagaattcagaacatgacagaatcagaacaatggctcaagaatttgtaattattaatgctcagaggcgaaccaaaaaaaaaaaaagtttcactttaggcaacaggacacccactgccaaagatatcaagggaatcagtgttcttgttaacagcaatactttgggaagctttgcactcataggtgtgggcaaatgaaagtgtagttatactgaaaacaatgatctgtagagaactttgaaactccaagagaattttacaattagctacatctttgtgtgaatcatctaagcaaactctatgtctcctaacatctacttaagttcggccactctgggcagtgggtgaaaagtaagaatgttgaagaattttaggtcaaggtaaaaaacacaagtgatcagaaataacaagaaggaaaaaatcagaaactgttaattttagtaaaggcagcacctatgcatatgatgcactcctggcctccaggagtttacatttgttagtttcccttcaaaacctaacaacatttacatagagggcatacatttttaaacaggtgtctgtgtgaggtgattaagtgattatgtttttatgttttctctgcttggagatatcgtgattcacttgagtcctcctctcaaggcttagaggaaggaagccgactcagctactactgtgagttctcttcaatgagatatggaagattagctaattgttcaccaaactgtacctcttttcctcctgagcaggcagctgtatttcccagcatcccctgtagttaagcgcaggcctgagttctgccaataaaatgcaagaagtgttgcatgacaattccaaatctggctctgaaaggcttcctgctgagtctcccatgcttattatcttccctcaattgactagtgaggtgcaaatatacagcaggaaaactcgaggccctagaggatggccaagtcactgtgtgaaaggaaccttagttccctgaatgattgcctggaggaaaagtccctctcagcctcacttacctgcactggactgtgataattataaagcaatcagcctttttcatgtcaatccactgagagtctggcattgcttattacaactggttaacctaacaaatatgtatgggtatctcaggaatgcttcatagtgatccatttatcttctttatggttgtggaaagtgtgtaacttaagaacacttttatgtaaagcacattttaaaatatgtgcctgaaaagggacagctgaaaacatgtacatatgtataataaactatttgcaaaaaaaaaaaaaaattggggggctttgactgttttaatacatctcctgttatcttcaaaactgattttaagcagtactttaaaaagaagtgaaaaatcactggcttggggaagagaagaaaatgaaataaacaagacatccaaagttacttgaatggatgcacattcttatatatagctggaaacaaatagtactttgtgtcaggttttacagtctgtgggatctctcagatgaggttcatgctgtgaaaatgaattgcaaaggagatgacaagaacagatgtttgctcaagatgactgaagatgtttctgaaagcatcaaagtgtacagtctacaagttatcagcagacaggtagattgtagccaacttttagatttgtattttcagacaaaattggcttctctaagggtagttttattatacttggtaatgaaagaaagtgatctgtgtgtcacttttaacttagattgtgaataatcacgtacataaatacatgtgacgcatgtttatttcaacccaaggcatccctctttacaactgagcaaagaacatgcccttgtcaggccccagattgtgatgctcaagacctcacaaatagaagcaggaggccctatctgttctttccaagacttacactgcctaggacgaaggtccacaatccctatgttgactaatagtaaggctaaaagtggaaggaatacagaataatccaatctggtccactcctactctaaagccctgactgtaacagaatgtcttctggcttccaatagaaacaaggaatgacctagaagctaagaatataagcttatgaggccgacttaaccaattatcaggttggacatttaaatgtacctgtgttatataatggctgttcttgcactgcaataaataaatatctgggactgggtaatttaaaaagaaaaggggtttcattggctcacagttatgcaggttgtataagaagcacggcgttggcatctgctcagcttctagagagacctcaggaagcttacaattatggcagaaggcaaagcgggaacaagcatatcacacggccagactaggagtaaaggagattgggttggaggtgccacacacttttacacaaccagatatcctgtgaactcaagagcgagagctcacgtgttatcaaggggatggcctaagccattcatgagggatctgcccccaggatgaaaacaccacccaccaggccccatctctaacactagagattacatttcaacatcagatttgggtagggacaaatatccaagctacagtatttctctgtgtttcattttgaagaaaatgttaaatggaagtaataatattttctcacagcattttttgagaagtaatataattaatacatgttaaactcttttaagagtgtctgatgaatagtaaactccatgccatccactatatcatggttatcattcatggatcaggttaaaaaaaaaacgtagaggatagggaagtccccattctagtggcagtcacagaccccttgttctgtgattcttggagagcaggcaagcccctacttcagtggcttgcctgctagatggaccaggagacttggagtcaatagttctttgatacactaatccagacccttcacaagcatgtggatccagactcctaaggggtgatacacctctgtgcctgtgctgatgagcgggtccctgctctggccactgctttgggataaaaagcttctcccaggcaaggtggtcccaatcctccaagtggtcaacaatttctgtcacttactccccatcctggcccagaacagggctggggccctggtcctattgccattatcttccccaaaatcctccagaatctgatggcccttttctactagtgagacagagtccattataattcagaaaacaaaagaggaattggaaagtatctgcccctatctcccagaaaaatcttcagatttttataaaaattggtatatcttactgcagagctatacaaagtgaaacaagtgttttttaaaaatctgaaactgtaagcccagcaaaccttccaatctaaagaaaattctgacaaaaccaagataggccacccaagatttgctccaagaaaaaaaaaccatttctggtttgcatgagtaatgtgttattatttataaaaatattgtcaagcacttaatataaatttacatattcttgatatatcattttcctctttaataaaataaaattcacccaaagtatatcatagttctcaattagctatgttccaattactgcataactttttcataaattctatacatacttacgtgtatttaatcataaaaataaaataattttaactattatctaaatatatttaaaccaaatatttaagtaggtaaatgacataaatatagaatatttacatacaatattaatatatatcaatatataggttcaacaagactgcatttagaatattctatataattctgtgggttgggtatgacacatttgagtgcattaagaacatactttttaaaaaatgctgatcattgacattcatatattaatacatgaaatctgtatatatttagaaaaaatatttgattccaactttaattgcctcagaataatgtaagatttttaaatatagtatatgactacatgggaatttaattaaaaacctatgcttaatgaattggtacaatgaagatcttaacaactcaatgggatcagtttccatataggtagatgtcccagatacaaacttttctaacttccccctaaaataactataaacactaaggaaaacataaaaggaaatacctcatttaaagcaggtacttacagtaagcctaattccaggatctggaaagaatttcaaaatggcttaaagtggattttaaagcatacctggtggattgcccagaacagaaaacacttgctcatctgaaatcatacacacacacacacacacacacacacacacacacacccctaaaaaaacaaaactataggtcctcccctgctgtttgcctctccacactcaatatctatctcccacaacctttaagacataatagaattttaacaacctgaaaacttgagtagctgggcattacagccagctgggatgtgtatagcaagtagttttttactagtattattgtatgtacacatgagcacaattaatataagattacattattgatgcttacattctgatatgattgacatgctgaaaggggcggagctactaagccctatagacacaaaaggaagtgagtcatgcatgtgaacctcattttaagaaatgccaggaagaaaattgttgagaacttgtctactccacagccactgctttaaaggcagcatgagtaatctatctgccactatccgccacgcaccctccccactgccattagtgctctcttcacagatccagtaggggactgcagcacatgggtagcaaatcaaggaagggagaaacacgtgaactaaggccattctcacagtgctgtgccacacaaagctcctcctgtctgtgcccttgctgacagcgctgcttggaatgctatctgtgcagaaccactaatttccctttgcttcctgaagaaatatggaccccagctggctggctcacagcgggagtagaagaaaagatcccattgcagagcagtaatgatgcagaaaaggaaagcctcctagatactaggaactgggcttggagctttgtgttccaattgtcttctcaatctgtgaaagaccaaacaaaggagcagagaaagaatctcagaaaagcagcatacccacactggctctggagaggtgggccgtccacacaaatgcacaaataagaaaataaaaacatacagtaactttgaaaaacactcgaagacaaggaaaacttgat

SEQ ID NO: 27 - DNA, 5861 bp, Homo sapiens
aacctaaaggcatttatcaagggcaaaaatttgagtaaactactaagtttgcaggaggttttgctttgggaggagtgtactccttgcaggtcgccgggcttcaaaaatcctgagaacatgctcaagagggactttgctgaggtcaaggacataggcatactatttacggaggtgagcagaacaaacaaatattggagaaatatttgtagaagaatcttctgcattccacaaatattgcaagcaagcacggggccccctaacaaacagggttttgtaaaggaatcaaaaagcagtgtagaacaacagaagctgtttgggggatttcataatctcacccagagaaaattcaacctttggtggctttcccctggtgtgtatgtgctacatttcctgtccttctcagttctgggaattaacccactaagctgccagcaccaacttacttgtgctcttctgataaatgctcaaattttgaaaattcaatattttaaatttccccaactgttaagtccttcgagatgacaaggcatagtggcagttattgcaatgacattttcatcaaatgatgcactctttttccagtttctataaaagtggcagagaaaggtcatcctggtaagtcaaaatcaccgaacttcatcatatcaaagagggtaagtgcactgaaagggctatttgcatggaacccttgtctaacagtaaggcaatttctgaaggtcttaggggttagaacaacttccatggtgtatctcttccgtctctaaatactattaataataactatcaaagtcagcattaagggggaaaatgatataaaggcagcctgagagatgtgcgcaggtggaaccagcttcacgtttgtgcaacctgagcagttgcacagggccctgagcgcagaagaaacacatgcctctattatctgctgatactatcctgaaattgtaaataattttatttttgaatttgtgttttagaagtgaagtcctatgtgcaatgaaggatgcacatgcgcagaggagacaggtggtataatatgtgtatctgtcctatttgcatatagcattttcaatgccctagaagcacagaagtctggtgagctcacagtaagtttagtaagattcaaagaatatggcgtaagtgtgttatgtctataactgagtaaacaaggttgctggcagccctgggagataatgcttcctatctgaaccagaccctgcttcaaatgcagcaagaaggcaattttttcaagaaaatacaaacgaccaagaaaccctatcatatcctttcctactcctgttatgttcctatatgaaccaaccacttatgctgaaattgatgatatagaaagaaagggaatcttgtgactttgggagttacctagccctgcataagccttagtttctgcttctgtaaaatgggaacaataatacttccataataagattgtggtaagaattaaagagtgcataatgcacttcacagagtgaccttgtataacaactaaataaagtatgttacggctgtaattattatcaaattcctctgcatatataagaagtgttttgaagcataaattgccccaagattaccttcttaagtcactgttcaggtttcaggagatggaaaattattgtcgaaaatacgcccccaaaaatgtgtaagagcaaacattatttaactctttttgaaatctgaaccttaacctagctcgtatttaagagttcttaaaaatcattaactatcttgagttcaaataatcttctccaaacgaagcattgtaaacagcactaatactcaagtaacacaatactttacactgtgcaatttgaatcaaaatattaaacactttatgatttattgatatttacacaggattgaattttggaagaaaatattaaaaggtgtatacttatactcaaggacatgacatctagtactcaaattctgaacctaaatattttgtctgaggatgtgcataaaacaaaaacatttcaaagacagccttcttaaagataaattcaaatctgaataagctatgcaaaattttatatttatatccatcaattcaactatatatatacagaattataatcaaaatttgaatttaagatctgagtaattatttgtctagatagactattgtttttcaaattgtaagtcagaatccattcatggttcataaaatcatgttagtaggttatgactaggaatattttaaaattaaacagaaaaatagtagtctgtgtcacttatataatactaacaattattgtctcaatttttgtttcagatgtgcatatgggtttattttgatatgtatatgtatatatgttctaaggtgagattaaacttttttctgcagtttgtaaaacaaaattggaaatggctctagaatttcagactaagcaaaccgacgaaaaaagaaatttgcctgaattctacatttgtatattttccatagagaccttggaataaaagacattttaaaataaaacgatgtttaatctgagaatttggaaataaagatataaaaagtggcttatgctttgtttcagcaccccaaaatatgtttttatcatcacagaattttacattgtacctaagattggagatcacttcatacatgtcatggcatcaaatgaagagattttctaggaaagttggtttttgttctttatagatctatttataagaaagatagaccccaatcgtttcatgaatgaagatgccagtatcatcaactggaactaattatttttcctatgcttcaatcctattttgtctttatcacagtagtttatgtttctcttcagtacattgggcaaataatgattacgatgagaggcatgacagtgaatggatgaaacgattctgtttttgttttttttttttcccccaaaattgagtacactcaaatttattcaacgttatccacagacttcagaggcttaattactgcctgttagatttaggaagtattagatattgtcacctatgttccttgaagacatcgctcattaaaaaaggtggaagaggccgggtgcggtggctcagacctgtaatcccagcactttgggaggctgaggcaggcggatcacgaggtcaggagatcgagaccatcttcgctaacatggttaaaccccgtctctactaaaaatacaaaaaattagccgggcgcggtggcggcgcctgtagtcccagttactcgggaggctgaggtaggaggagaaaggcgtgaacccgggaggcggagcttgcagtgagccgagaaagcgccactgcactccggcctgggcaaaacagcaagactccgtctcttttaaaaaaaaaaaaaaaaaaaaaaaaggtgaaagagcagaaaggagaaaggtaaaaaaatcagggatgataaatgactgttttagtccagcaatgtctagaaaaatctctagacactcatttctggagacaatttctagtcataatttctactcgtagaatttctctgactagaaatggttctaatgaagtatacagcaatagccttgatacttctgaatatataaatatattttaaaatccagtttactatctgtctgatcttgggtatttaacctctctgcatctcagttaccccatctataaaacaagaaaaataaaaatatacgtacgtaaggctgctggaaagattagatgagatagtgcatataaaatgctaagcacattctagatcccaagaaatgctctgcaatgcctgtgtttgggggccaaagttcattgaaatgataaatgatttttatggggaaacaggtgaatgagctctgtgtgtttctggaagcatgatttgggcaattcaaactgagataagtaatcaagtggctacatgtaggtagtgaaaccagcagcccagcaaaccacaaagctcttagaaaaaatagctgggacactatgagagggcacagtctatcactgagcagttttatatcactgataaaatggattttggcaatttatctaaattcagccttaaagtatgatacgactgttaacctggatcaaaaacagttttattggtcttgaatgcataaatgcttcaagaacatttgcaaattttatcattctcagttcatttaaatgtatcatacttctttttcatggagtctaagtcaatgcatggatggtgaattttttggtgtattctataatctttttacccctcagtaaaagattatttccaagataaaggattacagagggataaccaagcggttctttcactaaataacagaagagcatttctgaacaaccaggattagtacctggaaatattcttgacacatttccgctgtgttttctcacagatataacacgtaaaccaaggtactattcaaagcataaaaatgattactgaagtgatttatgagaaattaatccatcatgcaacactgtacatgacattcaacctaatgacactattaaataggtaatttttaatatagatagggcctgaaattgagttcaaagttaagccctaatgaggatttaggaaaaatcatggcctgctgttagggcaacaatcaacaacaaatacaactactaccgcatatacaacagcaataacaacagctgccattatttattgagtacttagtgtcagtcaatttgctaatcacttaacacgcattatatcatttttcactacaacagatcagggtgatagaaattagtaggatgaggaaatggaaatagaaaaattagatgacttgccaaaggtcacaaaggtaactggtggttctgggacttaaaaccaggttgtttggattccaaaacacgtctttatcccaatatgatcaatctctttaaatgaagaaaatgaattaagagtctaagcaacagcacttttaaaaaaatataatataactttttttttttctgtttttttgagattgagtattgctcttcctgcccaggctggagtgcaatggtgggatctcggctcactgcagcctctcccttctgggttcaagccattctcctgcctcagcctcccgagtagctgggattacaggcacaagccaccacaccgggctaatttttatatttttaatagagacagggtttcaacacgttggccaggctggtctcaaactcctgacctcaggtcatccgcccacctcagcctcccaaagtgctgggattacaggtgtgagccacggtgtccggccctcacgtaacttcttaaaaataagtcaaagtgtattttttcttaatttccacaaattcaatcaatggtttggaagctactaggaaaatacctcgtcttcattacgttgctgagtaggaaatcaaatgtcaagtctaaataatgcacgcaagtcacagacactgatatcacactgaggaagataccagaataccagaaagacagcaatgggacacagcccagatggtagtacagacccggtaaatcctccattatccatgatgtccttatttcacactgcatgtctgtatcaaaacatctcatgtaccccataaatacatacacctactacgtagccacaaaaatttaaaacataattttaacagttttttaaaaacataaacagaaaaagaagtcagaagaagctgagcaaaaaataaagctaacaaattctttctaaaagaaggcatgtgtcaagtccaccattcgaactctgcgccttctgttaatccctatgatttgcctttgatgttaaatgtcagcaaatttaacattcttcactattgcagaaccactcacagaaatgctacattgtgcctccgatgctccagttaagaagacaaaaatgggtatcatacgtacacatatggggtattttagtttttaaaaatctcattct

SEQ ID NO: 28 - DNA, 6917 bp, Homo sapiens
gatattcagtatgattggagagtttgaattgtgtaaactttattaagagactagctagaaactcagcagagttttcatggattgcatgacactactttcattttctttgcagtcatcacacaagtaaaattttataggttcaacacactccacatacacctaattgctctctagggtagtaaaacaaccaagcagtgaatccacaaaaacagttcagtgagtttcatttaaaccatgcatacactaccaaaaagtgactcacagcagaggaaattaatttactcgccatgaaaacacaattcttaatgatcccaacactatgacagtacctaaaatttcttgtgtgtatatatttggacacacatgtccacacattttatagcaagaacataaacatttcaaactgaaatgcctaagcaacccttaaagatagcttttgtcaagctaaaatctggtgagaaaatgaaagttaaggcttttattttattttattttttgagatggagtttcactcttgttgcccaggctggagtgcaatggcacaatctccgctcactgcaacctccgcctcccagcttcaagcagttctcctgtctcagcctcccaagtagctgggattacaggcatgtgccaccatgctcggctaattttgcgtttttagtagagaaagggtttcaccatgttgatcaggctggtctggaactcctgacctcaggtgatccacccgccttggcctcccaaagtactgggattacaggcgtgagccgctgtgcccggcgaggcttttaaattggtgaaaatgccaaccattcaatttttactttgaataatcaaaactgaagtgattcaagtagtgattcatcatccagtgtaatctagcacagcaatggagattttgtgtgaaacataccaaaggaaaggtttggggtttttaattgcgtaattgactaattcttgggcacctccttccctcaatcaaagatacatcatctgaatagttcacagcctcccccgaataaatgaaagtgacaggctctgtatttcttaatttgacgcctttcaaagataaggttaatggaattaagtaaccataaagattattgtaaattaaatgttatatccttagatgtctgagttaatttaatgcatttcaataaatatgaggttaggaaacataaaaaggaaaatttatggtactaatttaaatggtacctttccacatctcttgtgcgtgctaaagcataggcttttatgtttgtcaactcacaaatattgttgcagggaagagatagaggtcccaagttgtcttaagaatatggagtcagatgttcagtatgattttaggaacagccatatgaaatgaaatagtcatagctatgaactattgttaaacatcaatagagggagggtacataaatagaagttaatcacaagtaaaataacctaacagtgattatttttattatcataatcatcaaggttagatttacagagcaaaacaaatgcttttctatgttggtttagtgagtattttcacagctatatgtattttagtttttctttaaatttttatatatattaactagaacataatacaaacttcactttggtactagaattacatttttaaaaccattaacgttataatttttacaaggagaaaggtaatgttttgtgatgattattatattattatcaatattggttatctcagaaactgtgcttaatacttttctcatggcaacttatgaagtctttattataatcattttatttataaggcaattgagtcttagaaaggttaaatagatagtataaggtcatccttctagaaaatgagtgacaaatttaaacttagatgatttctaagcttattcttttgactgtagcattatattatgttcctgtagttacagaataatataacacagtgtccaaaaactagaaatcattttattcccttatttagggtagagggctgataataaccttggcaataaaaaaacccaaaacctactgtcacagttcttactgttgatggttttaataaaagaaaaaatgtctttgaggttttccttttatgtggcatctggtatttgcctatatccatgatctatttacagcctctttgaaaattaaccgaatgatattaatagatagtttattttatatagcgttaactcctcctaactttgtacacatttctctgcataatttgaagaataagaacagaggaaatcaacaccgataatacagggaaaaaaatacagttttttttaaaccaagcaagaaaatgcaatctgatgccaaaacaaataaatatgaagaccagagaaaaatctgatatccaaagactggaatctaaagtaaatgatgaagatattagcaatctgttttctgttaaatggattcctctttgttacctttgcacacagcatacattcaaaatattagaaaaaaatcaagtttcaactgtggtttgctttattggcagtaatgtgaaggatcaagtactcaaataatttaagcaaattttagaaataagaggttgtctaatcaaaacacaacctagaaagacaaatattgcatgttctcacgcgtatgtgggagctaaaaaattgatctcatggaggtagaaagtggaatgattgttaccagaggctgggaagggtagtggggagggggtgatgaagaggggcttgtttaatgagtataaaaatacagttagctagtaggaataaaatctagtgttctgtaccacaatagggtgattatagttaacaataattaattgtttatttcaaattaactggaggagtagacttggaatgttcccaacacaaataaatgataaatgtttgaggtaatgaatattccaattatcctgatttgattattacagattgtatgcctgtatcaaaatatcacatgtatttcataaatatgtacaactcttacgtacccacaataattaaaaagaagaaagaaaaacaaaacatatcacaaaggatgacgtagcttgattgatgaattaatagtgtatgcaactaagatgattggagagtgtagaccttagtccatgaaaggaaaatcagagttttcacagagagcaaaagggtgattctatcttgtctttggatttctctccagccatagatgcacacgctcgctacctttgcataccttactccaccatctaaaaagtttccttttatttcaataccactggaaaacccaccatttccttcatcatagattaagaaagagtgggtttttctgaagttccaactaccattgttaatgctttcaatctattgtctattttccatgcttatgattgtgtcagcccatgtgtaactaactcttaccaagttgaaatacgttcactaaggttcttttttgcataagacctgtatagaatagctatatattgaggaattaatagaacagcaatattttttatataccaaccacgagtgagatactatactaggtgttattcatgtatttttgtaacttcacaataatcctccatgttagttatttcatatatgagaaaacatgggaaggctccttccaggctatcttgctaactataaccctagcatttctaaacacaaaatataagaaattcagtgtcttagcactggctattctttccttctggaaggttcttcctcagtttttacatgactggttcctctagacagtcatatctcagctgacatgcctcttcagcaaagattctctttactactgaagctggaataactacccaatcactcactatctcaactcagtttgttctcaatgcaacacttttatctgatatgtttcttgtttatttatcacaagagacataatttctttttcagaaatgtaggctctgtgggagcagggaaatatatataagatccaattacaactcaacaatagataagtcacttccatcattgaagatctgagtttcatcatctataaagtaagataatatttatcagatatggttatcatataatgtatttatataatactaaatatatatatatatacagtaatgtccagtagaaagtatgctgaacaattagtgttctgtaaacaaattttttaagtgcactattctgaaatataccggtctctcatccttctcattttattttttaaaatcattttattgagctataactcacacaccacaaaattcactcttttaaagtgcacaattcagtgatatatagtatattcacatagttatgcaactgtcaccactttcttttttcctttatttatttatttttttgagacagagtctcgctctgtcgccaggctggagtgcagcggcgcgatcttggctcactgcaacctccacctcctgggttcaagcaattctcctgcctcagtctcccgagcagctaggactacaggtgcgcactaccacacccagctcattttttttaaatatatattttcagtagagacgggatttcaccatattggccaggatggtcttgatctcctaacctcgtgatccacctgccttggcctcccaaagtgctgggattacaggtgtgagccactgcgcctggccaactgttaccactttctaatataaaacattttcgtcagcccaaaaaagaaaccccatactcattaggaatcactctcctttctccacgtccccaggccctactaatctactttctgtctgtattgattagactattctgaaaactttatgtaaatctcataatttaaaaaatttcataatttttaaatttttataagttgaaggtattaacaagttaataataaaatacttcttgagagctaactcagggttagctgctttatatttcttcatgctttagctcatataatcattataacagagaaggtagtttctattacaatctttctacagatgcaaatggaaaaactgaggcacacgagtttaagaaactcccagaactacacagttaaaaaatgtagaagtcaggattccaagtcgggcttttcagtcttcctgtgtttgccagctctcacctgagtattgtgttactagtagagggacgtgctcacagtcgcccctatgaggggtatttggatgcagataattaacatcatttcaatccacaaaaataggcttagtcctcaataagtaaggaatcaaggtgagggcactgcagagttagtattttgttgaagacaaattaataaatcttttttttttctttttgagacgagtcttgctctgtcacccaggctgcagtgcagtggctcaatctctgctcactgcaacctccgcctcccaggttcaagcgattctcctgcctcagcctcccgagtagctgggactacaggtgtgtgctactacacctggctaatttttttattttttagtagagacggggtttcaccgtgtcagccaggatggtctcgacatcctgaccttgtgatccacccgcctcagcctcccaaagtgctgggattacaggcgtgaaccaccgccgctggccaataaatcttaaaatattcttcctgctctcctttcttttgtctgttatttccctggatatctactgtgaaatactgtggtctcacatacaaaccaggaaaaatgagagggaggtgcattttatctcaaatacagaacttctaataaaacagagttattttaaatgtatagggggatcaaaatacataaacataaacacttgattatttgatttagcattacattcattgtattcattgcatgcattttattctgctggcaatcaaaattagttccagaagaaggtccggaatggcagttgacacattcccctgctcaatagccctgatatttataattatgatttgaatacattttactgggctagtaaatattaaagcaaatttttagaaatgatgaaaaaattaatttaagcattttttgtctctaaatttacaaacaacaaacatgcaattttctaagtagaataacacacaccagggagtaatgatatttgaaatgactgtgaattttggtctctggatgttcttggcttttggtcatatgattcactacaccttctaggcatgtaattatctcttaacacctcacatcctgtcatacagtatgccattccttaaatgagaattggtctcgagtatcattgtatatttagatcttaataattttaatagaaacatcaaccagtaatttctgaagggcaaaatatataaattttatcacttaaaatatatcttttctttaataaaatctagctcttaaaattctattcagacctagaatgatcctttaagatcatttaactcctataattaaattgcaaaatttgaaatatgttcaacttaaaattcaacctaaaactcaaagctgtattttaaagttcatgttgcacttgttttactgcatctgccagagaatgcaccacaaaatcctttatagatattcagatgaatctctctaccagaaatgaagaaggaacgctgctaatcttgggctttcattggtttgattaccatttcaactctaaatggctgcatgataattagtgggtgtggaataaccagtactgctcaagaagcaattgcctttactgaaaaacaaagtttcgaaagaagcacagtaaactccaagagacaatcaattcaatcttacacacctccctgccatagttttaaatggagcagatgtgctaaaagccagtgagaagacggttgatatttcttagggttcaaacagaaatagaatatccagcacttgactgcccatatttttcacaatgatttattgcagtaaatagtctacacgagcgtcccagttttggactttttccctatcagtcaggtttttaaagccttaaagtagagttaaattaaataaaagaagggatggcttttatctaaaa

SEQ ID NO: 29 - DNA, 14284 bp, Homo sapiens
tgcccaggttgctgtgcagtggcatgatcatagctcacagcagcctcgaactcctgagctcaagcaatccttctgcttcataagtcactgcatccagccttgcccacaaatttctaattttacctcttcttctttatatcttctgagaagaaagagatgtttcctctatcagtggtcatttatagcctttctaagtctaaggaagaattgtggcagacataaagatcgttgaatcaggactaagaaaagtagattctagctgatcttgaaagactgacttcacttctctggggagatgatgggtttggatgaaataattccagaagactttcccatttttactcatctctgactctattacagcttttctatttcacccttgttcccaactctcatcaggaacttaaaagaaagacacaaactcacaaacagcgagaaagagagacagagaaaacaataatgtagggtatcagtcatctattggcacaataatgctgcataacagaccatcctgaaactcagtggcttacaataaggttttgtttttttaattcacgtgtgctggagcagacctgccttaggctgtaggtcacccaaccttggctccaggctaagatcctgaaagaagggctcaaatccactccctgtgtcttaatctaagcccttagataaaggggccacctcctgggacacaccctcctcctggcaaacaatacaaacataggtcctggccaaacacccaagcacacttaaaccttcttctcgtgtccaatctgctgacattccattggccaaagcaagtctcgtgatcaaactccaaatcaatgaggaatgagagtgtgttctgtccacgggtaggagggatttggaaaagccatagatatttgcagaacaataatccaattttccacattctgctacaaatatcatacactgaaatgccttcagaaactgacaggaatgaagcaaacagcagagggaacacaccatcaaaatcaggcagcagggactcagcctcagggtcaaatgtctcttcttcttgtgtttgtttttttcttttgagacaaggtctccctctgttacccaggctggtgtacagtggcacaatcatagctcactgtagcctttacttcctgggctcaagtgatcctcccacctcagcctccaaggtagctgggactataggcacacaccaccacacctggctaattattattattattttttttttgtaaagatgggattttgccatgtagttcaggctggtctcaaattcctgggctcaagtgaacctcccaccttggccttccaaagtgctacgattatggatgtgaaccatcacgccctgccagatgtttgatttttaaagaggggagatagaaagtcacagtcttttgtctaaattttctatttaaaaaaaaaaagttagaaagcagcttactttctgtctgtctgtatacatatggaaaattacatgtatgcatatgtatgtatgtgtatgtagatgtatgtatgcatgtatgtaatatatatgtctgggtaaaacaaagcatctgcagaccagatgtaattttgagattgttatttgcaagctttgactagaaacctctcttgtttaccaatatatgaccctataattacacatctaagatagttttaaaatctttctgggccaggcacggtggctcatgcctgtaatcccagcactttgggaggccgaggtgggcggatcaaaaggtcgggagatcaagaccatccttggctaacacggtgaaaccccatctctactaaaaatacaaacaattagccgggcgtagtggcgggcacctgtagtcccagctactcaggaggctgaggcaggagaatggcatgaacccgggaggcagagcttgcagtgagccgagatcgcgccactgcactccagcctgagcgacaaagtgagactcggtctcaaaaaaaaaaaaaaaaaatatatatatatatatatatatatatatttcttttgtattcaatgaggccataatttcatcctgccccatgcagagttaacacgtggtcaagctctttggcctaaccttgtgtagatctttcctaaaaactaaggactgtgtacctatgatgttacaatgttgcattactagagaaacacaggatttactcagcactttcaagtacatacattgacttaatccacatagtaagtgattctattagcattttgtagatgagaaaactggggctcagaaaaattacatgaaattttcaaggtcgtagggctatagcagagctaggtttctaggtcatttaactctttctcaactggcaaggaagctaagtaatcacagattcacagaacaccaaaagctgttctggctactgttatgatttgattctaatattaattatgtggttagaatgattgtattagtctgttttcacactgctataaagaaatatgccagactcaggaaagaggcttaatagttcctcatggttagggaagcctcaggaaacccacaatcatggcagaagacgaaggggaagcaaggaccttcttcacatggtggcaagagagagaagaaagaaggaggagcttctaaacatttgtaaaaccatcaaatattgggtgcaccaaaatctcagaaatcgccactcaagaacttactcatataatcaaatactacctgtttcccaaaaatctattgcagtacaaaataaatttataaaaagaaattaagcattgaaaacagatatttctttcctggaaaaaaaaatcagatcttgtgagaactcactatgacgaggagagcacatcacctccctcttaacacgtggtaattacaatttgagataagatttgggtggggatacagagacagaccatatcagtggtatttcaaaatatcttccttttgagtcatttaaatcccttatttgatgcagagatagtaaaagccctaccagataatcaggaggttgctattatccttttttgtactttgtttcatctgctcttatgtctttgaacctcatttccgtcagatgattaaataatgattatcttgtctacaaataattggttttgttttgtgatttcacttgacctcaagtgacatgatacagttttaagaatgtcacagatgttaagttgtaaatcagggagtgctattttttttaatcagagaaatatgatgattcagtgtttagaacatattctttaaaatgaggggacagagattctaaacttgattctgctgcaaatcagctatgtcatttggggctctgacatctcattttactctctgaatcatctaggaaaaagtaagatgatgattacaaagcactgggagctctttcaaaaggcacagctttcatctaaaatgatattactaattaattaatcagatcaattccctgttaactcatcctaatagcccaagccctgttagccaagtatattactgtgatttattttgacacttaatggaaccgtgcagcatttcagtcacaggttgataacctaagcattataaacttcaagcagtgtttatagttttgttgttgttgtttttcctgaagacagctgataaaagatacccttttaggaggtgctagctacatccctcaaatgataaaaaatacaaagtggtgagtagatgttatgaacagcattgtccttaaaagagaagtcaccactgatctcgaagaaaagtttgcaaaataaggaagaagaagatgaggagatgcagtcttcatttcatttcttttcccaatattttgctgctgttttgtttttaatatcttccttggagcaatgaatcaaatgtcttccatcaaagaaaagcaatattgatatacatttgcacatagtaaaatctgcatgaattcacggctcctggaaaggaaaatattttctctctttctctcttcctgtgtttctttaatgtaataaaatagcttcccttggaggtcaaaggattctgccatttctcttttctgtgctctaagacagttgcaaccacttgttttgaaacttgcttttggttttggggagttttaatggaggtattaactggtgcctaaagggagcaggttatgtatatgtaaaagcagggaagttataggaaagtagctataaagactctaagcagttcaagagagttatgttaattgctgtttcaaaatgctcccctgtagtgggagccttaggcctccagaactcacttttctctcagtgactcttatttagtttattttcctttttatactgtgctttttagagttttcctggtctcttttactttgaaatctcaaaggctgtccctcggaggatccactgtttacttctgaacactttctagagattctgatgggtccaaattccccaaggagctggtaaaggtctgcttcctcccttcatgctgagtgtgaaagaagggaagagtctttcacttcaaacttcagagaggtctacctaactggagagtgaaccgaaactctgaggagcactggccagggagggggagggcagcacactgcactgtctcacctgggcattttcattgtcacccactatgaaagatctgctaggagaatcgagtttcagagaaaaaaaggaatgaacatattttgcatgacagcagtagtatttcccctctgttccccttctacagagaaaaaaaaaatgtgttaatgactttctaagaacaattactatataaatgtgacaaatttagattgaatttggatttgatcctcttctcacacccatttaaattggtttgtgctcctagctcctgtgccatatcctatgtggaaatttaagaatgacaaagttcataaatttggaaaggagaagtttgtttctcataaagggttgcagcttgcagggtggccattctgacgggctgagaagtgtagcctccagtcagaagccagaaacagacactttgagggaggggcaaagggaacaggaatttatgctgagctagtgactgaatatacatatttaataagctgtaggaggagtcatgaatatttgtgatagaagaaacatgcacagatccagcggagctttatgccccttcctgagtctcactacaaaaaaatggcagtacaagcatgatctgagggtggcgttttccatgctctaacatcaataggtgaagccaaggtcgcaaaaactcttactgcacattctccatagactggacagaaccattccatggtcagtgttctcttatcagccaaaaaaggaagggcagcctcaggcagatcagtagtgtggtcttttgaaagaactggtttctgtttagcccttagggaataaagcctaattgtgattagcaagggagggggtataacaaggcatgtctgacctcccatttcattatggccaataaagcagttttcaagcttattttggggtccctttggccaagagatgatctgttcggtcaggtgggggacttagaattttattttccgtttacatatggaatagccaaatattttatgatacactttgctagattgtgaaatgtttggcaaatgaaagaatgggacattttcggggcgaggggaaggtcagcgaattcatctcaggatatcctgaagaaatcaaataatgaggcagacaagaccacccttgaacagactgccatatttcttgagcttcaggaagtttctttggaatgccaaagtaagaataaagttggcctcccatgaatactagggcaatttggtgatgcttactcagatccaaagaaataaattataacaaaactggaaaagtacccatgaatcagggccaaatttataagcatacacctaaaagtatggaattccaggcctgatatgtgaaacgtaaagccctaaggcaaatatatttcatgtgggttggcataaggttgcttccattttcacagtattttaaaaaacaaaatgaagtttttggcaatgcttcacaattgtagttttcacttaaaaatacagatttctggcttctcttggaagactaggacacacatgcccaagaattgaatagcagctacttctttcggcagtaacatgaactcacctggtccatgtgttcatgtcttacccaccatcccctcacacacatactcccaagtatctgactcttgacacttcccttactcccttgacctgctgtacctctgttgctgttctatttatcaagcaggaccctgtcctctcccaaaatattctccagagtgatggactgtgttttctgggaggcttctctcacctgaaggacaaggttgacctgtctggctgcctttgctggctgatgctgactatttccaactcagctctctgctccatttggtgctggcttcttccagttgtggatcctagtctgtcatcttgacgacactccagaccacccaaaatgtcaacttggcagttgtttaaatcaaatcatataataaaataattaagctgttaggctgtgctgatatacattgatactcttagtacacacacctgcaagagtggtctctttgtaaactacatgacaacgagaacattcccttttaaaagttcctattttcaaatctgcctaacagcaacatatttgctccaaaactacatttctattttacaggagagagaacagaaaccaaagcaaaactaaatttcatgtcttgattactcaacaagagagtgtattgatgacacaagttgtcctgggttaggtagtgattatatttaagtgccatagaagattttcttggaagagattgcaatcactataagtacttagcattgcattgcttacatgaaaagaatgcgactgttgagaggaaaagaagcctctttagtatagattagtcttcctattgtccattaattatgaatgaaagttgaaattcggctcattgtgattcaatgctagattctataaaaacaacagtgcttgtttaaggaactgcctggaagatctgctttgctcttttgctggtgcagttacttgtggaggttataggaatttagggacatggatttttcctgttactacagcataaatatgttgtaatatacaaatatacatgtatatctgaatatgtatgctgtatatatttacacacacatacatattctaaaactcttctacttcaaccagggcagcagctactcttctgtttagttttatataatgaggttccatataagattatacttaaagagaaagtgccggtttggttaagtaaaatttagaaaaatactaatctagtccaactgtcctattttctgcatgaagagaccactgagagacatgttttttttttttcatcacactgttggttagtgacagagccaagttgattcttttttttccttccttccttctttccttccttccttccttccttccttccttccttccttccttccttccttccttccttccttccttctttccttccttccttccttccttccctccctccctctctccctccctccctccttccttcctctctctctctctctctttctttcgagacagagtctcactctgttgcccagactggagtgcagtggcacgatcttggcttactgcaacctctgcctcccaggttcaagcaattctcctgcctcagcctcccgagtagctgggattacaggcatgagccatcacacatggctaatttttgtatttttagtagagacagggcttcaccatgctggccaggctggttctggttttgaactcctggtcttgagagatctgcctgcctcggcctcccaaagtgctgggattataggcgtgagccactgcaccccaccagagccaggtttagaatacaacgctcccaactcctagtcagtgttctttgtactgtatttggccaatatgtattgattgtttgctatgcacagacactgtgccaagattgaatttcctcaggtgataatcccactaaccccatgaggtcaatcttacgtatgttagagaaaaggataaaaaccctcagggaagataagtaacttggtcaagtttgcacagctacaaagtgcagtgtcaaaaattcaagtctaatttaatctaattccaatgtcaataactgtactcttatccacttctctctactttcctcataaccatttttttcccaggttggtagaatagaccacaaaagccaactttgtgtgcatttctatatccatatataaaataatataccaaaatacatttgatcatggcatatttattaagtgttctatattactctgagctctattactctttaaaattttttaaattctattcataagcgacacataataattgtacatctttctgaacttcattcttaaaggaacaattgtagctgcatcgaagttgacatcagggcaatttctgcttcacagattttgagggcctggaagaagatttgatgagaatattttaatccctggatgaattttatttacctgtgtaggcaaaaacttagtaaaagatctttgaaccctaaatattttactttaggtacagaggttataaaatacctctgtacctttaggtacagaggttgaaatgaatgaactgttatcttagatagtatgccatttcagcatgagaagggaatctgaggatttattatctataaacacagaatattcttgcagaatatcttcaacaagcacttccagtcataattgaaggaactgaccagcaaagagagaagggaaagaaaagtgatttatagctcatatgctgtcttgataaaggatctaggttttatgaaatattatggaaactttaagtgctgagaattctatgcaatctaatcaaagattgtagtgctgtgagtaaaagaaaaaaatgtaacaacagagagggattggagaggagtggaagaaacagcaagtaggaatcacacagagactaacaatgataattcacaatgataattcaatttaagctggtcctctaactatcatatcccatggggatcccaggagttacctggagactcggcattattattcagagaacacttggaattaatgcctctcttattgttgaaattctccctagagttgtttgcatacaccttgatatcgatgttctaagaagctattatccctttatgtgcattagatcacagaacagctacattagagatgctcttgaattttgatttaatcaaacaggcatttttatgcttcagtcctaataatggttccagtggttcatccagtagttcctgatatttgggtaaagaggtaggcaatgtgagctgtccattgagatattttgctttgcttaattcagtgtgatgctgtgaaactcaaccaataacagtttgaaagtgtgcccatgtatccaaataccaagtagcagcaggaaaagagttctctgcagccagtaacaattagagatttattaagactctggaaaacttactggctggtcaaaaaaaccaatgataatctccacctcactcagggaatttaaggttgtttgtttgtttctttgtttgtgtgttttcccctccacagcctaaggattcagaaaggtcagaaaaacagaagtcacttctcttgatacttcttcccataaagacttacctttctgccagggaaagatatagatttgtataacttccattattgtagaaaacacaaccaagaacctgccgcaggagatatcctgaaaaccattgcaactgttccacgtggggcgaaaagacatctctagttgtgttggagccttattgatgttttgtattgctatgttctgctgtgccattcttgtatgaaaaacaggaaaaagataagttataaggcattttagcatatcagagcatggttagcacatttagcttagaggagttgctccattacaaaattacctctttgtaaatcatattattaaaaaaaacacacatctgtcttctcagggaattgccttctgaatataaatctttgagaactgatacttaaattccactgtaatttaagtttcactgtaattaaccaacattttatggcctagcccacttctgccttctaatatatagtttagtgggaaagacacaagttaaacaaacagaaaaataaatatttatttaagattctagaaaatcttttaactggacagagaacagccttgccacatgagagaatagactaagaatggcttacattaagtttactagtctggtatgttctctctgagcagatagttaagctgagtcctgaaggatgagacagtaaaaccattgggagaacaaaggaagaagactaggctgtgcagaaattgttgtggtttgaaaaagctgagtggggaacgggaagaggcccaccttgccaaaaaggtatttaaaaacaaggaagaagagggcaatgacatgcagtggtaggcaaggctttatcacgtaagactttaagaatattgtagctctagtgaaagtttgaatcagagaaatttaaatacctaaatgtcactttgaaagatcattctaactattgtttgatgaatggtggttgctatagggcaaggggcaaaatggaagttcattgggaggcttctgtagttgtttacaaagtaaacaatgatggcttagactagggtggtatccatagagagagaagtagacagattcaagatgcatttttgagggaaaactgagagttgtatgaattcagtgtgagggattcaggactatgtgacatctcatgaatgccctcctggtttctgctctgagtgtgtgggtagatggtgacattatttactgagatgacgagggcatcatctataccttgaatacattgaatgtatttcttaatttctccctcattcctccttctccctttccttaccatgtttctctaaatcctagctatcttttcagattcagcatgcttaataaacatattgagtaataattaaaataataagtttaaaatttttgagtggttctaaacactgtacatgcccaatttatttaatcctcccaataaaactctataggagaaattctctttacaaataaagaatgtggagacacagagagcatacataatatgcctaaggtcacacagctgtatagcaattgctaggaaaagcaagcatttacctttacagagttacagtcaaatgcaggtggcagacttacaaacagactgatgcaatgctttggcaaagctgttttaacaatggtttcagtggccttctatgtgacccatgcaggggaaactgatctggccctgggcaaatgtctgtgctgttataacaaaataccacagactgggtaatttataaagactagaaatttatttcttatagttctgaggctgggaagtccaagatcaagatgctagcaggctcagtttctgatgagggctatctctgctttcaagatggcttcttcttgctgcatctctggaggggaagaacactgtgtccccacatggtggaaggtggaagtgcccttcaaatactgtctgaagtctctttaatgggggcctcaatcccatttatgaggagaggaggcctcatgacctaatcatcttaatatgtacacattggctagtaattttcaacgtctgaattttagagaggacacagtcaaatcatagcagcagagataatgaagacaggctttctagaggggatgatacccgagctacactttgaaaagaaggtaaaaatcctggtggaattaatgggggcagggaaggctttctcaggtaaaggaacatatatgcaaaggacactatgtagtggggtaagagcagggagaaataatgagatagtattgagggacaattgatgggaaatatggctaaagagatagattacagagatgaagtctggtattcatagagatgtactttaattatttaaaatagatctcttggcactatatcgagtcgatgaattggggagggcttaagtcacaagtctagaaatacaatttgaaaacttgcatttttatttttctattggagaaaaatgatggtttgatacagagcaacggtgttagagatgaagaaaagatgaatttgaagattaaatgagacaggacatagaaagcactcagcacaaagtttggcatagattacctacataagaaatatcattgtttcagatgtctgttgctgtttaacaatccattgtaaagcttggttgcttaaaacaacaaatacttactattttcttctaattctgtgagttgagtgggctcttctgggtggttcttctagtcttcagttgcaagtaaatttgatttaattgattatgactgaggtcactcatgtagctacattcaatttcaactggactggggctggagctgcaagaatggcctttctccaaggcctcttttcagacaagctttagtcattcactggtctagcctggacaacatggcagctgggttctaagagagagacagtggaagctgctaatgctcttactgtatggtcccaaaagccctataaccattttcctttcaccttcaaattggtcaaatcagttacaaggccaacccaaatccaaggagaggggaaatagagggagacatatgcagatagagaaatggcaaaaaaaaaaaaaaaaaaaaaagttgttggtgactgtatttgtagactgcataccagttatttaaattgtctaatgccaatttaattccttaaacagcattcttcatttatatttgtattagtttctttctctagctctataagcttcctttctatctcacacagagtctttcctatcttgtactaaatctatgttttagggtttttttccccttaatgtcccggagaatacaaaacagcagttaccggaaattcaatttattttcctagctgaggtaaatatttttcaaaattatagtctttatttatcttttacattctttcttttttaaattttcttttttagttgctgaatattttcaaacatactggttatgcatatgtatgcctgtatgtggcttgtttatttttcttgactgactattgaggatgacaagtctatacagtctatccatgttttctatttgcataaaaattgtttgtctcgattctccttgagacctgggcagcttgagttctccccatttatatgggcatctttaactcttgaggattgtgtgctggaggtttctaattagcaaagtggaaaggcagctacagtcctagttgataaatactttacgtcatggtttttgtcttgtttgttttgcaaagaatgtatcagactgctgtgttcacctgaccttatttctagatacaccatgtggttctcatcactatcactctggagtttctacctatcactctggggagtctccagtcctattggaggggtatttgtctcattaattaaaaggctcctcctggtttagtcacctatattgattaaaagtcatgaaaattccactatctttctctttaatgatgccttaggtaaggatacagcttactatccaaaataggacacttttaggataaagatacattgttaataatgtataataataaataagacaaaaaatgtaactattttggaaaatgaggctatatggtcactcaagtgatgccataactggagcttttgcaaccagtgtgtctccagttgcctctctttccccgtagccagacctccatccatgtcctccagactggtggagtttaccccagtgggagcaagtttacactgatattagtagaaactgtgcttggaaaaaaatacacttaaaatagactcatgctttctcttcccacttcacacggatgctgacccacgatgaggaaagggatgcgagctggctacctatgtctcagttccctcttccttcaaaaggtgcaaatattaaatagtttgcacttcttcccctcaacatttcttgcgatattccttgaaagaaaagttagttgttagtggatattccatgtaatagtctcaaatgtcgaatctgtggtagagagcaaagcatataaaaaaattataggggattaagtgtgtgactctacagtttgaaaaaagcactgtagctagttttaacatgcagtatctctgacttccccagcgcatgtgtattgagaaccactatcctctctgatgtaacagtaaggtgtgttgtaacaagtgcctggtagctcatgctaccaggatcaagaaaaattagctctgaggaatgatttttttctacttttattttatatggtattaatcacatctaagtaaacttgctttttgtttgaagccagatgccccaacagaccaagttac

SEQ ID NO: 30 - DNA, 14284 bp, Homo sapiens; identical to SEQ ID NO: 29

SEQ ID NO: 31 - DNA, 17712 bp, Homo sapiens
tttttctgtttgactttcatgccttactttttttctttctggtgatatgatgtcactctgagcacacagggcataggttatatatagttcctttagattctctttaaaactttcaggaacaatgaaaaataatatatcgactaggtagcagttaggacaaatggtgttaagctgttctaaaaagacaatgtttaagctaaaaaacacatcttgggataagaaataaagaaaattcagttacataatggcactatcagggtatagcatcaaggcatatgtatttttctcttctcttcttagaagcgttggtgtcagattatcatttccaggttttttttttcctatttaggagaagttcaggaaatgcttaatatttacaattccctttttaaaggtgtttttcaaaattaaaatagctttgttttcattgccattataaaatattaaaatagttgagaaaggtagaaattagcaattttaccacccagagacagtcaccagtatttttttatgaatcatctcctagataactcattgcatgcccttacatcaatacacataggatattaaggatgttgcatcatactatgcatgacattctgtaacttgttttttccacctaataataggaatgggcatcatttcatgtcaaatgatacagacatacatcatcgtttttaatggctacgcacctttgcaatatccttgaggcaaaccctaatgatcatattggtgtcagtgagtcacctagacatgcatatttgcaaaccattcagaggcattaaattggacacactccccaaagtgcgactaccaccgggttaaagtatcgttccatttaacatttccatcattcctgccaaaacactcttcagaatttgtctacaaacttaacaccaccaatcacagtgaggccaatgtcccccagtttcccagagtattagagacacaaccctcccctccttggttgtatgtgtattcatctcttcttccttcctgagatgaagcttggcatcactccactctgaaagaaatgagaaccgtttttgcatttcaccttaatcagatcaaattaggacaggtggcaaccctgcaggcaacataattatgaaaaatgtctgtgctcaatacagcctgtccttccagcttcccaatcaaataggacaccagagcccaacctttctatttcagctggtgactcatagagcagtcacccacataattgctctgaatataatggtgctgcaaaatctgaaattaaacataatataaaaagcacaaaaatctattttgtaagattagttaatttaatataataatagttcttctattataatcttcatgtgccaaattgggggaaaaaaccttatggctggcctgttattagaagaaaatcttttaacatatcccccttacacttgccatccaaaggtaaaaagaaatgatgttgaggatttcctggttttattgtaagagagtagctgttgtccctccaataaaaagtgtgcaatgaatatctgtttaaatagatttgagataagctgaagctggatacaaaactccattatacaacagggggatcctacatccagcttcatttaggatattgcttctcagaagacatcccgaacacctcaataacaaatgttatattgaaaatgtgctcagtaacaattgcgggatgagtctctgtgcagcgatttttcagcatgtcaaaattatactatcacaccatggaaacaaattaaacagcacaagcctggctgccgggatggctgtattagcaatgcagtgctatttcataaagaatgcattgcttcagatctgtcaatgaatgtcaacaatggcttctccatttgtatgaagcccaatttgtatttggagaaaaaccaaacagaacacttcagaatctggttccatttcttcccaacatttagattaaaagaaaaaagcccggttatctaatttatctgtagtcagcgttccttttctagggaggcacttgggaggaagcctcagagtgtgagttaagcactaacattctctttctgaagcacacgggcaccattaaatgcttactgacagctcagagaaaacacaatctatgtgctacacattgtacaagaaggttttgttgatatattagattcatatatgtgagctttggttttcttgtatttgtgaaacgtggcttagctgtgtattatggctttttgtgactaatgagtgggtcttgcttcagaaatgattacagttatgtcagaataatgtcaaataatcagtattagtagatgagctcttagaaaacagaagccctcttttgcagatagatatgtcataccaaagagaaattaaaacccaagactattctaaacgccaaatagagtctgctatattcacatctcaaattttgtgtatctaacaattaagttaaatagtgattgtcaattaaatagcgttcaaattgtagctcaaaccgaataagaatttcttgtccctggagtggatgtatgtagacatcaacattttaagacacaaagggatgatgagtttcaggctttgttgcagaagtttggacagccgtttggctcttccctagcagtcctgaaacacatgaagtaggtggtcctcctgcctcttgcctttttattttctacagctggctcgattacagccctgaggacttgacacagcagaagacaacccagccaggcagcaggttcaatacacagctgaaatctcactgacctctacatatttggctccagtaacctcttatgtatgtatttattttttaagatcatgttctcagtctccataagggtaaatttgtaaggaagaatttctttaattgtttttccaaacatgcaattctgtgcctcaatcgcttctttttttaaaaaaaagaacagttagggtgtcactctgtcacccactgttgagatcatagctcactgcagcctcaaactcctcagctcctgggagcaatcctccctccagcttcagcctccagagtagctaggactgcaggtatctgccaccatgcctagctaagttttaaattttttatatagagacaggattttgctacgttgcctaagctgatctagaactcctggcttcaagtgatcctcccacctcagcctcccacagcactgggattacaggtgtgagctactgtgctcaacctgcacctttggttttgtcactatattgccatagcaaaattcaggtcagtgggacttgagttttggttttctccactgagttccacgttcttgctcacgtttactccagctaccctggtgtagaaatgaaattaccccagtcctcatgatgcaagcgcttattctgtgccaacaccttaagctccgtttctaaatgagattttgtgaaacgaatcaatcaatcaatattaaaactcaagactaaaatctgtctttgatttttgttcttcctactgctatttccactgaaaaaaaaattctctttcatgtgtccatgggtagaatatccttgcattctttctgttgaaatagtatggttctagtattcactagctatgagatattaaagaacggaagccatcttcctcattatgttttataacagagaaatataactccccaatttacatctaagttcatcttaatagtgctttatacaaaaagttcctgaagaattacaacagttggccattctgcaaagtgccaagggactgattctgaatccagagcaacaacaaccaattatgaagaaatggtctctgtggctagtatggtctagacactagcaagctacatataatgagactgctctctcctttcaaaggctgtgatttaaatttataggtggggtcaatgggttaattttcactgccttgttttcactacacttaccgctattgaggggccttaaaatagctctgctatcagaactcactaatccaaatcagtttataaaaacactctcagattaacaaatcaatgatacttacacaccacaaaattggttaccacttaaaggctttattctgactagatttatagcctgcataaatcccattctcatgtaatttagatggaagacaagcaagaggtatctctgctgtctactcacagcagtgtaggccaaaaaggagagcgattctttattattgatgtttagcagcttgtgtttaaaagctataaagaagacgcaatgaaaatacaatagatcaattcctaaatttccagtatagtttacaaaattttaagagggattaaggatgctagtaattaacttaaaaataagggcatcattatatgtctgtgtaacagagatcttttcagaaacaaaaaatcaagatttttttcttttccaactataaataaagcaaagcctgtttcagataaaattcatctgccaaatactttaatgctatcctgaggttaagaatgatgaaataagtttgatcattcttatggtaaaatgaaggctatttaaagatgagtttcattcctgctttttttttaaaaaaaaacttttatttctataagtttttgggaaacaggtagtatctggttacacgagtaagttctttagtggtgatatgtgggattttggtgcacccatcacccaagcaatatacaccgaacccaatgtgtaggcttttattcctctcattcttgtttttttaaaggtgttttgaacacataaaactcactgtatctaatatattctgagcattggattctagtaacatcacctcttaagatgtaaaatctcttcattttagtctctgttgagaattaaagactggtaaaaccagtaatgtttttagaagcatatattgctgtctgaacttgggatttctgattcaaaattcagagtaaaattttagctcttgggactgctacagaaatattctataagcattaataagaccatgtcaatagagcgttaattattaggattaaaaatttactctatggggggctgggcgcggtggctcatgcctgtaatcccagcactttgggaggccgagtcgggtggatcacaaggtcaggagttcgagaccagcctggctaacatggcaaaaccccgtctctactaaaaatgcaaaaatcagccaggcgtggtggctcatgcctataatcccagctacctgggaggctgaggcaggagaattgcctcaggaggaggcaggttgtggtgagccgaagaggcgccactgcattccagcctgggcaacaagagcgaaactctgtcccctcgccaaaaaaaaaaaatttactctatgggtatcaataatcaatgtgttattctaactcattctgtgcctcattcagtaaaaggctatgaagcaatttaaggatatttgcaacaaacaagttggtttgctggtgttgctcttgctttttttaatgaagggaagactggaaaagggaaagtgatggcaataaaagtaagggcaaactgggaggtggggctggacctctcggtgcataccgtaaagccccatgatactgatccatgtgagccaccaacttggttctgagtttcccagcaatcagaacaaagagggcaccacaatccctagaaaatacacccaaagtggtttttgagaggacaccatcatctctagaaaataaacccaaagtggctcttgagagaaggacagaacttaattttggcacaagcctaggactgccagatttagcaaataaaaatacaggacacccagttaaatttgagtttcagtaaagtaccaagtcctttttttttagcctaagcctgacccagatatttttgttaacctgaaatgcaaatgtaaccggtatcctctagtttatctggcagccttaccaagccataattcagagagaatatttgtaacagaaggccatttgtagcatgtagttttagttcttggtttcttaaggaatgactagaatgagaaatagtatatttcctagaaacaaaagcttctaatttcaacaacatcaggacatagtatacggcatgccgtcaagaaacctgctgaaatacaccagcagatctgagcaggagcaagtgctgcagaagccagggtaaggaggacgcgcagagacgccccgctgctgagagcgcctgtgcttcagggtccactgcaggtctgcacaccacagggtgggtcacacctgagacgcccgtattttaattcctttctcccgtaaagccctcacctcactccactctaaggatttagtcggtgaaaaataagattatacttcagacaaggttcaaccaaacatcatcaaataaacctattctaagaaatgaggagtatctgtattcgatggtagaagtttgaaaggaaatacagatttttttttttttcctttcaaagagcttgttaaatttgatctccctcttcaggtagataactcgtggtcaaagttttcaaaagtttcgacatgtaagaaagaggaaaatacatgtaaggcacacaaaaaccatctattttgtgtatgtaattccaaaggattttgcttctttcatggaattgcatagagatgtttgtcttattttcagacactgataagccattatcagtatcatctttacctgtgcacatgttttttgttgaatttcctttaaaatacaatgaattgaaaaggattaaattcttttttttttttttttttggagacagggtcttgctctgtcacccaggctggtgtgtagtggtgcaatctcagctcactgcaacctccacctccttggttcaaatgattttcctgcagcagcctcacaagtagctgggactacaggtgcccgacatcatgcgcagctaattttttttttttttgtatttttactagagacagggtttcaccatgttggccaggctcgttttgaactcctgacctcagatgatccacgcaccttggcttcctgaagtgctgagattacaggcgtgagccactgtgcctgggctagagtattaaattctgaaatgcaattataattttatttaggatatattttacatctaattaaataaatatcctaaaattagcttcacagtggagaaacctgacggccaccactttgaccaagtaatccaagttcatcccaccagtaatgggacaagctgacactgtgtgcctactgagaagggtacaacatcctcctccaacactcttgccaaaaatgcataacttggttgggtacggtggatcacgcctgtaatcccagcactttgggaggccgaggtgggtggatcagttgaggtcgggagttcgtgaccagcctagccaacatggtgaaaccccatctctactaaaaatacaaaaattagctgggcgtggtggcgcacgcctgtaatcccagaactttgggaggctgaggcgggccgatcagttgaggtcaggagttcatgaccagtctggccaacatagtgaaaccccatctttactaaaaatacaaaaattagccagatgtggtggcacacgcctgtaatcccagctactcgggaggctgatacaggagaattgcttgaacccaggaggtggaggttgtggtgggccaagatcatgccactgcactccagcctgggtgacgacagagtgagactctgtctcaaaaaaaaaaaaaaaattgcataacttgagtctaaacaggaggaaacattagacaaacacaaattgaaggatagtctacaaaataactgtcctgcgctcataaaaaattccacagtcataatagactagacataatagtctagataagaggggtctaaagagatgtggcaactggatgcaacatgtgagctgggattttcttcttactattaggtatgtactgaggataaattttgaaatttaaataaggtttgtgtaaagtatggcatcaatgctaatttcctgacttcgatcattatactgtggttacataacagattactccggtattgagaaaacatattctgcaatcttcagaagtaaaggaccatcatgttggcaacttactctcaaaggattcagaaaaaaaatatatgcacatatgtacacagatggagacaggaagaaacaaatgtggtcagtgtcagcatgtgggtatctagttgaagaatgtatgaaaaattctttctcttgcaccttttctcatgagtctaaaattacgtcaaaattagaaagttcaaagaaaaagacatttcctttggtaaaaaaaagtcactcagtatcactaggggaggcatccactttgttttaaagcttactgggcctgaaggaaatgacactcgaacagcacagccagctatagctacagcacagaaaaccacctccaccctctcccacaggagggctccccggctagagttttctgaatacttactggatagttcaatgttgtttttttgtttgttttgtttagctttgccttgttttttgttttttacagctgagaaaatttgagtttccacaacatccacagacaatctggaccataatcaagtcagtgcagtctaaagcaatgtttcaaatatccgaaggtaaggccagttctttattttttgattgctactgaaactaattgaatagtgttatgaatggagtcaaatgatgtgcttaatcaactgaatatccaataattctgtacagcctattctatgttagttttctctaactataagatattctaatggagaacaaggaaaggaataatgccatttttacccggccctttagaagacaaggtaaactcatcttttctaacaggatattgaatatgcattttttttttaagaatccaagccttacctgtacggttgtcccttggcgtccaaggagtattgattccactactcctttgggatgccaaagtgacaattgctcaagtctctgatatacaatgatgtagtatttctatataacctatgcacatcctcccatatacttaaaatcatccctagattatgtatatctaatacaaagtcaatgctatgtaaatagttgttatattgcaattttatttgtattatttttatcgttgtgtcattttttatgttcattttttccaaatattttctatctgcagttgggtgactcctcagttgtggaacccatagatacagggggttgacagacactaggttgaggtaatgcttcatgattgttgaatgtaggattttggatatgcagaaacgaatttctaccttaaagactgaggagcaaaatataaggagacaatgcattaagcccatctgttaattttgattagttttaatattctctttaatatactcttctgtttatataatgtggggctagtagacgaaagaatatcaatatcatttgatgatattaatgttctgattatgcctatattccttctacaaatatatatggcacaaaatccaaatgccaggaactggtctagataagaggaatacagacgattagacacagttcctatgctcaggggatttacactccactagatgatacttaagtacacaaactaaagagagaaaaccctaagggctatggagaaagatgaagcagggaaactgttggagggagagggaggatctggaacatcagcaaagtcttcactagggaggtcccttgtgcagaccaagggacagccaggaccagcactaggaggacgagggaacacaagcagagcagacaggtctgcgggccagggtgccgccaggataggagggctggcgggagaggcaggaggtcaccgcaggacctgaaggaaatgactcctggccaggggccagatcgtgatggtctcaagggttgaagtttaattccgagagtagggagaaggcactggaggacttgcacatggtagtgatgtcatagccttcatattttagaaggcattctacattataataatgtgagatttacagaagagttgtaacgactgcacagagcgtcctcagatgcgctgcaccccacgtccgctgctgttaacatcctacataaccaggccatcttcccataatcctctatatttaaaaggtgatctgtccccttactgtatagaaaataattacgaactaataataacgacaatcattatgaactaataacatcgcatgtcaactgcatcccaggagctgttccgagtgcttcgcatggatcacctccttagtccttacgggctgctttgagtgtgagggcagggctattgatattttcattatccccatttaatggatgaggacagtgaggcagggaaaggtgcataaacctgcccagtgtcacaaaactaatatatggtgaggctggtttcaagctaatattggccaatccccaaccctgaactctggaatagtctgggggagcaaaacaagatccagggagcccagttaggaggctctggctgtggcctgtggtcagcagtgcagcggtcaggtgggaggtgatggcacctgggggctggaaggtgaggccagcaggtcttgctggtgggctgccctgtggagcagacaaaggaaaaggaggcaggggttgcgctgccacttttatcctgaggaaccggctggacagtggtgccttctactgagagtaggaagactggggaagagcgagagagggctcgaggagttctgcttcggatgccacattggcaaagcttataaattatccagttgtagccaagagaagaaggtgagtgtttggagagtagagagtgacacaccaagtcatgatgctcaggggtcaaataggtggaggtgatagaattgactgctggaggccgggcgcagtggctcatgcctgtaatcccagcactttgggaggctgaggtgggcagatcacgaggtcaggagtttgagaccagcctggccaacatagtgaaaccccatctctactaaaaaaaaaaaacaaaaaacaaaaacccagcagggtatggtggcgcatgcctgtaatcccagctacttgaggggctgaggcaggagaatcacttgaaccctggaggcagaggttgcagtgagccaagaccattctactgcactccagcctgggtgacagagcaagactccgtctcaaaaaaacaaacaaaaaaagaactgactgctggacttcatgccaaatctatttacaaatcaatttaacactcttcaagatgtagaaatcaacaaaaattggttcatcaattttctgtcctcagcctgtctcctcttcctcccagatccccatcccagctctgtcttatgagagaaacaaggaaagagagaaggaaggaaagaaagaggggaagaggctgtgggcaagatgggagaagacatcaagaaacccaaaggcaaagaaaatgatggctttcaagaagagtggcaggccacacctcttccctttgaacaacaaattcatgtcacttctttccaatatcaagacacccgtaggacacaataatatattttctctcagatttttgttagaattcagtcaaactgtctgctttagaatttattatctcatgacatgagcctctcattacagggtcacatatttgatttatgacatcaccagttaagttgtttctagtataacacttacacagttaaaatatataaatatttttacatagaagttatgaaatttcaagttgactgaataactgaacaactaaaaacactggtttttttatatttgaaaatgtaactacatgtgcaagaaaattataggtaataaaataatagtgaagaaaagaaaaaaataagtgaaacaagaaaataaggaaacaagtggattacaaaattatacattctagagaggaaaaacagtcaaatcagataggcagaagcagggatacctaaacgaacatggatcaatacaagttcttcaactacatgaacactggttgggggggtccccaagaaagcaaaatccaatggaaaatgtgactgtattgggtgggtaccctttgtgctattcaaaaggacaaacaatgccgtgagaaatctaaacctacaatgtaattgttgactccatagtgtgactataaagtagtgacaaaataattatatacttgtttctattgtgtgtcagataaaacagcacaaattcttgcacccatgtattacaagaacatcaaagaacacgttgtcagtgttcaaatacggcaaaaagttgagagggaagtttttctggtaatctctcacattcaacaaaccaccgacaacaagatactccaaaggaacccacagtgtggggcgagatgtaggaatttcatacacacagacaagaggcaggggagctatgttattcaagctcaagaaaagtatgaaagtaaaggcttctgttatgacactgggttttacctgctttcccattgttgtgttacaaaccaccccttactttttattcttttcacaatctctttccacgcagacactccatgtggttagcttggacttcctgacaacatggtggcctcaatgtatctggatttctcatatgaaagcccaggactcttcacgaaggccaagacggaagctgacagtcatgtcaagagctaggcctggcagagtgtctttttccactgaactcagtgcaagcagggtgaggtcagcccaaattcacagggcagggaagtagaacctacctctcattgggagggggatcacattatttgcagtgatctttactatgccacagggttgatcacctttatggcaatttgattgcttatcagccaaaaggaaggaggtggtgctataatttacggcgggaaagtgaaaaaagaaagaacattcctgggtcacttctctaggctgcctctgactaactccactgacaactttaaatccacatcagaggttgcatttgaaacagaaagacaagaaatacctgcaactaatgttgtcctgtggagtggccggtggcaggggacagctgaaagatccacacagaaggacaggggacttgcagacatggggtcggggtgaggagtggggactgcaaggagactgacagcgtggagctgccagctgtacaaagcttgctatacctatcagggttgaggactcatttttgtgtttcgacacattcttggcacgttccccttgagcatgaggcagaacgcaactgcctttgcttattttatctagagaatgatgaccaaggtgctctttccctaaagagaaggcagaacaagaggagagaaacacattactatggttggaggttaaaaaaaaacacttttctggaaataaaagttattcaccactaaaacagtttacacctaaaagtcagagaatcacttatttggaagatttctatctttactagtgcttattgtataggaaaacaactatttaaacaatactcttcacaatatgtatgtttttctttttctgacattgttttccaactttggtttgctattttttccctttattcctcaacttgtctcccacttctcagcctccattcatgtctgccttgcctttcacccaccagtggtcccagcgatatcgacaagaaacccctaggaacatttagcacacacaaaaaaagcctactaaatcccttcctggtggtccctatgctcataattaagtcggtgcatttctgtctggaaggagagttacactagattatttttctgatcatttaagagctagtgcccattagttataacaatggttgtaggagaatgaaagtgctgaccaactcctatctttgcctacacaatagttctctacctctttcttccctgaagatgatttgatgcaagacctggcctgagagccttccatgtctcggcagcagggactctctgactcagagaattgatggctaatctcagtttgcctcaagaatcctattctccgtgtacagtgactgtattaggagtgttcataggacctagtcttggccaatgaaaagtaccgggaagactgctgggggcttctggggagtctatcacttcctgatacctagagagaaattcaaaagaacaagaggctttgggcctcacgcttttcttcctgtttggattccagggtgatgagatgttatcttgagctgcagcacctgtgggcatggggtgatgaacacatgccgaaaggaggagcccagggcttcacagaagtgttagctcctaaacagagccctcacctgccaacctctggacttctcataactaaacagcaaatgttctcaggtttcagacctcagctggtcaggttttctgttattgtagctaaaggaagctgtgctccatgaatattttcatatttcacatttctgcatagctagggcttattgagtaaggattactggcaacccaagttaaagaatgaccgaatggtgaacatgccttggaattcgagatagtgacttgttcctgtgacatgtaaaggctcatctcctctgcagccattcacttacccaggggtgacaaaactggggacctttctctcctttcttcagagaagattcttccacattcccggacaaaacttcctgccttgctgccctccacccccgactctctctctctctctctggagtggagaagggacaagtgtgacagttactctatgtaagctccaagtttcataattccagaggtcctctcctggggagaaagccctgcccatgcaggcacatgtggccctcactgtaccataccatgggagattagtgcatgaggtactggtgctgctatgatgttctgtgagtaaataaaaggtctgtcctctgatccagcgtgcgcacacacacacacacacacacatattctaaacccacatacacacatgtgtgcgtacacacagttagggtagttcatgtacctacttaaatgcatgcacaattctgtgtgtgcatttttcttagtgcagaaggggagaaggtcctatggttttaatcagattctcaaaggtgtcagtaatcaaaacaaaacataacaaaattaagaactagttactagagtataaatctcttgaggaaaataacattgtcttaatatctgtagggcctagcacagtgtttgacatgcagcagatgctcaataaaagcttcctaattgaatgaatagataaattagttgtgtggtcctccaactatgctcgatgcctagtgctctgggtgaaagaaacaagtatgtgacatttaaatacaaactcataagccataaactcatagaaacagatgtatacacgacaaacttgcatttatcagcatgaaagtctgataaagctctatattgagaaacattcaattgtatgatagcatggaacataattttgtacatccaaatgttaattataagagagagaaaagacctgtaaatgaaagagagagatcaccgtgagttatctacttaacatacgggcttggtcacattaagcattcattctgcatttaagcattctgaatcttaagaattttaatttgccttcttagcaatgagaggctggagtaaaaacccaaaacatatacacgcatatgatttctatattatatgaattttgtataaaacatgattatctttctctaattcattagctagtttatcataagcatccactcgatggaatgtgtttttcttccttcaaagcataagatacaggatatttaacaatatatgttacgaaagtatgtacagcagatagattagtaaactcttcttgtaacatacttcttccaactatcctttttctttggatgttgggtggccatggatgttatgggttgaatttactccccaaagagatatgttcaagtcttaaccctaagtaccaatgaatataacctcatttgggaataaaatctttgtagaagtaatcaaattaagataaggtcatgagggtgggccctaatacaatataactcttgtccttgtaagaagaaaagagacacaaagacacacagagacaaagccatgtgataacagatcagctgtctgagtgatgcagccacaagccgaggaatgccgactcctggcaacaccaaagctcagacaaggggtgggagcagatccttcccagagccttcagagggagctcagtcctgccaacaacttgattgcagacttcaggctcccaggacaatgagacagtaagttcctgttgttttaagccatccaagcttgtggcagattgttttttggcagccctaggaaactaatacaatgggtgacaatggatatattcttgtgactcagatcctgctagtgcaatgttgatttccatctgtcactatataaaatcattgacactcagatgggaggagacagatcaaaggagatcaaatcatagaaaatagaaggatctgagaagaccattcttttaacatgcaattgccacttaacctaaccaaaagatgtattttgtaacttatccttaagactattgttctgataaaaataacgtttctttagagttctgaaattcaagagcaaaatgattgcctcattggaattacagttgacttacatttgagacagggcatcttggacatgtcatttgaaaataaggaaggcattggacttccctttataccaggtaaactttcattaaattcaaccaaagcctggcttacagcaatttctgtgctcccatcagcttgaattgttctagctgtgtttggcagtgctgggatagggatggggtaacataatgatctctcgctagctacccagttttctatttctcatttgttcttaaaagcctcaaacactcccaaagtattttcttaaaaattgggctttcgtttatttttggaaagaaaacaatcaaatgttgatgggtgaggaatgtacagagacagcaacacagggattctcaaatgtttctgctactgggtgtctatgatgacaaaggcgagacccaatggtgcaattttcccaaacatcccgcacacgtgaaaacaccatgtttgtttcttcaaccacttctttaaaatctgttatattaacattcaattaatgatataatttctttttattgtacagttcattttcttagaaaagctctgggtattgaatccttagaagttccccaaattgctattttgaatagcctaatttttattccttacttggtattattatttcttctttctctcatccttttctgttatttctctaccccttttctttgtgcattttgatcagctagagttatattcttttccactcccagaggatacttcaaatcccatcaccctctctgaacggtcttccttttctatcctcattcatctgggtggacttcttccaactgcatcctcctgttcaaatccatgcttgcctgggatcacactgagtcagtgattctgatggtaattttttcaacaagcatttgttaatcattctctgtccaagtagtaggtcataataattagatactttaggtaagagataatttgggcccagtttctaccctctaggtatgtctttattgatatacccagacagtactagttagttagttaatatactccgtatacaatatactctagaaaattacggttctgttgaattggcatgcttttgttaatgcagattgatgctacatctccaacactaacctcagttaaactttttacctaagacaaggcatattatggggatatatgtgtgggaaagaagaaaatgttctcacctactagatgggtctttctttcctttcttatttcattctttctttcccttttcccttcctccctgattccccttttctctctttcttctcagaagacactattaaagcag

SEQ ID NO: 32 - DNA, 13336 bp, Homo sapiens
ttaagactgttacatatgctacatactcacaagcggaggactaacaagtaaactacagacgtaaggtaacacttggaaagcatgggattatagagaaatgggacaatgctgtgtaatgtgtgctgatgctgaattacctctaacacaaagaaaaaacactagaggtagaacagcggtttgcacacactaccatggtgttcaaatgcatatacatgttatgtgatacatgcatgcatagctattctcatatgccacgcagatctctgcaaggacacccaaaaactggctaatggacttgccaccaggaggggtgttgtctgaggcatgtcagtgggagacgagtttttcatcagatatacctctgtatcgtttgcatattggactacatatatcaataatctacaaaataaataccctacttataaaactatttacaaaagttaggctgggcgcggtggcttacgcctgtaatcccagcactttgggaggccgaggcgggcagatcacgaggtcaggagatcaagatcatcctggctaacacggtgaaagccagtctctattgaaaatacaaaaaattagccgggcgtggtggcgggtgcctgtggtcccagctactcgggaggctgaggcaggagaatggagtgaacgcgggaggcggagcgtgcagtgagccgagatcgcgccactgcactccagcctgggcgacagagcgagaccccgtctcaaaaaaaaaaaatcaaaaaacaaaactatttacaaaagttacattacaggccaggtgaggtgcctcacgcctgtaatcccagcactttgagaagccaaggtaggcagatcagctgaggtcaggggtttgagaacagcctggccaaaatggtgaaaacccgtctctactaaaaatacaaaaattagctgggcatggggatgcacacctgtaatcttagctactcgcgagaccaacgcactagaatcgcttgaacctgggaggcagaggttcagtgagctgaaattgcatctctgcactcgagcctaggcgacagcacgactctgtctcaaaacaaacaaaacgttgcattataaaaaacacttaaaaacttacgagaaacataaacacatttacaaaatttcaaacacatttttaaactattctcattctaaaattcatgtggaaaagttagtgtacataaatagccaaagaaattttgaaaaaactgaggaaattcatcaaatattaaagaacattaatataaagctacaatattaaaataaatttccagaccaggcatggctgctcacacctgtaatcccagcactttgggagggagatccaggcaggaggaggctccctcgagctcaggagctcgaggccagcctaggtaacatagggagacccccccaactctcaaaaagtaaacacacacaaaaaaaggttaaattaatttccagcagggcacaggggctcatgtttgtaaccccagtgctttggaaggccaagttgggaggaacacttgaggccaggagttctagaccagcctgggcaacatagcaagaccaacctcttatttttttttttttaatttccgctgtcacttattaagtcaaaatgaattccagatggaccatagaagtaaaaataaaagctaaaagtactgaaagaaaacatgaaagatttagtaactttattgagatgtaacacatctgccatataattcacccaagtgcacaattcagtggttttagtatattcacaaagttgtacagccacgaccactaaccacagaacatttttttttttgagacggagtctcgctctgtcgcccaggctggagtgcagtggagccatctgggctcactgtaagctctgcgtcctgggttcatgccattctcctgcctcagcgtcccgagtagctgggactacaggcgcccgccaccacacccggctaattttttgtattttttttttagtagacacagggtttcaccatgttagccaggatggtctcgatctcctgacctcgtgatccgcccgcatcggcctcccaaagtgctgggattacaggcatgagccaccatgcccggacaactacagaacatttttatcaccccaaaagaagccctacagccactcatgttcactctcttttccctctcccaccagctcttggcaactactcatctatgtctgtctctatggatttgccttttctgggcacttcacagaaatgaaatcatacaatatatggttttttgtctggcttctttgacttagcataaagtctttggggttcatccacatatagcatgtatcagcacctcattcctttttataactgaagagcactccgctgtatagattatttttttccattcatcaaatgatgggcaactgggttgcttccaaattttttgtgagacagagtttcactctcgttgccaggctggagtgcaatgacatgatcttggctcactgcaacctctgcctcccgggttcaagtgattctcctgcctcagcctcccgagtagctgagattacaggcatgtgccaccacacccggctaattttatatatatatatatttttttttagtagagacggggtttctccatgttggtcaggctggtctcaaactcctgacctcaggtgatcggcccacctcggcctcccaaagtgctgggattacaggcgtgagccaccagtcccggccctttttttctttttttttttttgagacggagtctcactctgcagtggtgtaatctccgctcactgcaacctccaattcccagggtcaagtgattctcctgctgaggcacccgccaccacgcccagttaatttttgtatttttagtagagacgggttttgccatgttggccaggctagtctcaaactcctgacctcaagtaatccacccacgttagcctcccgaagtgctgagattgtagacatgagccactgcaccaggcccagcttccaactttttactgtaacttttgttttggggtggggtgggggtctcactatgttgcctggagtgcagtggctgtttacaggcactgtcatggtgcatggtagcctccaactggcaggcttaagcgatcctcccacctcagcctcccaagcaggtgggattagaagggcgcaccaccactcctggcctatttgcactcttttttttttttttttttttttgagataggttcttgctctttgaccaggctgaagtgcagtggcacaatcacagctcaatgtagcctcaaactcctgggctcgagcaattctcccacctcagcctcccaaatggctgggaccacaggcatgtgccaccacacccagcaatttttaaaaattttttttcgagatggagtctcactatgttgtccaggctggcattcaactcttggcctcaagcaatcctcctgccttggcctcctgaagtgctgcaattacaggcatgaccaaccgcacccagcctcgtttccaccttctgatggaccttcagattgttttcattttcgggttattatgaataatgctgctatgaacattcatgtgtaggctgttctgtggacatgttttcatgtctacaaggtatgtgcctcagggtagaactgtggggtcatatggtaattcggtttgactgtgtgaggagctgcaagaatgttttcctgcagaggtcgcaccgttttacattctcaccagcagtgtgggagggttctgatttttccacatcctagttatccattttgtatcacctgtttttttgttgttgtttctttaatttttaattatagccaccctagtgagtaggaagtgctaactcactgtagttttgctttgcagttcctaaactgccaggcatcttgagtttttaaaaaaaatgatttaagaggaaatctttttttttttttttttttgaggcggagtctcgctctgtcgcccaggctggagtgcagtggcgggatctcggctcactgcaagctccgcctcccgggttcacaccattctcctgcctcagcctcccaagtagctgggactacaggcgcccaccaccacacccggctaatgttttgtatttttagtagagacggggtttcaccatgttggccaggatggtctcaaactcctgaactcgtgatccacctgcctcagcctcccaaagtgctaggattacaagcgtgagccaccgcgcccggccttaagaggaaatgtttctaaacaaaatatataacccaaaaggccataaatataaggaccacataaaaatttaagtcaaaagacaaacacccgggtgaggtggctcatgcctgtaatcccagcactttgggaggctgaggtgggtggatcgcctgaggtcaggagttcgagaccagcctggccaacatggtgaaaccccgtctctaccaaaaatacaaaaattagctgggagtcgcagcgggcatctgtaatcccagctactccagaggctgaggcaggagacttgcttgcactcgggaagcgaaggctgcagtgagccaagatcgtgccactgcactccagcctgggcaacagacagagcgagactctaactcaaaaaaaaaaaaaaaaaagacaaacacattaagaaaaaaactgggggccaggcacgacggctcctgcgtgtaatcccagtactttggcaggcagaagtaggaggatcacttgagaccaggagttcaagacaagccggggcaatatagtgggaccccatctctaaaaaaaatgttttttaattagccaggcatggtggcacatgctccttgggaggaagaggtcacagccacttgggaggatgaggcaggagtatcacttgagtccaggaggtcaggcctgcagcgagccaggatcgcacaactgcactccagcccggatgacaaagcaagaccctgcctctaaaataaaatttagtgccgtggctcacgcctgtaatcacagcactttgggaggtgggggcgggcagatcccgaggtcaagagtttgagactagcctggccaacatggcaaaaccctgtctctactaaaaatacaaaaaaaaacaaaaattagccagaaagccaggagcagtggctcacacctgtaatgccaacactttgggaggctgaggcggatggatcatgaggtcaggagttcaagaccagcctgatcaacatggtgaaattccatctctactaaaaatacaaaaattagccgggcgtggtgacgggtgcctgtagtcccagctactagggaggctgaggcaggagaaatgcttcaacctgggagacggaggttgcagtgagccaagattgtaccactgcactccagcctgggcgacggagcgagactccatctcaaaataaataaataaataaataaaaataaatgagccgggcatggtggcgcgtgcctgtaatcccggctacttgtgaggctgaggcgagaggactgcttaacctcgggaggcggaggttacagtaaggtgagatggcgccactgcactccagcctgggcaacagagtcagactctgtctcaattttttttttttttttgagatggagttttgctctgttgccgaggctggagtgcagtggtgcgatcgcggctcactgcaagctccgcttcctgggttcacggcattctcctgcctcagcttcccaagtagctgggactacaggcgcccgccaccatgcccagataattttttgtatttttagtagagatggggtttcaccgtgttagccaggatggtctcgatctcctgacctcatgatccgcccgcctcggcctcccacagtgctgggattacaggcgtgagccaccgtgcctggcccgacactgtctcaatttttaaaagttatttaaaagggctagcgcagaggttacggtgagccaagatcacgccactgcactccagcctgggcaccaagtgcaaaactccatctcaaaaaaaaaaaaaaaaaaaagaaaaaggccattggttcaagagaaaaatggccattcacaaaaacaagaaacatcaatggctttacgtcctagtaaaagatgttttaccacactcataactaaggaaatgcactttaaaacgagatagcattttcactaccagattgacagatgttttaaatactgtcattctagcactggtgaaggtgtgagaaactgttggcaatgccgtctgttatcttggggaaactcagcaacaacctaaatgtccgccatgagagggttacataaattacaaaacatcctcgctatggaataccagagctctgtggcgacaggaaacaaaccccagaatataagtggaaaatgcaaggtacggaagattacacacggttccttcccagtttacctttgtttcccttttttttgtgtgtgtgtgtgagacggagttttcgctcttgttgccaggctggagtgcagtggcgccatctcggcacaccacaacctccacctcccagattcaagcgattctcctgcctcagcctcctaagtagctgggattacaggcatgcgccaccacgcccggctagttttgtatttttcgtagagacagggtttctccatgttggtcaggctggtctcaaactcctaacctcaggtgatccacccgcctcagcctgccaaagtgctgggattacaggcgtgagccaccgcgcctggcgagaagattcttaagtacatgaacattctgaacagaaagacctgtattccctcacaaatgtctgagttcttagctctggcattctcaacactcactgtttcttgaggtttcctgtgttccagaacctggtctaatcgttctctactatgatatactgatacttcattcatcaggaaacataactccttgaacataaagaaaaagaacaaaaagcgaaagggcacctcggaatagtcaaaatatgggcctgaagccctcaccctgagctttgctcatggaagactactggccccatatgaaatccatctcattctaacaatttgatgctaacaagtttcccagccacatctgcaaactaggaaaggagagaacagggctccagacagacctgcaagttaaggccacagtaagagaggccaaaaatataaacactcacaatgcagttttgatgtggggacacttcatagacgaaggattcttcacatttcaatggccctacgggagcctacatattaaaacagaagaccaaacattaacacccgtaataatgaccctgaaaacatccaagagaggttcagtcatgggccatcaaatgatggagtgttctagaaagacttctcatcataatggttaaaatgaaatgttttaaagtcagcctcgtggaaaattcgcttgaacattccattgcctgacaaatgctgaaatactggcaagtgtgaactaacatggcaatgtgctgtcttaatttctccttcgaggtgcatatcactaacccgacacacatagttacattagaaggacccacgtccttctgtcttcttctcagcagcattgctgaatagcctcctgctcttaatatggcatttaatttagctatctcaaaattaatttcttttatatgtgtgtgtgtatatatatatatatatatatatttttttttttgagacactgtcactctgtcacccagactgtagtgcagtggcgtgatcacagctcactgcagcctcgacttctcaaggcttaagggagcctcccacttcagcctcttgggtagctgggaccacaggcacacccagctaattggaaaaaaaaaaaaaagggttttttggtagagatgggggtctctctaggttgcccaggctggtctcaaactcctaaactcacaggatcctcccgccgcagcccccaaagtgctgggattacaagcatgagctaccaggcctggccaattttttaccttctagccacatttcttaattatatggctatgaagtaactgagccattccttttaaaaccaatgattcagctacatgtcctttcaatctacccaatctacaggaattcacctggttaaaaagccaatggcagggctgggaacggtggcgcacacctgtaatcccagcactttgggaggccgaggcaggcagatcacaaggtcagaagttcaagaccagcctggccaacatggtgaaactctacctcaactaaaaatacaaaaattagccgggcacggtagtgcatgcctgtagccccagctacttgggaggctgaggcaggagaactgcttgaacccgggaggtggagattgcagtgagccgagttcgtgccactgcactccagcctgggaaacagagcaagactccatcttgaaaaaaacaaaaaaaaaacaaaaaccaaaacaaaaacaaaaaaaacacaggtggcagtaatactcccgcaagtagatactgtttctccaagctacagcttttatggtaattcctagtggttttagcagaaataaccagccacaccacaaataaactccctgaaatctattttgttaaatgctgtggaactacagggaagccactttgtggactaagagcagcttcctagtagaaggcaggtcttcagtaggactaagcaggacggtggtaagaaaagttctagctggctacacttgaggcaccaaaaacgccatccatgaacattctctggctttgaacccaaaagcactttttacttcatttgagtatgaatggatacattttcaatcgctatcaagattctttgtcaggcccgacgtggtagctcatgtctgtaatcccagcactttgggaggccaaagcaggcagatcaaaaggtcaaaagattgagaccatcttgcccaacacggtgaaacctcgtctctactaaaaatacaaaaattggctggccatggtggcatgcacctgtagtcccagctactcaggaggctgaggcaggagaactgcctgaattcaggaggcggaagttgcagtgagctgaggtcatgccactgcacttcagcctggcgacagaaagaatctgtctcaaaaaaaaaaaaaaaaaaaaaaaaaaaaaaaaaagatatgtcagcattttgagacaagcaagtatcacaggcctcagtaacagcctctttcatggaactcacctttgtcacatggtatttactgacatggggggcaggagtaaatgtttattttcccacagttttcttatcaacctgacacccccatccccaccccgcaagctgcattccctctcttcctgccaaggggtagcaaaatacttggagattcctcttttgtcttagcttaggccaactactcacccagtaaccaataaacgctttgctaatctcttacattcggattgatgtgtttgtttccaagacagagtcttgcactgtcgcccaggagggagtgcagtggcacaatcttggctcactgcaacctccaacctccacctcccaggttcaagcaattctcgtgcctcagcctcccaagtatctgggattacaggcgcctgccaccaccctggctaatttctttgtatttttagtagagacggggtttcgccatgttggccaggttggtctcaaattcctgaactcaagtgatccacccacctcggcctcccaaagtgctgggattacagacgagagccaccgcgcccggcctgatgtgttctttttcaggcactcagataactcagttcccttggtcctaactaagctgaaggtcctcctggtggccttggacagctgggccacaccttcctctgccgtctaagtgccagcaccacagcttaatcagacgacaaacatgtcatggacgctacacctctagcgtcatctcagcaacacaaagagctgtttcacagacagagtcgcaactgaccagcaagtactactcccctccactctgaaaagaacagccggagagcaccagaaattcacctgaattctcctgaagggtgcagcacacaagacacggaaatcaaacagcacaggctccaaacaaagggagagcagagggaggaggcaaaacccgtcaacaaaacgaagtactgaaggggagggcgcagcaggcaggcaccacctacaggagcggggtccaggtgaggctctttttggaagatgaaacaaactagctagtacttgagccctgagcaaagtgaggaaaccagctctcccgaccttcctggtgctggcaggggacctactctcacaactctgatttccaagacaggaagttccagcaaaggctccagcttacagagaacaaaaaggcccaagatcttaacgcctgcaccaaccagtcctatcgtggttgcctcagtcatgttctggcaatttcacgaaaacaagagcatctggcatgaccaggagactggactcggcacccttggtgattgtggcagtcacctcgtcatgcaaaatgaccaacccgtcaccgtacctgcctgaccacagaatcacgtttgctttgggagactgcgtctgctgttgatctttccaggtcttccctctcctttaggaggcggcctcatccttctactggcacatctgacacttctgacagttggagctctgacgaaaagctctcatggtgggccacgtggctgggctccccacacaccaggcccagggctggctctgtgactgtcctgaggaatgcaggatgaggctcctacgcacaagcttatatctgacagaaaagacacaactgctagcctcattcaccatcactcctgcacactcccgcaagtctttcatcaaaccaattattcagagctatctccttacccttgcacctgcagctttccagacatggaacgttcctccctcccctccagtgaaaacagccttggacactcggcccaaatcgctcctcatctgtgaaacttaccctggggcaagcagctcttgtttctctaatgtgctgtccaggccaccaagatggccctggtacactgctcagcagccacctatgactccagacagcagggtcacattttctttgacgactcgggggcattggaaatgtatttgctgaataaactgttatgggcaaaaatgacaaatataaagtccacaagcggatatcctagcccacccctcacagaaatattctgagggtaggccaggcgcagtggctcacgcctgtaatcccagcattttgggaggccaaggctagtggatcatgaggtcaggagttcgagaccaccctggccagcatagtgaaaccccatctctattaaaaatacaaaacctagctgggtgtggtggcatgcgcctgtagtcccagctacgtgggaggcgaagtcaggagaatcactcgaacccaggaggcggagggtgtggtgagctgaggttgcaccactgcactccagcctgggcaacagagcaagactccggctcaaaaaaaatcaaataagatattctgagggcaagtgacagggctggcagtgtcaggggtcagtgaggtctgaaagggtaagagggctgagctcatgggtgactgaggcagcgtagcatgggcgagaggattccacagacataagacacgcacacctgaagccaggcacatgctacaacctggaaatactttcccaagaaaagaaaaaaatttcaagaggtctggattttctacataggtggatctgcctaaactattctttctcccctgttgcacaagacatgtattttcttagctaaattctctcatcgttcaatcaatccaaacaatttaccttcccattcatccacacaggtgacaatgacaagggcacctgccacgcagaaggctgccaagaacatgttccatttcttagactcaggcagaggaatgcttgaaccaccgcaccagaagatggaggacgagaggagagagacaatttttaagaaaaagagataaagggctgggcacagcggctcacgcttgtaatcccagcactttgggaggccgaagtgggcggatcacgaggtcaggagatcgagaccatcctggctaacagggtgaaaccccgtctctactaaaaatacaaaaaattagccaggcatggtggtgggcgcctaaagtcccagctactcgggaggctgaggcaggagaatggcctgaacccgggaggcggagcttgcagtgagccaagatcgcgccactgcactccagcctgggtgacagagcaagactccatctcaaaaaaaaagaaaaagaaaaagagataaagaaacagaattaaaatgtccctgggctgaaaactgacatattttccaaatggaagggacagtgcatgatacaaagcatgaatcacaaacacctgtggacgcgagaccacaaacgacaaagagaaaaaatcttaacctccaagggggaaaaaacccgagtcagctacaaaagaaacgagaaccaaattaacagaacagttggccaggcacggtgacacacgcctgcaatcccagcattttggagggcaaggcaggcagatcacttgaggtcaggcactggagaccagcctggccaacatagtgaaaccccacctcataaagacaaaaaaataaataaataattgatcagacactggtgctagaagagagcaacagcatcactttctgagggaaaattattattatttttgttgttgagatgaagtctcactctgtcgcccaggctggagtgcagtggtgcaatctcagctcactgcaatctctgcctcctgggttcaagcgattctcctgcctcagcctcccaagaagctgggattacaggcgcgcgccaccacacccagctaatttttgtatttttagtagagacagggtttcaccatgttggccaggctggtcttgaactcctgatctgcccacctcaggctcccaaagtgctaggattacaggcgtgagccaccgcgcccggccacaaggtatcttttatagaccactggttttgaaaagacataagattcagcgttgaagaaaatacctttggaataggcagtcttgatgcctgctaaaggggatataaattgataaggcctttttggacaatttggcagtatctgctaacatttcaaaaatgcataggctctgaaatatcaattctaaaattctaattatgtaaggctaaagaaataccgcacgtgaacaaatatttaagtactcacccattctatgcagcattgtaataaaaagtaaaacctgaaataacctttattgcgtccactaataggacaatgtttaaacaaatgacacgtccatcatacagaatactgtgtggtcactggaaggcacatggacctgtatacactgacatgaaaagatgtggaaagaatgctgggagcgttaaaattttctgaagtacaacgtagcacaatgcatacatggtttaggctt

SEQ ID NO: 33 - DNA, 10004 bp, Homo sapiens
gtcatgtgtattagtatcacttattaatgcactagcaaattaagtatttaagttttttccttatgtgatctattttttgttaatggacagttacataataggagattaagtatgaaggaatagtgacccaatctggaatgcagatgtgtaagattgtctcagtttatctgaggccacataaaacacatgcacaattattaacaggctgcagttatttattggaaaccaaagcaaataagttagttactggttaatcctgctaaaagacactgttatgacaacaccaccagggaaagaaaagaagatagagcaaaccacttttgttatgcagataaaatgattcagcatagagattctctcaatagcagttcagtttcctgctggcctgtaaacataatcagcaatgcccttctgaggccagtgctgcaggattattccaatgtgaggtcaatggggtcaatctgtgtgaagtggtgacaaacactaagagaaggtaagaagctatttgtgtgatcagtgatccatagactggggctcagagttctgggaagcagtagagttatgaggtagggtggtagttaagcacttagcttttgccatcaaacaaacctggaatcaaattccagctccccatctttagttctgtgatcctaagcaatttaaattttctgtctgtaaaatggtgatcatgttactcaccctacgaggttgtctatgcaggttatatgttatagccatataaaggaactagcacagtgccagccatgaggtaagcatttgataaaagggaactgttagtactatcatagttgtatgaaaagggaaagcatgtctgtccctttaagctaaggaactaagctaggcaaggagtaaggagataaagaaggcttgttgaagacatcaccctacagtccagcagctcatccaaaagccagtcatgtgcttgatgttcacagaacatttctgaatcaggcaacactgcaacaatagtaatagccacaataacaattctaaccagcacttttaagctccattcctatgactgaaaagaaaggcagtaaagtctaaataatacgtgcagcaacactgccgaacttctctgggtgaaaaatgaaggatcactttccacatttaactgaaacaatcaggaaaaggaaaataaggacaaaatgaatataattactcaactggaattggaccaaggtgccgtgtaatggtcttagcaatcacatgtaggcacttatcacctttttatgtattctaaggagatcctgcagatgaccagagccttatatatgaggtttgcaactctaagtaaaaaaaaacgttagagtcagtttttttcttatggctgggaagacagaaatggatgcatactgatgttgttctagtccttatttgtgttttgatttaaaggacagcacagatcctgagttgttaagtggcgtgtcttcagattcccacacagttcatgtaattgctagagttgtttcactcgcattgggtgaagttactattagcaccattccagatgcagatatactatagagtgtttgtttgtttgtttgtttgtttgaagttctttttacttctaggttggcatagctgtgttctccagtgggataggtccaattctatgttacagaatacagaaatagttcatcttcccttcatactagttgggcctggctagagatgccccttaagccattaataaatctacttgctaattcacttagagtactaacaaggatctcacctgggcctgtgggtacaaccactccatagaagagctctaaacctaaatttaaacaaaaagaatttcacccatgactgaggaagcatccacaggactattttacatgctttacatttaaatttgatattttgagagaagactatgtaattcaaaataattttattttatttaatatgtatttagtccttctggacccactacagagctggatgttgtatcattattatatggttattataaaatgtacactttactcatcaataaagccaattttacttttgaaaattgaggtacctggcttctgtggtttctctcaacagaaagtcctatgaagagtaagaactataaattgtcaagtagacttgaaaaacttatgcttattttgtaaattactgagctaggtctggcccttcattttgaaaagctatctgcctataagaaagaggaagtatgaggagcacagttatctattaatcaacactgtgaactggaaacagataaagtgcaataaagaaggaaaaggaaatcatatggtaaacaccgttaacccaacggcacagttgatctgtctagaccttaggtcagataagctgtaataaagctataaaatccacgaaaaactaaagcttatttacaaaaactgcaaaatttgaattttctataattaatgccacttaaaatgaaagaatttaatatcaaatttcatgtataaacatgataaatttgaactctcaagtagaaacctcatctacaatacactaagtgttaataattctaattgtcctataatccacacttcacagcatattctagagaaaatagctgttgggtttttatgacttaacttaaacttcacaacttttaaaataaaagtttaagagctaatttaaaaatgtatttaagaacctaaaatttagaaaatattaaaaattatattttcaaaatatcctcaacttgaagttatggctattgaaatcaatgatttattctcagaaaatgtgaaaattttactggcctgcttgtatacatccctggggtcttagtttagatattatctcctccagaatctgatatcctgtgtctaatcctgtcataataatcattttattgcactggaattgtcttttacataagactgtaaacttggggaccagcatttgtatcttattcaccattacatctgtagtttttacttagcacagtacataatgtgtggtaggtaggtcttaaatattggctaaaggaatgttgcatgaattgtgttagcttgtattcttgatgattaagaaaattcacactgcataaaaaattaaggaatcacattcgtaaacaagttattcccaatctttaaaggactaatcttccaatctattttcttgtgctttttctacctatttttcctcttaatcagtacaaacttaaaatatgagaatttgagtctcaaatgttaacaccaggttagaaagcctcgttagtttggccccacattggacaagaatgagttgtccaaatcctacctgttaacagatactcggtatggaagaaactgttacacagagttcactgaaagagttctgcagttcctaaccaattatgtggttcttatactttctctaaaaaacttcttctagctatagttcctgagacagatacctccactattttattcttttgtggcatatatgacagtttaaattattggggtgattattggcttatgtgtttattatctctttctttcccactagattgtatactccatagaggccacactactttattcactactctatacccagggtctagtttagtgcctgacacacagtcaacacttaataagtatttgtcagatgtataagacaaacatgagttcaaaaatatgagcagtaaatttagagcagtagctttcaatcaagagactataaaagtaggcagttaacagctacccctaaaaagtgttttcatttgaactctgtggaagccttgatgatgtagaaaatcttttattgtaaattctgttcaatcaaaggcaaggcagaaaaacttcaaaagcaattctaggtaggatgaaggtatagtacctagaaaaagcaatggaatcacaacaacagcaaccactttcaattagaagttttgagtttgaattaaagcttactaggtatgtgtcctaggtaaacttacataaccatctctaatattcagattaatcatatttaaaatgagggggattttatataatataaaatttttatattatataaaattttatgtttttatgatgacttaatgagattatatgtatacaagtagctattagcattatctatggcatttaggagaaggggctcactattgattagttcctttaccttggccagccagcgtctgcaacaagattgagctaaaacttcatcaagtaaccaggataatacattttaggtaggaaaacatagatgaaataagggcttaaatgcagagaaaagtaagttggtgttagggttaatacataaaaaaaaatgtgtaagacagagtagcgagaatttcacagcagttagaaatggaaaaagatttcaacatgatacaaaaactgccaagaaatctattagcttttcccttaggtgacgcagtcttcccctcatataaataaaataattgctactattatagttggagaaaaatcaactgaaatgtacattaaacacgtattagagatttaacattcttcacatcatttcacatgctgaaaactcaacctttgtaaatatagccatgaaccttattatttactataataaagtaacagcatatccttttctatgtactacttgcagaagtataaaaggcaaatgtgttcttgctctttaggtgcaattacaaggcagcagaatgtagttaggctaattttttgcattttgtgctcatcagacagtggctaccaaccctgcaagaaaaaactggtaccaaaaatacttcatcggaaattctattttcatacttagttgctttcagtattcttactaatttggtcaaacttatgtcagctccctcattaaaattgttttctgtctaaatcgttatcttttctgtgtacgtatatgtgtgtatgtgtattatttggtcaatattcagacagaacaagtctgagatgcaccgcataacaaaagtaatcaccccatccccatacttctcagggaatatctacctggtaccaataagctcatcaagagttcatctgaattcatagcctttgtcaatcagaggtgataaactgtgattttagtagtctatgttccctgcaagaccatcgtcttcatgagggctagaatctggtttattttctttcttttttgtcatcaccacctagttcaggacaaagcacacaatatacaaccattggatatttcattcatttattctaaaatgtttattgagtacttactatgtgacaggcattgttccaagtggtggtgatttaggagtgaacaaaatagatggaaatttctgatctcatggagattatatatatttgttgtggatgtctgataataaatatatagaatgacagacaattatctgcgctaaggaattaaaataaagcagggaaagggaaaagtaaatgatgggattgggagttggggttgaaattttagatagggggaccagcaaagaaattatggaaagatcacattcaagtgaagacccaaaagaaatgaaggagggagttagccagaaatgccttggagaaaaggcaaaggaataggaaagagtttcctttaaaatgccaggctatattcagatagaaatgtttctattaaaatataaaggtatacgaaaggcattcaagccaaagaaataggaaagacttttctttaaaatgtcaggctatattcacacagaaatgtttctattaaaatataaaggtcctatagaaacatttctgtacgaatatataaacatcaaatacataaaagttttaaaatgtttcataagaaaggaacttagaaatcaagaagatagagctagggtatttggcattactatgattctaccacaaccctcccaggggaattatccagctcagtaataacctgagaaatttaggggtacaaataaagtttgcaataactgtaatcactgagaatggcaacctcctaatagatctggaatacctagaagaaacaaatccacttttgcaggataccttcaacaactcaggtcatgtgggagtctcacagaaaaagcaaacaccaatgaaaaagagctcatatatcaaaaatatcaaatccgaagaaaggttcatccataaatgagtcagcagatgaaaaactttaaatgaaatgtacgcattaagttcaaaatagggcacaatcttagggaactaatctgagggccaaaataaaaaaagaaagaaactatgaaaaaggcagatttgataaatatacagagatttatagaaataaaattgtcattaaaattaatatctgaagtgagaatttatcatattaaatggagctaaagggaggattactgaactgaaaaataattccaaggaatttacctaccataaaacagagatagaagatattttttaaaaagattaggagatataaatgacaaaataaaaaactctaacatatctaataagtatttaagaatgaaaaaaaataaagacaaaaatgcaatatctgaaatgatgatgaatcttttccaaaactgataaaacctcagaaaactgtaaaacagcatcaggtaggtccttcagggaatatttcagaaaaaggaatttttatcacaggagatgacagctccatgcatgttattacgccagaagaccttccagtgggacaagatgtagaggtggaggacagtgatatggatgatcccgaccctgtgtagacctggctaatgtgtgcatttttgttagtttttagcaaagtttaaaaagttaaaaaaaattaaatggaaaaaatacagaataaagatgtaaagaaaaaatattttgtacagctatacaatttatgtgagctttaaactaagtgttattacaaaaaattcaaaaagttaaaaaatatgtttataaagtaaaacacttaacagtaagctagggttaatttattattgaagaaatatgaaacttttataaatttagtgtagcctaagtgtacagtgtttataaagtctacagtagcatacagtaatgtcctaggccttcacattcattaaccactcactcactaactttctcagagcaacttccagtcttgcaagctccattcacggtattaattataacttataagcaaaagactataccatacagcatacgtgtacaataggccataccatctacgtttatctaagtacactctatgatgctcacacaatgatgaaatcacctaacaatgcatttctcagaatgtatccctgtcattacgagatgcatgactatatatcaaaactcatgcaatgcagctaaacagtcttagggagcaaagtacaactttaagttaatatgctaaaaagaaaagacaagactaaaattatcaagacattagaaaagttacaaaaaagtaaaaccaaaaaatgtaaaagctgaaacgtaacaataatactgagcataagggaaatgaaaaacaaaaatgtaaagacagtcaacaaaattaagtgttgctttttttaaatgactaataaagtagaaaaatctctgggaatttttattataaaaaagaagatagaaataaaattaaaaagaaaaaacaaatctatttggacatttaagtgattactgaatactatgaaatactttatgctaatttgacttaaatgttcaagttattttacaagtgaaataatatgaacaattttgtagaaaaatataacttgcctaagaagaactagaaactctgattcgacaattataaagatatcacatatgtggttagaaatttatataaacatacacacacacatgcacgcgtgcacacacacacacacacacacacacattaccaggcccaaatatatttaaatataaaatttaataaacctttaaaaatctgttgaggtctatgtgataaaaattggaccatagaaaacaggaaagcacctcaactcttgtataaggcccttgaacactgatatcaaacccagataaaggtattatgagaaagaaaaattatttacaatggtgaggatttagaagaggtacaagctagccaaaagacactcagaaaaagaaaagtaacaatagctattatttatttagctactactaagtgtttgataagagttttgcatatattatttaatctgtatatcagccatataagtggttttattttcattattatcacaattgtataaataaaatgatgctcaaaaaaaataaatgggctcaaagtcataaaattaataagtagcagcagttgatagagggagactctaaagaccatgtacttaaacactgccttgtactatttactcatctttcttaattatgttcacagaggacattatgctgtctccctaacacttcacccaattttaaataaagcataatttttggtttttagcagctttactatgatgttcccaagtgttgttttcttcacgtttattgtgtttagagttcactaagcttcatgtctttcacaaaatttgggaatttttaacctttcttcttaaagtctttaaatattttctctgtcctattcttgttcttcaataccctacatgagagaacaggaggtccctcagacatatacccccacagcaataaaaattttctagttatcccaaaaaaaaaagtgccctagttgaaactttggggctcaagtagggggttgtgaacactagtgacacccaagacctaagaaggccattttgagagggtagaatcaagcccacatgacagacttgccaatgatggtcccagcttcagacatggaaatagctccaacatcctgtatcaaaaacatcgacaaaggggcctggaagaagtcatgcacactaatgcctcaggtgacagtcatttgtcttggctgaggatcctaaaagggagctcccacttagctccagttcctcttggctgctctctcagagcagtcctgccagcacagggaaaaagaactcaaaataatgattttcaataagtccaatgagatgtagaaaacacaaataaaccacaaaatataattaggaaaataattcattaaaaaattagtttagtttaaatattatattccataaaaaaaggaccaaacagataccctatagctgaaaagtatgaagacagaagtgaaaaattcaatacagggcttcaacagcagactcaatcatacagaaaaagaattgatgaacatgatgacaggtaatttgaaattacccacctagaggaacaacaagaaaaagactgaaaaagcatgatgaaagtatgaggaacctatgggacaataccaagtgtacaaaaatatgaattaggaattcccagagaagacagacagagtaagaggacaaaaactaatataaagaaatactagcagaaaagttcccaaatcctgggaggcatatggacattcagattcaagcagcataaaggcttccaagagagatcccaaacaggaatgctctaagacatattataaccaaattgtcaaaagtgaaagacaaagagagatcttgaaagtagtgaaagaaaagagccttgttccatataagtgaacatccaaaagacaatcagtagatttctcaagaaaaaccttgtaaaccaggagggaatggaataatagattcaaagtgctaaaagaaaaaaaaaaaaaaacctgccaaataaaacagtatatccacaaaagctgtccttcaaaaatgaaggagggataataacataaccagacaaaggaaaactgagggaggtcatcacaagacttagaagaaatgctaaagaaagctcttggagtggaaataaaaggatactagatgataaaataaaattatatgaaagaataaaacttactggtaaaaataaacatatagtcaaaatcagaatactctaatactgaaatggtaatacgcacatcactttttaatagggttatttgtctccttattatttgttattaggtatacttttaaactttttattttaatatttttggaacacagtaagtatatatatttatggggtacatgagatattttgatataggcacataatgcctaataatcacataaaggcaaatggagtatc

SEQ ID NO: 34 - DNA, 11952 bp, Homo sapiens
tgtttggtagacaaaatcctactggacaaccatccattggcgtgggaaagagttgtgaaaagagatcttggagaagttaaaagaaaagagccgggtgcgggggtgctctcagagggctgaagctggggatcccttgagcccaggagtcggaattcagcctgggcaacacagtcagaagttgtctcttacaaaactttttcttcttttttaaagcaggcaggcttaaaaagagagagagaaaagatcttgaagtttgggaattctgaggtcagtctttctctgtctgggtcttctttctgtctccccacctgacttttctctccacatggacggagcctctccttcagccatcccactatcttctagaaggttccataactcctccctgtccccatcattccttattctgaaaatcctttggtaaatgggtttattcatttgccaggtgcaaataattgtcagtggctacttgaagtttgataaggaggattcggaggcctgtcccagccaagggggaaatgctgcctggtgatcaaatactgatgcctgctacaggtgtcagaagagggaggaggagcagaggcatctgtgctgtgtgtttaccccctggaatttagcaagtcccgagccgcgttcatttggcacctggtgtcatgttccaaggggcagtgccttgttgcttctgctggaattaagccctttagaagcccagcagtgcccacagctgcaggaagtgctcagccaacgtttgcctgtcattcagcaaataatggctatgaaacaatgaaagtaagacgtgaatagcgcctggaaacaggctgtgtgtggggagcgtgtgagcgtgaccctcattttggtgcaaatgcatagaccggttcacataagaggggtctgactactgtggtagcagcagagatgtttccccctccgggccttagctcctgcccttctctttgcttggaatattccgtcctcccgccgtacccacagaggtcccttcttgcctctcctgactcctctagctacaagaggccccactctccaggccccatcctgctcacttttctttcttttctttctttttttttttttttttttttttttgaggctgagtctcgccctgtcacccaggctggagtgcagtggcacaacctctgctcagtgcaacctcctcccagattcaagcgattttcctgcctcagcctccagagtagctgggattacaggccaccacacccgccaccacgcccggctaactttttgtatttttagtcgagatggggttttaccatgttggccaggctggtctcgaactcctgacctcaggtgatccactcgcctcagcctcccaaagtgttgggattacaggcgtgagccaccacgcccagcctcacttttcttcttagtgtcactcactgtcctagtctccttgggctgctgcaataaagctccacaaactgggtggctacagtggaaatttattctctctccattctggaggcagaagtctgaaatcaaggtgtgaggggggctgtgctccctccatgatgggtgtggggagattcctcctgcctcttccagcttctcatggacccaggtggtttgcagcctgtgatcaaatccctgccttcatcttcaggtggccttctcttctgtctcttatcaggccactggtcactggatttagggcccactcagttaattcaggatgatttcatcttgagatccttagttatatctataaagatgtttttccaaataaggtcacattcacagcttccaggagtaaggacatgaacatatcttttgcaggggacattattcaacccacgacatgcactgcctcactttgcattacacatggctttgtccgcggcctgtctccaccattagatgagatataggaaagcagggaaagagtctgttgtgttcccagctcgatcgccagtgccacatggcaggtgctgaaaagtatttcttaagtgaacgaaatagttttatctttccaagtcccagtgttcccgtctataaaatgattactgcctgtgggtacagctattgcaaaacaaacagaatcgagggtttatgcaaggaaccgtaacttccacctaattcttaacattagaaacaaattgtacaaaatatacttttgtacagtgtaccctttccaaaaaggatgtcttcagtgccacgcttagagaacttttgagtgaagtttgttaccaaacaaaatacaggtgtcttgaggttgcatcctggctcccagcagggcgcattgctggggataatttgtgggcagtgaaaagacacgactctgacatagagagtgaatgggagttgcagagcatgacctcattgttcaaggtgcccagagcagacattttgagaaaggctggatgcctctggttgggtcccacccttggcgttcatcgttggccaatagggcagaatcactctgaggcgttgagccgcaaaccccagaaagttctccagccaactgccttgttagattctttgcaagtgggctctagcattttacaggctgaaggcagaaaaaataaacaaaaaacttgaaaaaacagaatcttgaagtctgtggggatgaccacggaatccaaacaaagtgacagacagagctcagaaaggtcgtttaaggcaaacataaatagcaggtgtaactgacggggaaacaacaacacacaacaacaacaacaacaaccaactcagaaggtaagagcttgggccgggcacggtggctcaaacctgtaatcccagcactttgggaggctgaggcaggccgatagatcacttgaggtcagaagttcaagaccagcctggtcaacatggcaaaaccctgtctctactaaaaaaaaaaaaaaaaaaaaaaaaaattagctaggcatggtggcgcatgcctgtagtcccagctaatctggaggctgaggcacgagaatcgcttgaacccagaaggtggaggttgcagcaagccgagatggtgccactgtactccagcctgggcaatagagcaagactctgtctcaaaaaaaaaaaaaaaaaaaaaagagagagtttggataattaacttacttagaatataaaaggatgcagaggttagaaaaacaaaaattaaagttggaaaatttctttaaatctggaaaaggaaaccaaaagagactgtaaatactcatctgtatttctgaagtgttttcaggtagctcccaatagaactttcaatgagatgtttattccaaaaccaaagtaaaaattgacagcaaattgagtgcttgcctcaaaaggcacagaaatgaaacatgaaagaggatgacagaagtcaatctaacaatgacaactataacaatgtaaacacaatacatttccctatttttttttttttttttttttgagacggagtctcgctgtgttccccgggctggagtgcagtggcgcgatctcggctcactgcaagctccgcctcccgggttcacgccattctcctgcctcagcctcccgagtagctgggactacaggcgcccgccaccacgcctggctaattttttgtatttttaatagagacgaggtttcaccgtgtttgccaggatggtgtcaatctcctgacctcatgatccgcctgcctcagcctcccaaagtgctgggattacaggcatgagccactgcgcccggcctacatttccctattataaagcaaatcgttcatatgaaagttctgttaaatataaatttgaatgatctgctgtttatgggagacatattcaaaaattttttggagtatttgccatgtttcaggcacatcatttaccataaccaacactggtggagcctaatttacctaattttacacaccacaaatctaatttataggcctgggcaacagagcaaagaccccatctctacataaaaataaaaattagaaaattagctgggtgtggttctgtgcacctgtagtcccagctactcaggagggagtattgcttgaacccaggagttcaagcctacagtgaactatgatcgcgccagtgccctccagcctggactacagagtgagaccttgtctctaaaatgtacatgcatatatccaccacctagagtttccttctggaatgccctgggcattttcgaacctagcccaggaattccagccttgacatctctgggctggagcggaagccatggtgataggatccgaaaggctgggctttcaaatcctctgctccggggatgctgatctgcctggagagatgacatctggttaacagcttggaaaaacatgaagatgccaacaaggcgttcttcttccctggatccaacatcattttaaaatcacagaatgccacttgggaaggacctgagaaataactgagccaagttcccatatgttcttttatattaataatatagaagcgcctgagagcctgcaatgtcgggtaccacgacatcgtactactacatcatacctgtgcaagcattcactcagcctgaaccacaggatgctgaggttggctgcgggatgtctcctccttgttcctctacaacactcttttttttttgtttgtttgacatgaagtcttgctctactgcccaggctggagtgcagtggcacaatcttggctccctgcaacctccaccttccgggttcaagcgattctcctgcctcagcctccgaagtagctgggattacaggcgcatgccagcacacctggctaatttttctatttttactagtgacagggtttccccatgttggccaggctggactcgaactcctgacctcaggtgatccgcccaccttggcctctcaaagtgctgggattagaggtgtgagccaccttgcccagcctcctctacaccactctccacccttctttggattctctgcccaggaggctgcatccttggcgctctgttgctttctggcttttgatctaagcagttgccctctgcagaagttatcagtgccccagagctccccctccaggtaactcctctctcgtctggcccttcaggccttgggtgggaccaaagccacttctcactctttgctagtcttcgttaatgacacaagcacttctggtttctctacgtcttccccacagctttgtaaaaagtctgtttctcaaactctcctcaaattactatttcctactgggaccctgactcctacgggtaggtagtgacatccccattttatggatgagtaaactgaggtggagagaggtgaagaaaattgcccaaggtcggaaaggaacattcctgggattcaaatctggactcactcacatcagaggtttgctgttaccattattcctgcacctttgttgaaactggggagtggggccaggctgataccgtagcctttgtttccttgaaagaggaagatgcaggagatacaagaaggggcactggaactgccctgcaggttttcgtggcctggagtcaaccctcgggagcaattgaggtaggtggcaaatatttgctcaaaaggggtggctgaatttcgtggacaaatgcagagggcacctcctgtagcccgtgagtaacttccctgtagagatgaggaagccagcggaaaggcgggtggcacggacttccccagagctccccctctgctaagtggtgggtctagttacggatctagtcctacctgaagccaaagaaagccctggaacttcaaagcacccacttggctgctggcaactgtctacactgcgtatggactcacatactttgggagccatttgagcccagcaccttctgatgatgaagaggaggaggatggtgtcatggggacaccagcacattctctactccaagccctgctcgagaccttcctgtacagcactgtccgctggggcctctccatgtcactgtgaaggaggcgctatcgtggtggccattctgcagagcagtaaaccaaggcgctaaaaatataagaaacctgctcaggtcccacgacgagcaagagcggcgctcatcctgcagacgaggacaggggccctgaccatccgagaccatgcaggcgccaaaggcagcagggctctcagtcgctcctgttcctggactcactcccagggccctggaggtgggggtcttagccttctgctgctccccgctcaatgacaggctaggttgccgaggctcagaaaggccacgtgacccgtccagagtgcacagccgcaggtgtgagtctgactgagctccagccacctcgctcccggcgccttagagccgcccaccctgggttcctcaagaggatcacctggggctcgttaaaaacccagctcccggcggctccaaaccgtgactgggcagggaggggtctgggaatccggattttaaaccagcatttgctcctccacctcccccactccaggtgattcttaggatctgtaagtttgggaaacagcccaagccctgaggcgacgcagcctctccctgggcctttcatggccagccggcgctgtccccagagcccctggggtcccaggcgagctcgcggggcggggccgggtgagccggcacctccctgtgcgcagccccgccccaggggcggggcctcacctgccgcgggcaggtagacagctacctggtaaccgggtccggcccaggaggcttgggcgcgcgcagccatcccgggcctcgccggggacctagggacgcaggcaacgcctgcgcccgctcaccatggtcgagggacgcgtctccgagttcctgaagaaactcggcttctcgggcgggggccgccagtaccaggcgctggagaaggacgaagaggaagccttggtgagtccccgcgactccgcgccgggcgtgcgacccgaccccccatcccctccgtcgtaaccgtccccggcccgagaccccgcgttcgcgctgcgatccgcgaactcgccctcctcccctggctctggaaagaagctgtcctcacagcaaccgcgctctcatctgcgctctggcgcggggagctcagcatggaaccctcacgtgaacccattttgtggttgagaaactgaggccgagagtggttaagtatattccctaaggggcacggagctaggaagtgacctggctgggaacttaacctaggtttctctgactccagagaattaaaattcctgggtctccagacttgggctgctttatggatttttaaaacttaaattggaaaataaaattagagggatgcaaaaaacaaaagattgctgaaatgttgtagcaataatagaaagcaaagttggagctgagggacctcccagcctcacttcctacagtcaggtacttttagaaagtcactcagagctgtatgcctgctttgcaaccttcagggaccctctgggataaagcagcagggtgccagggcagggcggttcatgagggaacgaagtggcaaagctgtcaaataaagcccctcctgttccttggattcttggaagccaggggtgaagccaggcttgagggtgacccaacacccttctttttagcttcgcaaacagaactcgttgcatgctttaaggtcaggggggcactgaatttctgcagaagcgtttctctgcacgccagagggtcgttgcacttttttttttttcatttacgcttaagcagtcgttcaaaagtaacatttctgaacgagtcccctgggttgctaattagaaatatgacttggcgatggccttttgaccagtgaaaggaaacttcaaaggtaaacttaccttttaattaaaaaaagaaattagctgaaaaaatatttgacttaaaattttatttttttctcccaaagaatactaatggtcaaaacattttgtttgtgagattaagtattcgtgcttttttaaaaatagtgttttgtgcttttttaaaaatagtgttttatacatccctgttgatgtaagaattctggtcttagggtggtaggccacaggaccacgtaactagcagtttttgagcaatctcgatttttctgaagtggcatgttaatattgataggatatagagttcaattaattggctgtgatccatttctctgcttctgcgatacattctgctaaaggagtttgaagtttatttgccatcacaggttgcctttcctatgttgccattcctgttttttcctttccatcttttgattcttgcatcaggccaggtatttttcaaactctcctggtgtgtagttggttaccatcaggtttcacaggatgtccaggaatgcaggtgcatggatgatgtaacctcaagggagatgctgggagagtttgatctctgtgccaggtggactcgtccctccaaagctttgcaggagagttctcagaggtctgacaggtgttcagccggtctgtcagtgtgctctcccacctggctgtggaccggggtgctctcagcagcatcctgaggccctgggtgcgtgatgatgggcagtgtgcagcgccaggaggcgggtgataccagcactgacaccaaaggccagctgagaaagaagccatgctgtctccagaggcagccttgtgcaaacccaggaaatgtgcaaacccaggaaatggcaatgaagatcgatgggaagtgtgaggagggagggaggtggggaggccgggtggctgggcgaggcactcacttcctgccaggttggctcagacctgaacacctcctttgctgtcatactcatgtcctctcgttggaactcctttctcccagggtttggaaaggaggcgatgtgtgttgaggtgatcacttctacaatagttggaattgtctttttttttttttgcgttatttcatactagtttatttaggggttccattttcactcctcaatagaaccgtcttttatgagcactaattacatgccacatccaggatgcctgtaggaggcctctaagccctcccctcccccagccactttgaccagttaccccagttctaatagtgattgttactgagaacttgctgtgtcttctcttgggcctcttacctccaaggtaaattttactctcgtcatgtgatcaatgaggatgtgaggctcctagtggggccacgtttgtttgctcagtgagcatttcctgacagccagttttgctaggcgctgaggatacagatgtgtacaaaacaaagttcataaaggaggccaatggtcagctgagaaactgggagatgctttatttgagacccagtggtctcaggtgcactggagaatcaaagagtagaggaccagacagaggactggtggttgagaggggaactggagacgaccccatgttagaagcactggagactggatttcagcatttccaggaatggaaagaaaggtgtttgagccgggcgcagtggctcatgcctgtcatccccacactttggaagactgaggcaggagggtcacttgaaccccagagttcaagatcagcctgggcaacatagccagatgccatctctgcaaaaaattaggcgtggtggtgtgcacctgtggtcctagctactcaccaagctgaagcaggaggattgcttgcacctgggaggtcaaggctgcagtgagttgtgatcatgccactgtgctccagcctgggcaacagagtgagaccctgtctcaaaacaaaacaacaacaaaaaggtctttgagaggcctccttaatttagttactagaaaaagcttctcactgctgacctgaacattagggtaaggaagagattggagcagaaattcctgcttcccaggtgactcagcgccaactccgggggaagctgtctctgcccctcagggctcccatctcttaagtgaggcaggtatagccccagcccactgccttcctggctggtgagcagatgcatccttctgggctctccagggtgaggcttggatcccaacagacgaatgtagtgaccacccatccattcaacctagattcacggagggggctccctctgtgtgtcaagtgagtgctaccagctggagttggggctgataaggatgcacagttctctaccctcaggtatcccaaccaggaggcagagacaggcacccagcaactggtcacagttcactgtttaatgccaacgtgtcagagctgggagaaagacgtgatgtttaagatgaataggagtggcaaagggtgagctggatgaagggcagggattgacagcgagttctagacagaagaggtagaggcgttggggttggtaggatgaggctgcagaggagggtcgtacggagccttgtcagagtgtgggctttatccctggagcagtgggggatcgttgaagggttttaagtcaggacatgatagtcactcatttattcccagatgggccaaacattagaactgtgataaaacaggcacagtcagatttgtgtttttaagagattacactcagttactggaaaagagtatgtgtgtgggaattctgaggctcatgcacacacaactttaacccaaggcttgcccaaactcacagatcattagtgtttctcagaattcagcaacatgtgggcatcttcttaaagaaatgtactgcaaccccacagtgttttttctttcgagacagtgtctcgccctgtcacccaggctggagtgcaatggcatggtcttggctcactgcaacctctgcctcccagattctcctgcctcagcttcccgagtagctgggattacaggcacccgccaccacacccagctaatttttgtacttttagtagagatgggggtttcaccatgttggccaggctggtctcgaactcctgacctcatgatccgcctgcctcagcctcccaaagtgctgggattacaggcgtgagccaccgcacctggccagtgttgtcttaaatgatttgtacaaaagtgtgatatcaagtaagtataagcataaaacttgtaataaacataactgtttgcttataactcaactataaaatcaggttcaatttaggcctgttgcggtgactcactcctgttttcccagcactttgggaggctgaggcgtgcagatcacttgagttcaggagttcaagaccaacctggccaatatggtgaaacccctctctactaaaaatacaaaaattagccaggcgaggtggcaggcacctgtaatcccagctactgcggaggctgaggcaggaaaatcctttgaacccaggaggcggaggttgcagagagctgagatcacgaaactgcactccagcctggaagacagagcgagactccctctcaaaaaaaaaaaaaaaagtcaaatttataataaaattataaagtacaaatagaacagccttattttgatatattggtgatgtctattaaaactcaatcaggctgggcatggtggcttacgcctgtaatcccagcactttggaaagccgaggcaggcggatcacctgaggttacgagttcgagaccagcctggccaacatggcaaaaccccatctctactaaaaatacaaaaattagctgggtgtggtggtgggtgcctgtaaccccggctactcagaaggctgaggcagaagaaacgcttgaatgcaggaggtggaagttgcagtgagccaagattgcgccactacactccagcctgggtgacagagcgagactccatctcaaaacaacaacaacaaaaaaagagactggaaaccaaagccttttttgaatctcattttgaaatgaggtctcataacttctgccatattctattcgtttgatgcaagtctaggtccagtctacactcaaagggaaggggttacacaggccatgggtactgggagggagtgatggctggggactgccttaaaggctgcccattggaatagtagaaagaaatatttccttcaatgacgtcattcacgttaaaaaaaatcctagaaccacatctgacatgtcatctgctcactacttatctagttttgttagtgttttcattcatcgtaagttctgttctttaaactcttttgaacttttgattttgaaaata

SEQ ID NO: 35 - DNA, 7277 bp, Homo sapiens
acaatttttctaggaattaaaatatataatctaattttcttaaagtaacaatgatgtaaagagatagtttttatgactttgtgtaaccttgcatatgactttattgatatcatcagtcatggcacattaaattatctggaaatatacccagtcaccttaagccttcttttatcatttctgcttttttactgctatattcagcctaacattttgggggatagaagaattaaggggaaaaaaaacttaaagcataaaactgatgattttgattaaaaatttcaagcattgattcttttcaaaaggagaaaaattcaaataaggtaacccttaaatagggtaatctttaaatacaattttcaagaaccatggagttgcagaccagaaagaaataatggatttgatattttcaaagaaatagatagtgcttttaagttcaaaaacctcaatgaagtcctattaaccagaagaatagtatagtaagaaaaatctaaattgggaagtagaaaatcttagcagactaataattagggagttctcacagaaggatcgatttattcacaggtaaagttttctaaaccttcaaggaaaagataacttccaaacatttccaaaatgaaagaaataactggaagctactctgttcgttctgatatagatatctttgaacgccatacctgataaaattaaacatactctcctcattccatagtatatacaataatgccccaagtaaccatgttttggtcaatgacaaaccatttataccactgtggtcccataagattataattgagctgaaaatttcctatcgtcatagcctttatgacactgtagcacaattccatttctttttataaattgagtgcagcctgaatgcattgtgtttacaaggtctacagcagtgtactgtaatgtcctaaccttcacattcacaccactcagtcacggactcagcagagcaactgccagtcctgcaagctccattcatgataagtgccctatctcggtgtgtcagttcttaaatcttttatactgtatttttactgcaccttttctatttatgtatgtttagatacacaaatactttaccattgtgtgtctgggattgtaagtagtaggctacaccacctaggagcaataggctatatatcctgtagtctgggtgtgtagtcggccctaccatctagggttgtatatagtagactacaccatctaggagtaataggctataccccataacctaggtgtgtagcacactacatcgtctagggttgtagtaggctataccatctaggaccctcaggctgtaccccatagcctagctgtgtagtaggctatgccatctagtccctgaattctatattgttgaaaacataacaaaatcacctaagaatgtggtttctcaaaatatatcctcattgttaagtataacacatgactgcgtgtcagattgttaatagcgagaagtaaaagctgtcttgttaccaaaagagtaatgtttgagactatcttactggtaatactgttttgcagtcttatccagtgtaacacaataaagaatagtaagatgcaacatttaaaaatgttgacctggggccagggacgtggtggctcatgcctgtaatcccagcactttgggaggccgaggcgggtggatcacctgaggtctagagttcaagaccagcctggccaacatggcaaaaccccatctctactaaaaatgcacaaattagtcaggcatggtgatgggtgcctgtaattccagccactcaggaagctgaggcagaagcattgcttgaactcaggaggcagaggttgcagtgagatgagatcgcaccactgcactccagcctgggcgacagatggagaaaaaaaaagaaaagaaaatgcagtgtgtaatggaggcacaagaaacggggcagtggaagaggggttaatgtggtatgtggaagagtcaggagcttttctttcaaacctgcttaaattatgacactcccctgtcctgtcccttggataagtttcttgataccattccatttcaccttgtttcttttcttttttttttttttaaacagagacagggaccttactctgttacccaggctggagtgcagtagcgtgatcatagctcattgtaaccttgaattcctgggctcaaacgattctcctccctcagcctcctgagtacctggactataggcacacaccaccacgcccagttaattttttaattttttgtagaagtggggtccatttcagttttcttattagtaaaatgaaatgctatcacttgacagaagtttttgtttaattacaaagaacccatgtcaatgtacagagcatagtatttggcaatcaaaagacactactcggtcctctcccattgtttatggtagtggataattgatgagaaaccttgatagaaaactaaacccacattttatagtaacataaaggcaataatggatgacgttaatccttctctgtccgccatcagaagatttgatacatctttgttgaggtattatatgatcgtcctctaaactttgaaataattaacagaaggtaagtcctgctgtgatggccatataaaagtttacttaaaccttttttttgtttgtttaaataaaaggcgatgtagatactggtagagcttgttgctcatgttacagaatatacagctttataaactttaatttctcaacaaataaattgactaagggtatagatggtttacagatgcggcgatgggaaagtgcgtagggaaacattcacgttctgtatcaagaatagcatttttctcattcgtagcttttatctgatttggcagggttgaagtgaagctggcattgtcatttttgcaactatcatggtaaactggcataatccctttggaaggcagttccctgataagtttttactgtacttaaagttgaagagatcttgttagagtcttgaggcttataaaataatcgctatctcagtgctttgggagtccaaggtggtacgattgtttgaggccagtagtttgaggctgcagtgagttatgattgcaccactgcactccatcctcggcgacagaacaagaacctatgaaaaaaaaaaagagcttataggtatatttcaggaaactgctgggctaggtttttcgggacaagtacttaaagaaggtcatgacagcgtttgataattgggcttgcatttgcattaggcactagtcattctctttttctttctttctttttttgagatggagtctcgctctgtcgcccaggctggagtgcagtggcatgatgtcggctcactgcaagctccgcctgccaggttcaagcaattctcctgtctcagcctcctgagtagctgggactacaggcacgcaccaccatgcctggctaattttttgtgtgtgtgtttagtagagatggggtttcaccatgttggtcaggatggtcttgatctcctgacttcgtgatccgctcacctcggcctcccaaagtgctgggattacaggcgtgagccaccccacccagcccgaaacagaaaagctttctaaagttgctgactcactaaatgtacccccgtggctttgcggtatgtttaagttgtataaaccaccccttcttgtcattttctatcctataattccttacctaatggattaagtggtgccagaactgaccctggagaatgcagatttttgatgcggaagtcacggaagttatgttatcttaagggaaggcctttgcttgttaccttttagtagtaggttacagttggtgatgccatggggctcattcctcacaaattgcaaaacttacatgtgctaataaaccttggccttcaaaagtagtaacctagatacaagtagttctccatgctctttctttgaaatttcctataaggactgctttccagcctggtgcatttccttggcactcaccgcattctgctcgctgagcccttttcccacccctgctctctccctggcttcccctcctgggcaactgctctcacttctcactgctgccactgtgctgcctttgcccggcggcccacctccggctgctcctgatgccccctcccagagccgccccttcagctgaaggtgataaagcatggctttccctttgtaatttgggaagataattttttttttttttttactgtttaaactgttaagggagttttttgccagtgatacatattataaaagacacttgtttgtctccaagtttttgtttttattttttcaagagaataaactggcttctgtccctacacagctgagcagtggttcctgattgtcctaaggaagcctttggccctaacctgtgtgcctcattggccacttttttactggcggcagcagcagcagcagcatcagtagttgagaacaccctaatctatcttttcctttctcttcttcacttctaactatagggaaaacgtccacagcgcacaaaggcagagttgcatcctaggtggatgtctgaccacctgtccatcaaacccgtcaagcaagaggtgagtgtgggtgagagtagcgaggaggagctttcctgatgaaagagacggatccttttcatgtacttccattcctgcctttttattttccttcattttttttcctaaaccccaaatgtttatttagcaatcttatgcttaagatacatttctagaaagagaaagaattagaagacgtgaggccacactctggttctgacaatctcctgggatggtaggcatgtccacatttaataagaatacgtactgcaataggtgcatgtataggagcagttcacaaatgcaaagatgggaggatgtagagctgggcaacggaaggagaatttgagtaggcagagccatatttgacctgaatcctgagatggctgggattgatggaaggggagcaaagagggtgggagaggtggggcagaaggcatcccacactacaggagtagtagaaacaaaagcacagagacaggaaattatataaatttatataaaatgatataaatatatatggtcaaaaaacagcatatattagagccaagcacaggtagctcatgcctgtaatccgagcactttaagaggccaaggcaggtggattgcttgtactcacgagttcaagaccagcctggccaacatggcaaaaccccatctctactaaaaatacaaaaattagctgggtgtggtggcgggcacctgtaatcccagctactcgggaggctgaagcaggagaattgcttgaacccaggaggcggaggttgcagtgagctacgatcgcaccactgcactccagcctgggcaacttcagagtttcactctgtctcagaaaaaaaaaaaaaaaagaaagaaagaaaagaaaacctgagagtttgtggcaagtttgttgttttgtttctaattggagatgtagcatggacctgaaaagggtccaggaatgagagagcgtggatctggctgatctgtggggagatgaaattcttaggtgtcaagacctcgccatggagggtagataatcacatttcttctaagacacaaagcaaaacaacataaatgggagggcagggaaatgtttaggtcacatgaaagagagagggcatcatgtgggagtttgagatataatgttaggtgaagaaagaatatttggtgcaaccactaattaaaagagttgtccaaggagcattctggagctgactgtgtttcggcattttcattctgtaatgtagctcaggagcctgaagcaggagatttacttgagcctaggagtttgagaccagcctgggcaacatagcaagaccccacctctgaaaaaaaatagttaaattactttatcacatcacatcacactgtaggaagggacaacactttttaaccgtttatcctttgggcactctttcatcgaatatttaaacagttcagtgatcgtagagagttttgagttaagggacagtagttttactctggaccatgtctttgaattgttacgttacggagccttccttttgcctttcagtaacattttcatggatcttaaatttgagtgacgacacgatgttctattacagagatcttgtcagtaactaaacacattctaccttgagccctgaaaagggaaagctaatttataaatttgtatttacttcagtatattttgatttcacatctgtctctttttaactcagagatgtgtcttgcccgatgtttaattacctgggggttgacaattctattcatgattgacctcccttctccagtatcctcttcctcctagcagtcactaatttcagagtggcctttggtccctggtattcagccatgttctcaaatggttttctagcctggccttgttgggctctctctgctgtctttattaccttgacagttcacacctccttgcaagctcccttttctgtttactgttcactgctctgagtattcctagatgccataacttaacacttcagactgcatagcaggctgaatagactgaaacgtccttcattgctccaagcaaaactttggcatcaaacactaaaatttctttttattcttggcagtgtttgagctttcttttattctactcttcagttcgaacaaaaagaaaccacagtattacagagactgtaaactatctgttgtggtccccgatatcctggagaaacccttagtggtgacatgactttttaagcatggaggcagggtttctggcctctattggtcactcagcagtccaaacttattgcctgataaaagactttgagttgtgacttcttggggaaaatatcagtgaggggagactgtctcgctgaactcagggattcgggatgcagtggttatttttgtccggacactttggtcattgctgttgctagggagctgtttgttgggtgttcgtctcaaatgtgctgctaacgggagcaagggtgccagcaagtctgatacctgccctcagagaggggagcgtgtaagggcacagcatgttgggcattgcttaaaccaggggttctgttgaatcgtccttgactggattttaaagtgttgtttctcattagcttctcattaaaaacccccttgattctagcaggactcttatctgtaaagcattcctacaccaacatctctaccatttgcaactgaccccaccttttaaagaaaaaaattgcagcctaagacagtatcacatttttgtaactgtgcaggtttatttttgcttggccagttgtcattcatttggttgtactggttctttaatagttaaaacactacaaaaa

SEQ ID NO: 36 - DNA, 13775 bp, Homo sapiens
tctttcctcatttgcctcccagacactgaaaaatgttctctaattcatatccacatggagaagaaaattctacatacttggaacaaaagcatgttccatggtagcgcatgcaaatgagatacttgtggggttttttaagtcaattctcctgtcttatcctgtttccatagctctcctctggtatatttagacactcttcttctatcctctcaaccaaagaaagaactttataaagcacaaatctagtgacatccagaggaagtcttctacatggtgctatttttattttattgattttattttgcaaactagtttgtcttcctcctttgtacttccagacagtaatcaaaaccctataaactataaatatattgttaacattgactcactggaactatgtgagaaagtacttactgctccagtccctcagatcctgctccatcatatcaaggttaggaaaacgtggaaagcaccttagagacaatgaaaattaaactgaccttttttttttttttttttttgagatggagtcttgctctgtcacccaggctggagcgcagtggcatgatctcggctcagtgcaacctccgcttcctgggttcaagtaattctgcttcagcctcccgagtagctgggattaaaggcgccggccaccatgcccagctaatttttgtatttttcgtagagacgagggtttcatcatgttggccaggctggcctcgaactcctgacttcagattatccacccgccttggcctcccagagtgctgggattacaggcgtgagccactgtgctgggcgaaactgaccttttttgaaatgacacaagggttggccgttttgcctagatgttacaatagaaataatcactatgacaacaaatgccaaatttactcaatccgtatttcctgagagcctgctctgcactgtgtaagtgatgcagggcagatgaaccccaaaactggggcttagtctggcttcaccgaggaaagaactcaaggacagcggcagcagagatactgctccctacagaccatggctacccaccagcagtgcgcccaggctagggctgcaggcatatttatacccacctttaattatatgcaaattaagaggcagtttatgcagaaatgtctaggtgggtggtaacttccaggtcattgccatggaaaggggtggtaacttccgggtattgccatggcgatggtaaactgacatggtgccgtggtggccctgtcttatggaaagccgcctctgcccgaccctgtttagctagttctcaatctggtccggtacccgagtccccgcctccagagtcagtttcaccttctgcctcataaggccctgagctgggcgctgttgcatataaaaataaggcaatgagaggactaaatgacccggcttcactgtagctgagacagtttgttctcctctccccatgacaatcctgaggaaaataaaactgctggaatatctgcccaggccaacatcttaaagtagcagtgtctttccaacagctgatgtctgttttagatcaacaaaaagttcagcaaacatgaaggtcttattggatagacccctggagctgatttcccaggaaaaataagaagcagactggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaaaaaaaaaaagccgacctgttgtggaaaggtcaggctagtactagaggtctgggtgatctccccaaaagtctaccatccgcaacctggaatggcacttacaagttcatgaattcatctcagatctttactcatgatctgattttccttccttttctacaaccttactctgaccttagcaaaggaggccaagtttggacttcttactcaagtggaccctggtaagaattgcgtaggggtcaaaaggcctactgtataaacttgggcaagtcacttcacctctctgaccctcagtctcttcatctattaaatagagctgatgcctagctcacagtgttgtctggggggttacatgagataatgtatgtgaatgtgactagctcaataaatgtcactttctgttgccacctttgagctttctcatccttttttttttttttttttttttttgaggcagagtctcactctgtcgcccaggctggagtatggagtacagtggcacaatctcggctcaccacaacctccgcctcccggattcaagtgattctcccacctcatcctcctgagtagctgtgattacaggcatgtgccaccatgcctggctaatttttgtatttttagtaaagacagtttcgccatgttggctaggctggtctggaactcctgacctcatgtgatcgcctacctgggcctccaaaagtgctaggattataggggtgagccaccacgcctggccttcatccttaataacaaatgacatttcttggccttaacaactcatgaatttaacaggaatatgaaacatataatatgtcatgttggtgcctttaagattaatatgaatcaacaagaatttggctttaagaatttcacatctaagatgactagagatcccagggatgtcccagagactgcaaatcaagacaacagcaaaggatatttgttccttattatcttttggtcctattagcattgaagtaagaataatttggggacttggccgagcatggtggctcacacctgtaatcccagcactttgggaggctgaggcaggcagatcacgaggtcaggagattgagaccatcctagctaacacagtgaaaccccatttctactaaaaatacaaaaaattagccgggcatggtggcaggtgcctgtagtcccagctactcgggaggctgaggcaggagaatggcgtgaacctgggaggcagagcttgcagtgagccgagatggcgccactgcgctccagcctgggtgacagagcaagactctgtctcaaaaaaaaaaaaaaaaaaaaaaaaaaaagaataattcggggactttttttatagtttttttaaaaagccttacaatttaggtttaaataaaatttggctctgggttgtggtttagctagacatttatgagtgatcgttcaggtaatacatctaagaaaagacaattttaagggattatatatatttgatatggatttgaaattgcaattttctgaatgaggaagcctagagttggagtgtttttccatttttttcttagtcatagattaactttgatatttggctctgacatatcctgtgcgatcctgtttcctgcaaaaacacagctctcaagtcgggaactgctgtgatgtggagctggtgtttgacgacggctttgagcatctcagctagaacacactatgcaaacatggaatattatttctcatctcttaccctaagaagggagagacaggagcttaatccccagatgccaccagggtttcagagagaacaaagaagtgaccagaaaacctcgcagccccttagagaacgagatagaggtttgggctctggctgctcagctgggcactgctgactctgccacttgcaaatgtcctgtggcttgtgccattctaaacccacagaggtcctggtctacagggcacagccagctctgtggtgaacacacatcctggcaggaattgggtgggctgggcatggtggctcctgcctgtaatcccaacactttgggaggccaaagcaggaggatcatttgaggctaggagtttgaaaccagcccgatcaacatagggagtcccctgtctgtacaaaaaataagaaaaattagccaggcatggtggtgcatacctgtagtcatagctactagggaggctgaggttggaagatggtttgagcccaggaggttgaaactgcaatgagctatgatcacaccacggcactccagcctgggcgacagagtgagaccctgtctaaaaacaacagaaaagaaactggatgagccctctgatgggaatctcagggagaacgctctgtgattccctgtctgatagcagaaggacactaaggttgtgaagaatgctctctcacccttgcaaagcaatgcagcagctggagatcagtgactcgtccaagttgtacagctagtaaagcacagtcctagtgtggagctcagggcttgtgagtggagtccagtgtgctttctcttttgaggccaccagtgttagcagtattgaccacaagtcccacctagcctctttttctttactggttaggagcaactgagtctgctctagatccctttaaaatcctcctcaaggatctgaaggcagcccgcattcatgatctccttccttcctgccccagcacctttccacaggcagttccatctttggccagccttccttccccacgcaaccctgccccactcagaagccttcttttttttttttttttttttttttttttttttttgagatggagtcttgctctgtcaccaggctggagtgcagcggcacgatctcggctccgcctcccaggttcaagagattctcctgcctcagcctcctgagtagctgggactacaggcgtgtgccaccatgcccagctaatttttgtatttttagtagagacggggtttcaccatgttggccaggatggtctcgatctcttgacctcgtgatctgcccgccttggcctcccaaagtgctggaattacaggcatgagccaccgcgcccagccctcagactgcttcttaccctgcatgtttagtctaaatgtcgtctccatggaaatgccttccctgtctactccactgttctgtatcccatacccaaactgtctcctttacagcaactgtcaggaggtgtgggtatttgttagtttactggtttatcatctgagtcagccccaggataagaggttgaggcagctgtgctcagtgctagtacatgccttgcatatttgatgaatgaatgaactctttgaaaacagtgagccccataaaccactatctctgttttatctctggtcacagctgttaatcctgctgttgaaggtcaggtaagcaacacaaatctttctgacttaaaaatacctccccctgaggcttgccctagttctcttagaacaatttataaagctggtatttgtttgctgcagttttgcaatttgcaacaagacagaagtgctagaattttagtcatcccccatcctcctttgcaggatagaactgggtgtaggtaaagaccttcggtgcctgtagaaggaaggaaactggatccaagaagcaggtgatttcatttccatcaatctttaggttccagatggaggagctgtgcatttgggctcattagctgtgctcactaaagatggacctggagcatgacagcacagccctagctggtctgcccaagtctgtgcctgtccccagtgctcttagctatgtgcttgcagcgtgctgcagctgcatagccacccaggttcttcccaggatcagctgagaacattttagttgcaagtgacagaaaacctcacataaactaacactagcaaaaagagaacttattagctttcacaatcggaaaagtccagggacagggctggctttacctgcagcttcatgctgggcccctgctatattcccaggacctggttcctctctgggagtctctgggcttcctgtcctctgtgttgattccattctcatccataccctcccccggaagcaggatgtctacatcaactccagactcaaaatgcttcctataagccaggcgcagtggctcacacctgtaatctcagcactttgggagactgaggcaggtggatcacttgacctcaggagctgcagaccagcctgggcaatgtggcaaaactctgtctctacaaaaaatacaataattagctgggcatggtggtgcactcctgtagtcccagatacttgggaggctgaggtgggaggatcacttgagcctgggaggcagagatgcagtgagccgagatcacactactgcaccccagcctggacaaaagagcgagactctgtctcaaacaaaacaaaacaaaacaaaacaaaacaaaacaaaacatttcctgtgtgcaagttcatcagggtaagagtgtcccacctcttttccagtggtctcagaagccctgtggtgtcttgccaactctgatttggttgcctgttgtccctgaaaatcacagtgggcaggtctgagaggcaggcctggagcagaaggatgcatcagctcccccaaaagctgatggactgagagtggagtgaggttgttccacaaaaggaaactggggttctgttaccaagagaaaggcaggtgaattcaaggcaacagacatagcacgtgtcctttttatctcctaatctgatttcctcctctttacataaagatctcttggtggccaggcgtggtggctcacgcctgtaatcctagcactttgggaagccgaggcgggtggatcacttgaggtcaggaattcgagaccagcctgaccgacatggcaaaaccccatctgtactaaaaatacaaaaattagccaggcttggtggcacatcccatctaccggagaggctggggcaggagaatggcttgaacccaggaagcggaggttgcagtgagcagagatcgcgccactgcactccagcctgggcgacagagtgagactccattaaaaagaaaaaaaagaaaagaaaaaaaaaagatctcttggtgtgcccctccttcccgtggccttgccgaagcagaggatgaccaaaggcctgtgtccctgtggcgcattcctcatctcataattctcccattgttcatcacggcacttggacacagtacagtatgattttttgtataattcccccgacttttattcatgtatttacttatttattttgaaacagggccttgctctgtctccaaggctggaatgcagtggtgcaatcacaggtgcctgcagccttgaacacccaggctcaagtgatcctcccacttcagcctccaaagtagttgggaccacagacacacaactacacccagctaatttttgttgttgtttaatttttgaagagatggggtttccctgtgttgcccaggctggtctcaaactcttgggctgaagcgacccacctgcctcagccttccagagtgcagggggttacagatgtgagccaccttgcccagctccctcttgggggagggatggctttaacagatattttactgttacttatatattttactatttagatatttactcatttattttactgtttagatatttactaacatattgtaagtaataggatatcctattacttagatatttactaaaatatcgtaataagatatcctattacttagatatttactaaaatatcgtaataggatatcctattacttagatatttactaaaatatcgaataggatatcctattacttagatatttactaaaatatcgtaagtaataggatacctattacctagatatttactaaaatatagcaataagatatcgtattacttagatattttactattgcttatattttattattacttttaacagatatttcactgtattttactgtttgccttttaacaggtgttttgctattaaggccaaacagtttttctgttctatcattgttttttttgttttctctctttgatggagaggagatgaaatgagctgctgtttagcctgagtacaccattgtgctttatatctatcagcaccagaaatacccctgagagctgaaccgtagaaagctttctagaaacaaatgaacttatgaagcattttaagctacaggttttcccactgcagtgcatcatggggagaggtaaaagcgtggaggatctggcttcaggcagaccttagcttaaagcccattaaggccaccaggctgcacatctcctgggggcccccttcacagcagactcagtgtgcagggcacctctggagtagtggctgcatggatgacccagccatgtgcagcagccttgaatcccgtttccctcactgactagctgtgtggccttggacaggtatttgaactctctaagcgctggttgcctcatctaatacagcattaataaatatttattatattttagtccggttgtggtggctcacgcctgtaatcccaacactttgggaggctaaggcaggtggattacctgaagtcaggagttcaagaccagcctggccaaaacggtgaaaccccgtctctattaaaaatacaaaaattagctgggcgtgatggtggatgcctgtaataccagctactaaggaggctgaggcaggagaatcgcttgaaccctggaggcagaggttgcagtgagccaagattgcgccactgtactccagcctgggcaacaagagcgaaactccatctcaaaaaaaaagaaaaagaaaagaaacctaggctgggcgcagtggctcatgcctgtaatcccagcacattgggaggctgaggcgggcagatcacctggtcaggagttcgagaccagcctgaccaacatgacaaaaccccaaacaaacctcaggaaactagtaatagaaggaatcctccttaatctaataaaggatatttacaaaaacccccaacacctaacataaacacttaatggtgaacaactaaatgctttcccccaaagttcaagaacaaggcaaggatatcctacttaacataatactactcagtaattttttttttggaacatagactcacagcagagacaagtgaacatttatttttgtgcctttcttcctatgtgtatttcaagtctttttcaaacaaaggccccaggaatctccagattcaattatgtccctggggttggtcgactgctacaggagtcttagggagccttggacaaatgctagagttactcatttaccaccattaaactctaggatagaagatgcagcaaagcaggactccttcctccatggaatgtgctgatttcagacgaggcggcagccaatgtagaaaacgctggaattggccgggcgcggtggctcacgcctgtaatcccagtactttgggaggccgaggcgggcggatcacctgaggtcaggaggtcgagaccatcctggccaacacggtgaaaccccatctctactaaaaatacaaaaaaaattagctgggcatggtggcaggcgcctgtagtcccagctacttgggagactgaggtgggagaactggcttgaacccgggaggcggaggttgcagtgagccaagactgtgccactgcacttccagcctgggcaacagagtgagactccgtctcaaaaaacaaaaaaagaaaacactggaattttttccttggaactggactgtgatgagaggtgcttgccatgaacataagctactgtcttttcttttttctttctttctttttttttttttttttgagacagagttttgctcttattgcccaggctggagtgcaatggcgcaatcttggctcaccgcaacctccacctccagggttctagcaattctcctgcctcagcctccctagtagctgggattacaagcatgtgccaccatgcccggctaatttttgtatttttagtagagatggggtttctccatgttggtcaggctggtctcaaactcctgacctcaggtgatctgcccacctcggcctcccaaagtgctgggattacaggcgtgagccaccgcacccggccagctactgtcttttctttgacccttcctttccattttttgaagataaagcaggaaataatcttctctgaagatacttgataaaaattccccaaaatacaaaaacacatgcttccacttcattgataaaaatttactgcagtttggcacctgggtctagttcagctggcagatgagctgattgatgcattcaccctgatagccaggtatgcccatctccttgaggaagcccactctatttttggtagcatgacgggccactgagaggtggaaagggcacaagaaccacgagatctcctggaaatgcttctccaggtgctcctcaatcactgtgttgtctgtcagagggatggtcttattcgtgaccttgacttgtccacgtttcaaaatgagttcccagacagacttcagatttggaaatccctaggtcacataagtttccactatacgcagcatttttaggttctggggggtgacttttacaaagacaccactaaaaattttctttgggcaaagtctcgcaatggttctctgcaccagtaaactcacgccatcaatcctttcgatgcgtacaacaaaggccaaggaatgtttatctggcaattccaaggtgtggtttcacttctagtcgtctgagacgtaccttgtcacgtttctgtcaccaggaatcttgtaggaatgattccagttgtttaaacctgagcccttttctttttctctgctccttctttgccaaaagtgcctgctttgcctgggtggctttgagggcttgataagctgtcctcattttcaggagattttctggaaccaaagggatttatctttgctcttgctctgccatctttctagtgttgcagctactactactcagtaattaaggcaaggaaaagcagtcaaagttattcagattggaaaggaagaaataaaacgctccacttgcaaatgacataattgtctatgtagaaaatctacagaaaagatcccaaaattaagtgaggtaagccaggtcacaggacatacggtcaaaatgcaaaagtagattgtatatttagatactaacaatgaacgactggaattttaaaaattaaatgactttttttttttttttttgagatacagtctagctctgtcatccagagccaagctctgtcatccaggctggagtgcagtggcgcgatctcagctcactgcaacctccgcccccaagttcaagcggttctcctacctcagcctcctgagtagctgggattacaggcacccaccatcatgcccggctaatttttgtagagacagggtttcaccatgttggccaggctgatcatgaactcctgacttcaggtgatccacccgccttggcctgccaaagtgctgggattacaggcgtgagccactgcccctggcctatttaggtataaatctaactaaatatgtgcaatgcctgtaagcctaaaactgcaaaacactaacaaaacaacaacaacaaaaaatcaagacctaagtaaatggagacataaataatattcctgggccaggagaatctatattatgatgccagttctcaccaaactaatctgtatattcaaatcaatcacaattaaaatcttggcaggatatcttatagatagccacaagcagattcaaaaatttgcctaaagctataataaccaagacagtgtgatattgtcaaaaagacagatgcacagggccgggcgccgtggctcacacctgtagtcccagcattttgggaggccaaggtggctggatcacttgaggtcaggagttcgagaccagcctggccaacatagtgaaaccctgtctctactaaaaacacaaaaattagccgggcgtggtggcacatgcctataatcccagctacttgggaggctgaagcatgagaattacttgaacctgggaggtggaagttgcagtgagacgagatcccaccactgcactccagcctgggcgatagagtgagactctgtctcgaaaaaaaaaaaaaaaaagaaagaaaaaagaaagacagatacacagatcagtgaaacagaacagtccagaatggacccatgcacatacacagttaactacattttgacaaatgtacaaaggaagttccgtggataatgtttagtcttctccacaaaaggtgctgacaattggacactcacatgcaaaagaaaatgaacttcaacccattcctgcacctttataaaagattaatggaaaatggatcttagacttaagtcgaggctggtgggccacgaggtcaagagatcgagaccatcctggccaacatggtgaaaccccatctctactaaaaatacaaaaatcagctgggcatggtggtgtgcacctgtagtctcagctactcgggagcctgagccaggggaatcgcttgaacccaggaggcagaggttgcagtgagccgagactgtgcgactgcactccagcctggcgacagagcaagactctgtctcaaaaaacaaacaaacaaaaaactacaaaatttctagcagaaagcatacgagaaaatcttcgtgaccctgtgttaagcaaagatttcttagatatgacacaatccataaacaataaaactgataaaatgaacttttagaatttctgacttgtgaaagacattagtaaaaggaaaaaaagactgagagaagatgtttgtaaatcaaatatttgacaaaccacttttattcagaatgtataaagaactctaaaaactcagtaagaaaacaaacaacttgattaaacattatgcacttcaccagataagatacatggatggcagataaacacatgaagatattcatgattagtcattaggaaaatgcatattaaaaagcacaatgaatctgggctcaatggctcatacctgtaattcctacactttgggaggtgaggcaggagaattgcttgagcctaggggttcaagaccagtctgggcaacataggcagacttcatttctacaaagcaaaacaattagccgggtgtggtggtatacacctgtggtcccagctacttgggagcctgaggcaggagcagaaggatcacttgagcccaggaggttgaggctgtagtgaatcatgatgtcaccatagcactccagcctgggaaaaagaacaagatcctgtctcaaattaaaaaaacaaaacaaaacaaaaaacaaacatgaagaatctaaatgcattgctaagtaaagaagtcagaattgaaatgttatgttgattccatttacatgacattctagaaaagctgaaattatagaaacagaacaaatcagggatttccaagggctggaaatgcaggaggggttgattacaaaagggcagcacctgggaaatattttgggcaaaaaaactgttttggcatcttaatgcctgcagttattatacagctatttgcattaataactgtaaaccaaagagtgaattttattgtaagtaaatttttacgaagtgcataaagtggaattgaaacaaaccacaaatgctactgtaagtgagttccctccaagatctctgagactcagacctaccaatgatagtaagagtctccttagcaggagacaaattattcctaggaaggagattatatttgttcttcgaaattggaagaggaggaagaaaaaaagagaagcccatgagcaccaagtaaacatggtgaatactttattattgggctcttaaattgtcagtttcatatgcgtgatttcccataaatatcatgccattggccgggcacggtggctcacacctgtaatcccagcactttgggaggccgaggcgggcagatcatgaggtcaggagatcgagagcatcctggctaacacggtgaaaccccgtctccactaaaaaat

SEQ ID NO: 37 - DNA, 11965 bp, Homo sapiens
atggcgtgaacccgggaggcggagcttgcagtgagccgagatcccgccactgcactccagcctgggtgacagagcgagactccgtctcaaaaaaaaaaaaaaaaaaaaaaaaaaaaaaaagccgacctgttgtggaaaggtcaggctagtactagaggtctgggtgatctccccaaaagtctaccatccgcaacctggaatggcacttacaagttcatgaattcatctcagatctttactcatgatctgattttccttccttttctacaaccttactctgaccttagcaaaggaggccaagtttggacttcttactcaagtggaccctggtaagaattgcgtaggggtcaaaaggcctactgtataaacttgggcaagtcacttcacctctctgaccctcagtctcttcatctattaaatagagctgatgcctagctcacagtgttgtctggggggttacatgagataatgtatgtgaatgtgactagctcaataaatgtcactttctgttgccacctttgagctttctcatccttttttttttttttttttttttttgaggcagagtctcactctgtcgcccaggctggagtatggagtacagtggcacaatctcggctcaccacaacctccgcctcccggattcaagtgattctcccacctcatcctcctgagtagctgtgattacaggcatgtgccaccatgcctggctaatttttgtatttttagtaaagacagtttcgccatgttggctaggctggtctggaactcctgacctcatgtgatcgcctacctgggcctccaaaagtgctaggattataggggtgagccaccacgcctggccttcatccttaataacaaatgacatttcttggccttaacaactcatgaatttaacaggaatatgaaacatataatatgtcatgttggtgcctttaagattaatatgaatcaacaagaatttggctttaagaatttcacatctaagatgactagagatcccagggatgtcccagagactgcaaatcaagacaacagcaaaggatatttgttccttattatcttttggtcctattagcattgaagtaagaataatttggggacttggccgagcatggtggctcacacctgtaatcccagcactttgggaggctgaggcaggcagatcacgaggtcaggagattgagaccatcctagctaacacagtgaaaccccatttctactaaaaatacaaaaaattagccgggcatggtggcaggtgcctgtagtcccagctactcgggaggctgaggcaggagaatggcgtgaacctgggaggcagagcttgcagtgagccgagatggcgccactgcgctccagcctgggtgacagagcaagactctgtctcaaaaaaaaaaaaaaaaaaaaaaaaaaaagaataattcggggactttttttatagtttttttaaaaagccttacaatttaggtttaaataaaatttggctctgggttgtggtttagctagacatttatgagtgatcgttcaggtaatacatctaagaaaagacaattttaagggattatatatatttgatatggatttgaaattgcaattttctgaatgaggaagcctagagttggagtgtttttccatttttttcttagtcatagattaactttgatatttggctctgacatatcctgtgcgatcctgtttcctgcaaaaacacagctctcaagtcgggaactgctgtgatgtggagctggtgtttgacgacggctttgagcatctcagctagaacacactatgcaaacatggaatattatttctcatctcttaccctaagaagggagagacaggagcttaatccccagatgccaccagggtttcagagagaacaaagaagtgaccagaaaacctcgcagccccttagagaacgagatagaggtttgggctctggctgctcagctgggcactgctgactctgccacttgcaaatgtcctgtggcttgtgccattctaaacccacagaggtcctggtctacagggcacagccagctctgtggtgaacacacatcctggcaggaattgggtgggctgggcatggtggctcctgcctgtaatcccaacactttgggaggccaaagcaggaggatcatttgaggctaggagtttgaaaccagcccgatcaacatagggagtcccctgtctgtacaaaaaataagaaaaattagccaggcatggtggtgcatacctgtagtcatagctactagggaggctgaggttggaagatggtttgagcccaggaggttgaaactgcaatgagctatgatcacaccacggcactccagcctgggcgacagagtgagaccctgtctaaaaacaacagaaaagaaactggatgagccctctgatgggaatctcagggagaacgctctgtgattccctgtctgatagcagaaggacactaaggttgtgaagaatgctctctcacccttgcaaagcaatgcagcagctggagatcagtgactcgtccaagttgtacagctagtaaagcacagtcctagtgtggagctcagggcttgtgagtggagtccagtgtgctttctcttttgaggccaccagtgttagcagtattgaccacaagtcccacctagcctctttttctttactggttaggagcaactgagtctgctctagatccctttaaaatcctcctcaaggatctgaaggcagcccgcattcatgatctccttccttcctgccccagcacctttccacaggcagttccatctttggccagccttccttccccacgcaaccctgccccactcagaagccttcttttttttttttttttttttttttttttttttttgagatggagtcttgctctgtcaccaggctggagtgcagcggcacgatctcggctccgcctcccaggttcaagagattctcctgcctcagcctcctgagtagctgggactacaggcgtgtgccaccatgcccagctaatttttgtatttttagtagagacggggtttcaccatgttggccaggatggtctcgatctcttgacctcgtgatctgcccgccttggcctcccaaagtgctggaattacaggcatgagccaccgcgcccagccctcagactgcttcttaccctgcatgtttagtctaaatgtcgtctccatggaaatgccttccctgtctactccactgttctgtatcccatacccaaactgtctcctttacagcaactgtcaggaggtgtgggtatttgttagtttactggtttatcatctgagtcagccccaggataagaggttgaggcagctgtgctcagtgctagtacatgccttgcatatttgatgaatgaatgaactctttgaaaacagtgagccccataaaccactatctctgttttatctctggtcacagctgttaatcctgctgttgaaggtcaggtaagcaacacaaatctttctgacttaaaaatacctccccctgaggcttgccctagttctcttagaacaatttataaagctggtatttgtttgctgcagttttgcaatttgcaacaagacagaagtgctagaattttagtcatcccccatcctcctttgcaggatagaactgggtgtaggtaaagaccttcggtgcctgtagaaggaaggaaactggatccaagaagcaggtgatttcatttccatcaatctttaggttccagatggaggagctgtgcatttgggctcattagctgtgctcactaaagatggacctggagcatgacagcacagccctagctggtctgcccaagtctgtgcctgtccccagtgctcttagctatgtgcttgcagcgtgctgcagctgcatagccacccaggttcttcccaggatcagctgagaacattttagttgcaagtgacagaaaacctcacataaactaacactagcaaaaagagaacttattagctttcacaatcggaaaagtccagggacagggctggctttacctgcagcttcatgctgggcccctgctatattcccaggacctggttcctctctgggagtctctgggcttcctgtcctctgtgttgattccattctcatccataccctcccccggaagcaggatgtctacatcaactccagactcaaaatgcttcctataagccaggcgcagtggctcacacctgtaatctcagcactttgggagactgaggcaggtggatcacttgacctcaggagctgcagaccagcctgggcaatgtggcaaaactctgtctctacaaaaaatacaataattagctgggcatggtggtgcactcctgtagtcccagatacttgggaggctgaggtgggaggatcacttgagcctgggaggcagagatgcagtgagccgagatcacactactgcaccccagcctggacaaaagagcgagactctgtctcaaacaaaacaaaacaaaacaaaacaaaacaaaacaaaacatttcctgtgtgcaagttcatcagggtaagagtgtcccacctcttttccagtggtctcagaagccctgtggtgtcttgccaactctgatttggttgcctgttgtccctgaaaatcacagtgggcaggtctgagaggcaggcctggagcagaaggatgcatcagctcccccaaaagctgatggactgagagtggagtgaggttgttccacaaaaggaaactggggttctgttaccaagagaaaggcaggtgaattcaaggcaacagacatagcacgtgtcctttttatctcctaatctgatttcctcctctttacataaagatctcttggtggccaggcgtggtggctcacgcctgtaatcctagcactttgggaagccgaggcgggtggatcacttgaggtcaggaattcgagaccagcctgaccgacatggcaaaaccccatctgtactaaaaatacaaaaattagccaggcttggtggcacatcccatctaccggagaggctggggcaggagaatggcttgaacccaggaagcggaggttgcagtgagcagagatcgcgccactgcactccagcctgggcgacagagtgagactccattaaaaagaaaaaaaagaaaagaaaaaaaaaagatctcttggtgtgcccctccttcccgtggccttgccgaagcagaggatgaccaaaggcctgtgtccctgtggcgcattcctcatctcataattctcccattgttcatcacggcacttggacacagtacagtatgattttttgtataattcccccgacttttattcatgtatttacttatttattttgaaacagggccttgctctgtctccaaggctggaatgcagtggtgcaatcacaggtgcctgcagccttgaacacccaggctcaagtgatcctcccacttcagcctccaaagtagttgggaccacagacacacaactacacccagctaatttttgttgttgtttaatttttgaagagatggggtttccctgtgttgcccaggctggtctcaaactcttgggctgaagcgacccacctgcctcagccttccagagtgcagggggttacagatgtgagccaccttgcccagctccctcttgggggagggatggctttaacagatattttactgttacttatatattttactatttagatatttactcatttattttactgtttagatatttactaacatattgtaagtaataggatatcctattacttagatatttactaaaatatcgtaataagatatcctattacttagatatttactaaaatatcgtaataggatatcctattacttagatatttactaaaatatcgaataggatatcctattacttagatatttactaaaatatcgtaagtaataggatacctattacctagatatttactaaaatatagcaataagatatcgtattacttagatattttactattgcttatattttattattacttttaacagatatttcactgtattttactgtttgccttttaacaggtgttttgctattaaggccaaacagtttttctgttctatcattgttttttttgttttctctctttgatggagaggagatgaaatgagctgctgtttagcctgagtacaccattgtgctttatatctatcagcaccagaaatacccctgagagctgaaccgtagaaagctttctagaaacaaatgaacttatgaagcattttaagctacaggttttcccactgcagtgcatcatggggagaggtaaaagcgtggaggatctggcttcaggcagaccttagcttaaagcccattaaggccaccaggctgcacatctcctgggggcccccttcacagcagactcagtgtgcagggcacctctggagtagtggctgcatggatgacccagccatgtgcagcagccttgaatcccgtttccctcactgactagctgtgtggccttggacaggtatttgaactctctaagcgctggttgcctcatctaatacagcattaataaatatttattatattttagtccggttgtggtggctcacgcctgtaatcccaacactttgggaggctaaggcaggtggattacctgaagtcaggagttcaagaccagcctggccaaaacggtgaaaccccgtctctattaaaaatacaaaaattagctgggcgtgatggtggatgcctgtaataccagctactaaggaggctgaggcaggagaatcgcttgaaccctggaggcagaggttgcagtgagccaagattgcgccactgtactccagcctgggcaacaagagcgaaactccatctcaaaaaaaaagaaaaagaaaagaaacctaggctgggcgcagtggctcatgcctgtaatcccagcacattgggaggctgaggcgggcagatcacctggtcaggagttcgagaccagcctgaccaacatgacaaaaccccaaacaaacctcaggaaactagtaatagaaggaatcctccttaatctaataaaggatatttacaaaaacccccaacacctaacataaacacttaatggtgaacaactaaatgctttcccccaaagttcaagaacaaggcaaggatatcctacttaacataatactactcagtaattttttttttggaacatagactcacagcagagacaagtgaacatttatttttgtgcctttcttcctatgtgtatttcaagtctttttcaaacaaaggccccaggaatctccagattcaattatgtccctggggttggtcgactgctacaggagtcttagggagccttggacaaatgctagagttactcatttaccaccattaaactctaggatagaagatgcagcaaagcaggactccttcctccatggaatgtgctgatttcagacgaggcggcagccaatgtagaaaacgctggaattggccgggcgcggtggctcacgcctgtaatcccagtactttgggaggccgaggcgggcggatcacctgaggtcaggaggtcgagaccatcctggccaacacggtgaaaccccatctctactaaaaatacaaaaaaaattagctgggcatggtggcaggcgcctgtagtcccagctacttgggagactgaggtgggagaactggcttgaacccgggaggcggaggttgcagtgagccaagactgtgccactgcacttccagcctgggcaacagagtgagactccgtctcaaaaaacaaaaaaagaaaacactggaattttttccttggaactggactgtgatgagaggtgcttgccatgaacataagctactgtcttttcttttttctttctttctttttttttttttttttgagacagagttttgctcttattgcccaggctggagtgcaatggcgcaatcttggctcaccgcaacctccacctccagggttctagcaattctcctgcctcagcctccctagtagctgggattacaagcatgtgccaccatgcccggctaatttttgtatttttagtagagatggggtttctccatgttggtcaggctggtctcaaactcctgacctcaggtgatctgcccacctcggcctcccaaagtgctgggattacaggcgtgagccaccgcacccggccagctactgtcttttctttgacccttcctttccattttttgaagataaagcaggaaataatcttctctgaagatacttgataaaaattccccaaaatacaaaaacacatgcttccacttcattgataaaaatttactgcagtttggcacctgggtctagttcagctggcagatgagctgattgatgcattcaccctgatagccaggtatgcccatctccttgaggaagcccactctatttttggtagcatgacgggccactgagaggtggaaagggcacaagaaccacgagatctcctggaaatgcttctccaggtgctcctcaatcactgtgttgtctgtcagagggatggtcttattcgtgaccttgacttgtccacgtttcaaaatgagttcccagacagacttcagatttggaaatccctaggtcacataagtttccactatacgcagcatttttaggttctggggggtgacttttacaaagacaccactaaaaattttctttgggcaaagtctcgcaatggttctctgcaccagtaaactcacgccatcaatcctttcgatgcgtacaacaaaggccaaggaatgtttatctggcaattccaaggtgtggtttcacttctagtcgtctgagacgtaccttgtcacgtttctgtcaccaggaatcttgtaggaatgattccagttgtttaaacctgagcccttttctttttctctgctccttctttgccaaaagtgcctgctttgcctgggtggctttgagggcttgataagctgtcctcattttcaggagattttctggaaccaaagggatttatctttgctcttgctctgccatctttctagtgttgcagctactactactcagtaattaaggcaaggaaaagcagtcaaagttattcagattggaaaggaagaaataaaacgctccacttgcaaatgacataattgtctatgtagaaaatctacagaaaagatcccaaaattaagtgaggtaagccaggtcacaggacatacggtcaaaatgcaaaagtagattgtatatttagatactaacaatgaacgactggaattttaaaaattaaatgactttttttttttttttttgagatacagtctagctctgtcatccagagccaagctctgtcatccaggctggagtgcagtggcgcgatctcagctcactgcaacctccgcccccaagttcaagcggttctcctacctcagcctcctgagtagctgggattacaggcacccaccatcatgcccggctaatttttgtagagacagggtttcaccatgttggccaggctgatcatgaactcctgacttcaggtgatccacccgccttggcctgccaaagtgctgggattacaggcgtgagccactgcccctggcctatttaggtataaatctaactaaatatgtgcaatgcctgtaagcctaaaactgcaaaacactaacaaaacaacaacaacaaaaaatcaagacctaagtaaatggagacataaataatattcctgggccaggagaatctatattatgatgccagttctcaccaaactaatctgtatattcaaatcaatcacaattaaaatcttggcaggatatcttatagatagccacaagcagattcaaaaatttgcctaaagctataataaccaagacagtgtgatattgtcaaaaagacagatgcacagggccgggcgccgtggctcacacctgtagtcccagcattttgggaggccaaggtggctggatcacttgaggtcaggagttcgagaccagcctggccaacatagtgaaaccctgtctctactaaaaacacaaaaattagccgggcgtggtggcacatgcctataatcccagctacttgggaggctgaagcatgagaattacttgaacctgggaggtggaagttgcagtgagacgagatcccaccactgcactccagcctgggcgatagagtgagactctgtctcgaaaaaaaaaaaaaaaaagaaagaaaaaagaaagacagatacacagatcagtgaaacagaacagtccagaatggacccatgcacatacacagttaactacattttgacaaatgtacaaaggaagttccgtggataatgtttagtcttctccacaaaaggtgctgacaattggacactcacatgcaaaagaaaatgaacttcaacccattcctgcacctttataaaagattaatggaaaatggatcttagacttaagtcgaggctggtgggccacgaggtcaagagatcgagaccatcctggccaacatggtgaaaccccatctctactaaaaatacaaaaatcagctgggcatggtggtgtgcacctgtagtctcagctactcgggagcctgagccaggggaatcgcttgaacccaggaggcagaggttgcagtgagccgagactgtgcgactgcactccagcctggcgacagagcaagactctgtctcaaaaaacaaacaaacaaaaaactacaaaatttctagcagaaagcatacgagaaaatcttcgtgaccctgtgttaagcaaagatttcttagatatgacacaatccataaacaataaaactgataaaatgaacttttagaatttctgacttgtgaaagacattagtaaaaggaaaaaaagactgagagaagatgtttgtaaatcaaatatttgacaaaccacttttattcagaatgtataaagaactctaaaaactcagtaagaaaacaaacaacttgattaaacattatgcacttcaccagataagatacatggatggcagataaacacatgaagatattcatgattagtcattaggaaaatgcatattaaaaagcacaatgaatctgggctcaatggctcatacctgtaattcctacactttgggaggtgaggcaggagaattgcttgagcctaggggttcaagaccagtctgggcaacataggcagacttcatttctacaaagcaaaacaattagccgggtgtggtggtatacacctgtggtcccagctacttgggagcctgaggcaggagcagaaggatcacttgagcccaggaggttgaggctgtagtgaatcatgatgtcaccatagcactccagcctgggaaaaagaacaagatcctgtctcaaattaaaaaaacaaaacaaaacaaaaaacaaacatgaagaatctaaatgcattgctaagtaaagaagtcagaattgaaatgttatgttgattccatttacatgacattctagaaaagctgaaattatagaaacagaacaaatcagggatttccaagggctggaaatgcaggaggggttgattacaaaagggcagcacctgggaaatattttgggcaaaaaaactgttttggcatcttaatgcctgcagttattatacagctatttgcattaataactgtaaaccaaagagtgaattttattgtaagtaaatttttacgaagtgcataaagtggaattgaaacaaaccacaaatgctactgtaagtgagttccctccaagatctctgagactcagacctaccaatgatagtaagagtctccttagcaggagacaaattattcctaggaaggagattatatttgttcttcgaaattggaagaggaggaagaaaaaaagagaagcccatgagcaccaagtaaacatggtgaatactttattattgggctcttaaattgtcagtttcatatgcgtgatttcccataaatatcatgccattggccgggcacggtggctcacacctgtaatcccagcactttgggaggccgaggcgggcagatcatgaggtcaggagatcgagagcatcctggctaacacggtgaaaccccgtctccactaaaaaat

SEQ ID NO: 38 - DNA, 17639 bp, Homo sapiens
acaaacagagccatgaccactgtacaccagccactccatgtcctgcgtctgctgtgtattcctatacttatacacagcaggtgcttaatacaggcttgtgggatgagtgaccagacttttccatctatgccttccacagcagttacgttatttcagtggctgcagagtccctgcctagtcttaatctttcttctctttctgaacatttagtaacacctatttcttggttttaacatcactgacaaaactgccatgaacctgctcatcaactgatgtttcactttttcttctgttcacttgtttccctgggactcaccccaaggaggcagtgcacaggtagtgaatatggcaggtgttcttaaaagcttctcagggctcagggtggcctagaagtgtggcaggggaaaaggtttggtagtcagggtcaaattctagtctagcttcagacccttaggcaagtcattctcctttctgagcctcagtttctgcatctgtaaagtggaaataggcctctctgaaggggacagtgtgaagagcaaatgagataaggtacaggaagtctataggccccagctgataggaaagagtacaacagctccatccaccacccaggtcccaaaggcatctccccagagtcggtagctctgctgtctttcccttctctggagtcaccaaacaccctgcccaccactacaccctcagctgccctgggagctacagccctatgtctgaaggaaccctttcttacacttttggagagcaagtgccccatcactgcttggttcctgacagtacacagggacacagggacaggtcttccggcaaaggtcaggtctgggtcatgaggagtggaagggagggaaggagagagggggcctaacccaggagtgatgggctctcagaacattggcagcagaaaacaggacaggctgggcttttacagtagaagcccagacgttttcccagttaaggcttgagttctgcctccgagcctatattcaccctattccccaactggagtgccctctcctctttctccaggttgtccaaaccctttctccaaagctcaactcaagggtgacttgttccaggtaacccacctgcctcccatctcctacatgcctggtctgcctgtgccagctgtcaggagccgagccatgggccctcccagctctaatggaaatggctctccatccagctctgccagctcaggcctcagcactgcccaggggaccatcacacggctcaaggtcagtctccagtgatcttagttgatccccacaagaaccctgtgacatgagcacagctgggttagtagttcccattttagaggtggagacacttaggcccagaagggaacagtggcttgctaaggcccacagcatcaactacccagctgacttgaatctagggcttcagaatctttgtctagagttctttgctctcctggagccacgccttaacaaatatttgttcattcatttgacaacatcctccaaacatctcttttgtgcctggacagaggccatacaagaaggaagctggagtgtaaacagtgaggtgcccagtataaaccattctgtggccacacaagggactggggatgtatatgtgtcaggctccctgagtactcccagctgaatggattggtggagagagagtcagggagcccgtcccaaagaggtgaggcctggcctggacagaaagatgggccagactaggttagcaaaggagcagggagagcagcaggagaacaagggccagaggtgagggagggcttggctagaagcccttcagtgtgcctaaaactttgggtgcaaagggaaagggagtaagaaatgaggctggaggcccggcgcggtggctcacacctgtaatcccaacactctgggaggccaaggcaggtggatcacctgaggtcaggagtttgagaccagcctggccaacatggcaaaaccctgtttttactaaaaatacaaaaattagatgggcatggtggtgggtgcctgtaatcccagctacttgggaggctgaggcagggaaaattgcttgaacctgggaggcggagctgggatgcggaggttgcagtgagccgagatcacaccactgcactccagcctgggtgacagggcgagcgagactccgtctcaaaaaaaaaaaaaaggaagagaaagaaagagatgaaggaagagtgagagaactaagagggcgggtggctggagggggatgggcaggaggggcgcaggagggagcagtcagacctccagtttgcaggagactgagcaggcctagcccagggccctggctgtcgtgatggaggaggggacctccaggtgacccacaaaagaggctgagtcacaggccttgttcttaactgaaaacatgggctgagggagagcagagagttgaaatggctggaggagcagcagtgggtgttggagaggctgtgacccctgttttggagtttgaggggtctgggggatggccgtacaatgcagaggagtgttctggacagaagcttaaatgttgggaatcaccggcaccgggaaccaagagggtgcaccctgcccaggaaaggttagactaccaggctgggaggtcccaagaaaccctaggtgtcacttaggggagagggtgctgtaactcaggctcacccccactcagcccgggctggcaatggctggctggagagccagagggtaggagatgtggggctctcaggtttcacagctctcatttctcccaccccgcctggcagggtctagctaggctctggcaaagaatcagaacataacactgggactggctccgatgagtaacccaatgccaggctggttggagtgggaacctgggctccccacccccatgaagctactcctcacttctgagcatggcttgcctgcttgcccctgcccactcccaagcctttatccacgctgtcccctccacctggaatgcctcctctgggccccactgggcaaaacccgacctatcttcccaaggcctgctcaagtgctgtatcgtttctggactttgtcccccttccctgctggcctcccactgcccactagtgcccttccctagaacacactccaccacctgcctctatcacaagggccacacactggaggtgagagtctgtctctgagtgtctgagactgagtgccttgggaacaaaaagcacacatggcccagcccagcccactcccaactaaagaagtgagcctaggagtcaagattcgaaatcctgtgtgagccctgaatggctcctcagcctctgtttacacgtctgtaaaatgggctaataatccacctcactgtgatgatcaagtgagttgatgcgtagagggcatcaattactgtgcctggtacacagcaggtgctccataaatgcgtctcccctcttccttcccagggcctcacctggggagctgagaaatccattactgacaactagggcttctaggaggagaaggggcctttgttttaccttcacccacatcagaggacccacacttcacacctgctttccttcacagccaaagtaagcactgatgaaggcaacaagtgcctatggagaccctgttggtgttcctcctgcccagttacacaggccacaacacaatcctgccccctccgcctggggagtcaggggagaggcatcagatgtgggacttgaagggtgaaagagatcctctggaggggggaaaggcatccaggcccaggaaatggcatgggcagagggagagagggagggaggaatgagcctggtgagctggagcaactgcaaatggttttaaggcggctgccatgcagagggcagggaagggacctggggagactgaggctgcagagataagctgagcaattggccagggctccgggtaagccaaggggttgggcttcatcctgcaaccacagcgaagtttttacctgggtgggacggtattgggattccagatctggaaagctggctctggaggcaggaaaacctagaaaggtctaaggaggtggctactgagggcctaagggagctgggagaggtggccctggaaggctgctaccgggcttgcgttcttgctccagttatctccatgctggggtcagaaggagcgaaccccagccgataaacaagacagtcccaagggaagactgcatgtggggactgatgcaccccactcctagaccagacaggacgccagctctcatttctgctttacagagactcgctctcctgggctccttcctggggctggggggcagggagcggggagggcggtcctccgtccagcctagtttactgactccctctccgggccagatgggcgctggaatgggtggctggagaggggttcgggtcctgcctagggcgagagtagctggagagaggcgcgcctgagaggttcttccaactggaaagagctcttattccaccggtggggaaactgaggcacggcgaggggaagtcaccggcccaaggtcacgcgtcgagctgaaggcagaggcagggtttgaacctgggagagctggctctcgggaggcctcggccagcgaccgagaaaagggaggggcggcggggcggcggggcctgtgttgggggccgggcgcgccgagctcacctggtagttgtctagctgctcttcggtgaagatggtctgcttgttccccatggtggccgccgcgccgccgctcgcccgcccgggctccgactcccatcagcggccgccagacccggagccagcgccccgtgcccgcggccctcggcagccccgcggctggcagcggcccacggtggccggacccttcccgccccgcagctcgcctggaggaggcgcgcgggggtctcggaggcggggacgggaacccggagcggcagcgactccgccgccggcgggaagagggcggggcacccggctccgcggctgcagcgcgcccgggtcccggcaggaggcgacctggccccgggagacgctgcccggcacgaacccttggctcccgcggccggaagtgctgggggcgcgcgggggtctcggaggcggggacaaagacccggagcggcggcgactccgccccgcagcaggaagaggtgtgagcccgggtcccgccgtgggagtccaggtcgcacggcgtgagggtgcggggcctgggaaaaaaccctctcgaggcgggcagtggggcgagtggcgccccttgacctggggcgggggcggcagcgaggactgtgagtgcgtggatctagctggggccgggctccgccaccgtctcgcgtcgcgaccttggtcaagcccttacccgggccctgtccctctggggagaaggagggggtcagtcaagctgacatctgaggccctcccggccaggcctcgggaagcccatctggcctttgggcgcggcctaggcagggcatctcagaccttctgtgttccttagggagcaggacaggatttacttggcttggttacaaacgtgagacttgagaggatttaaaggacttgactgtgtccacagaagtgtgacaaaggccaagacattttttggagcttttaagcagatgccattgtaagggaagcaggactttacctctgccctcctagggtctttggctgggcttgagaattaatttggcataagacagattaaggggagaaaaacagatttaatacaagttttacatgacgtggaagccctcataaggaaatgaagaccctgagaactggcaaaatctaaatacttttttttttttttgagatggagtctccctctgtcgcccaggctggagtgcagtagcgcgatcttggctcgctacaacctccgcctcctgggttcaagcgattcttctgcctcagcctcccctagtaggtgggactacaggggcatgccaccacacccagctaatttttttttgtatttttagtagagagaggtttcaccatgttggctgggctggtctcgaaatcttgacctcaggtgatccacctgcctcagcctcccgaagtgctaggattagaggcctgagtcaccacgcccggccaattattgtattttttttgtagagatggggttttgccgtgttgcccaggctggttttgaattcccaggctcgagcaatccacccactttggcttctcacccaaagtgctgggattataggatgtgagccatcatgcccggcctcatctcctgttttttagaaaaagaaggatgatcaagagtgcccttcttgcatctgctatttttcaagtgcctttaactcaaatactcaatatgccagagcagcatatgttgtggtggcatgttctgaactccttccccatccaccaaatggagtcaccgctatctttttggggtccagcccatacaactgttatttctaaactcaggacaactgaatcagtaggtattatctccatattataggcaaagagttgggctgagagaggttcagtaacttgcccagggtcccacagctgggaattagtagaacctggactggacccaggcactggctcaacataccattccacaactgccagtggactttgaagagatcaggatttttttttatttatatatataaaaaaaaatagagatggagtctcactatgttgtccaggctggtctccaactcccaggttcaagtgatccttctgccttggcctcccaaagtactaggattacaggcgtgagccaccatgcctgggcgagatcaagactttatgctttaaaatgcgtggtttgttactttaggatagtggttctgaaaccacctgggagcatgtatcaaaattacttgggaggctgcacccctagattttctgatttagaaggtctggggtggctaagaatgtgggtatcgaaagggttcctgggtgacactgatgcagctggtcttggaaccatactttgagagtgcttaggctgctgaagcttgtgggttctgatgggaacagggcttcaagtttggcagatgatccctcatgcttttagttttcttttatatctgaggctactggttggggttttccaaccttattttgccactccctggtgagaacagcagccatcagctaaacagacatgtcaccctgttaaaatcacaagagtcttcagaggcaccatcaattgctatcagaggggtaagaagcaattcattagcctggggattggtgaccagccttcaggggtcacctcaccatcttttcatcattgtggacacatgcaataggggcctaacccatgggaaagaaggcaggatgtgtccccagagatttggagcatgtggaattttagagcagagaaggcacatttaaaagattctctcttctgtacctcccctttttcctgtgttggagttggggaaaaggaaacccttttgaaaccacataaccactattacacaagttttccttcttcccatcttattagattccacactgtgcatgaacaagccagaattctgtgtgttcagatcctgctctggcgcattcttgtacaattgctaacatgctgcttatttgcataccaggtgttccaggtagaaaatctggaacctatacaaagaggactgtgttttcagtcccgggagcccttcctctcataggagagaaatagaggtaaccaactgaactagaaaattcctctcaaaaatccttttaggccaggtgcggtggctcacacctgtaatcccaacactttgggaggccgacacagacggatcacctgaggtcaggagtttgagaccagcctggtcaacatggcgaaaccctgtctctgctaaaaatacaaaaaattggcctggcgtggtggcgtgcctgtagtcccagctactcaggaggctgaggcaggaggatcacttgaacccgagaggcagaggttgctgtgagccaagatcgtgccattgcactccagccggggcgacaagagcgaaactccatctcaaaaaaaaaaaaaaatctttttggatcattattaccatggcctatctgaagctctctctcttgagcaatgctgtgaggaggggcaaggaacacaattcccatgttacagataagaaacctggggctcagagaggccaaatgacttgcctgatgccccccagctgggaagtggcaaagcaaagctctaacgtcgttctctgattccaaatcctgtgctttagctgctccctgatgttgagtgtggtccctgaggagcagagtgtgtgtgtttgctgggagggaggatgggccgagggagaagaataaaacattactgattacttatctagtgcccagaattgtactggatgtgctatatttactgaatttgattattccacaatagcctcctcagtctgtggagtttcatattattatcccatttcacaggtgaagaaatagtttcagagaaggtgacttgcccaaggtcacatagctggtaacaggtagatttaaatctgggccctgactcttttcttttcttttttctttttttttttttttttttttgagacagtcttactctgtcgcccaggggcatgatctcagctcactgcaacctctgcctcccgggtttaagtgattcttctgcctcagcctcctgagtagctgggactacaggtgggagccaccacacccagctaatttttgtatttttaatagagacggtgtttcaccatgttggccaggctggtctcgaactcctgacctcctcagcctcccaaagttgggattacaggcatgagccaccgtgccctgccggactcttctcttgatcacacagtctaggacagggaaacgtggttaccagtgtttaaagggggctgactccttgtcaattgcagtcttgtaaataatgtaaaaggaaaaggcagcaggggtgccagatactcattaaatgttagcttattttttttcatttctgattcacacaatgaagtttattttaaaatttggaaggaaaacaggaataaatgctaccaagtgcttctttgggatgagaggtcatcttgacctgctgcccaagtgctcgtttgtgatgatgatgcactttgtgatcaagatgacctctcatcccagagaagccttgtagcatttactgcagaacaactcaatctgcaagttgttcttctaagacttagaatctagatagatctttttgtttgtttgtttttgttttgttttgtttttttgagacggagtctcgctctgtcgcccaggctggagtgcagtggcgcgatcttggctcactgcaagctccgcctcctgggttcctgccattctcctgcctcagcctcttaagtagctgggactgcaggcgcctgccaccatgcccagctatttttttgtatttttagtagagacggggtttcactgtgttagccaggatggtcttgatctcctgaccctgtgatccgcccgtctcagcctgaatctaggtagatcttaatgacagagatggaagatccctgggcccaaggtctgggtgggaccatctcttaaagtaaacgaagcctgcagcctgtcttctagcagctctgtgggccctgtgagtcattccccagtcctccactcaaatcctttactatcccacctctactttttatcagctcaggaccccacctgctatcttggctcatgggaatcttctctatcttaggggcaattcaaatcttactcttatctttacctataaagcattgtcatcttggcgtcttccctgacatggctgtgatttatagtgtgtgagcagttactaggtctgcctcagtctctctctctttctctctctctccctctctctctcacacacacataccctgcaaccccttgtttaacctggcctatatcctagcactgaacagcttgtctctgtttctctagcattttgcacatagtaggttcttaatgagtatttggtggataaataaatacacaccctgggactgtttttttttttgtcctgaggagggttatttttccctctcaaacactaagaaacaggagggctgggaccagggctgggaccacatgttcgtctgtatccccagacacagaggaatctcccagggtctagcacatggtcttagcaaatgtaaaatcaacaccctttaaaagagtacattttcctggacctgttcatacatttaatcaactagatccccaaatattctgacttgaaaaagattttcttactggaggatttagtgaccagtcgtttagcgcagagccaacagaatgaaacccctttctctcttccgggagactgacctgccctagagccttccccagaagctactctggatgtgagaagttactggatggctcaaatgggaccccagctggatggcgactgtcctgttgttgagggaggagggggtcaatttcctccacaaatctgcttcttctggatcgtgtcccacccacctcttggatgcctttgacatctttggaggcacccttgatttctctccttccctcagacccctcagtccattagcacagccagtcatatctagaagccagccacttcttagcactccattgctatcactgtggtccacgcccccctcacctctctcctgttatggccgtatctatcatgaaatgacctaaaccaattcatccacaactaggttcattttactgcagatctcagtaatctccagtaatgagtggtaggtaggggtgttgtgtttccttccacaaaccttgctatgagggggtctgaggcaagcaagtctcagactgaagtccacaccttgtaccatcacttatcagcaagcaggtccccaacagtcatataaccttctctatgagctcaatgaaggcctagctccctgaccttttgcatatttcaataaactttcctcttgaaagatttagttcaggctgggtgcagtgctcatgcctataatcccagtaccttgggaggctgaggcaggaggatcacttgagctcaggagtttgagaccagcctgggcaacatagtgagaaccccatctctaaaaaaaatacaaaaaatagctggacgtggtggcacacgcctgtagtcccaactactcaggaggctgaggtgggaagatcacttgagcctgaggggttgaggccgcagtgagctgagattgcaccactgcactccagcctgagcaacagagtgagactctgtctcagaaaataggggggagggatttcattcaaggaagttgcaaacaatatttaaggagcaagatttgaacaaccttcaatttgggatcaggcaactgcattcttactcagaagcttgaacctgaccagacggactcctaagacctagaccccatcaaaactccctaggtttttgtgtcctgtctgtctgtgtaagggcagaggtacttggacaacccttcacatatctaaaataccactcatttgatcaatggacaattatttcagccatccattttgctaatgaacagaccctctgctgctggaatggcatcaagacagctgaagcccttgtggaagggtctctggagtgtgggcttctgggtaaagtcccaactgcttctagaatggcctctctcaaagtgtgatcgtgggtctcctggggtctctgggatcttttcagagagtctgcaagggcaacaatatctcataataatactgagacattatttgcctttttcattctcattttctcacaagtgtagagtgaagatttccagaagttatatgggtatgtgatattgcaacaggttgaatgaagaagcaaatgtgagaatccagcagttttctattttgtttttgtttttttgagacagagtctcgctctgtcacccaggctggagtgcagtggtgtgatctctgctccctgcaagctctgcctcccgggttcatgccattctcctgcctcagactcccgcccggctaatttttttgtatttttagtagacacagggtttcaccatgttagccaggatggtctcgatctcctgacctcgtgatccgcctgcctcagcctcccaaagtgctgggattacaggtgtgagccactgtgcccagcccgagcagttttctattaagccaagctctaaagacatttgcaagcatgtaaaacaatgccactcttctcaataaatatttttgtcttcaaatatatgattatttttcataaaagtctgttaactaagccaacatataatggttttgtctttgcagtgggtaggaagaacccatcgggtgattacacttgccaagctttcagtatcagagaggaaggtgggggtgtccgtagggtgaaaatagcaccccaaatgtcttagatcctcatactttttttttgagatggagtctcactctgccacccaggctggagtgtagtgatgtaatctcggctcactgcaaccttggcctctcaggttcaagcaattcttatgcctcagcctcctgagtagctaggactacaggcgcccaccaccatgcccagctaatttttttttttttttgtattttttttgtattttttttttttgtagagctagggtttcaccatgttggccaagctggtcttgaactccttacctcaggtgatccgcccacctcggcctcccaaagtgctgggattacaggcgtgagccaccgcaactggccagatcctcatactttttaagaacaggctgctttcatcatcaagaggagctcttcatcacacttaaggtggttctgcaagacctctgggagaatcccagtgagctggggtccctgtgtctgtagaggcctggcatcatggtttacacaaaaggaacaaaagaaactacctgggaatcccttaacccttcccaagctctatcaactcaggtcacattgatgtctctgaagcatcttgtcataatatgaactgtcttccagagctatctttgtggctctcccaggctactatgggttcctcagaggcaggccctgaatgattagatgttcatttctgtgtttggaggattgttgggaagtttgtgtagggagggttctcatttaatcagtttccctgcatcttctgatctgatcagcccaggagaatgggagcttcagcaggtctgtgtgaccgcaaccattcttgtgttgctataaagaaatacctgagactgggtaatttataaagaggtttaattggttcatggttctgcaggctgtgcaggaaacatggcttctgatgaggcctcaggaagcttttattctcggcagaaggtgaaacagcagcttgcgtaacacaggtggaaagcaggagcaagggggaggtgccatacacttttaaatgaccagatcgcactataactcactatcacaaagacagcaccaagccatgggggacctggccccaaacaccttccaccaggccccacctctagcattggggattacacttcaacatgagatttgggcggggacaaatatccaaagtatatcaaagtcttttgtcattctattagcttcagcttactcaaacatctttaaagatgttataaggtgtcacattaatcagagagtcttctgaattctccgtgggagtgttaataactccattttacaggtgagagaatggaaggtcaaattcacacatctggagagtgtcaatgtgagaactgggacccaggtttgcctggaggatcttccactattgccctggcacctatactgagaataaatgttgtccctttgaaaggggcagctagttcctttgttcaccccagagactatgagaataggctttcaagtatttactccattaaccttgcagcccaaggctcagctactccaggaagagagagggactgggagtcagtatctgctttgagggaagttttatcactttttatagcaacctctgaacttgacccatggacttaggcagatagagcaaagccagtccctgcagtataaacagatgggagataagtcaggtcaatttgatttgatcaacacccctgattgcatttatttccttatttctaggctggctccagagatgctatccccaaatgggcctctggaggacaaatcttttggtgaacattcattaagcaaaataatgcacttatgagtaaagcacatggtgacttggatggtgtgccattacctccccaggacagagtccaaactgcttgccatgataggtgcatgtggtctggatcctgcctttccccacttcttcccacctggccctttgttcctggtatcctttctgcctggcactccttttccttcccttctttctgtttggaaaattggcctcccttaagtcttgtctgcttgtaacaatctctgctttaacccccatgacactctcatctcccctagttcttgaggtaccccaggcttagaggacccacagaccctggaatccatattacagcatttgtttcagtggattgggatcaactgtttgaatatttaccctctagatcagtgttcgtatgggagggatactgctccctaaggaatgttttgagctgtatgggtgttttgtggatgcaatgacaagagggtactatttccacttagtgcctgggttttggggatgctgatgttctgtaatgccgggacaatcctgcccactggagaatgtctcatgtcctgcaggaccttgaggagatcaaccagatactcctgtaggaaacaaacctgtttataatgacctgagcttggaacccaactctgttttataaataaactcctttttgtgtgatcttaacatatgttcagttatccaggaatgcaaatcaagggaagactaaaatttactttgttcaaaactttaacaagactcgatcaccattttggaggtaacatcggagatggcaacgtgacttgtgattgagaaagaagaaattaacccagatgcctgtggcaactaagaattttgcttgatgtggcctggtgcagcagctcatgcctgtaatcccaacactttaggaggctgaggcgggaggattgcttgagcccaggagttccagactagcctgagcaacatagcaagaccctatctctacaaaaaattaaaaagttagctgggagtggtggctcatgactgcattcccagctacttgggaggctgaagtaggaggattgcttgaccctgtctcaaaaaaaagaaagaaaaagaattttgcttgaccccatacaacacacctgtattcatctgcatttgtgaacgtcaccatcactgtgattcatggtctattaacatctacttttttagctcttatttttaaatgtcaaagataaaaactgtggcctgaatattatcatacctctctcaaatccaaacttacttgttataagtaggtgcaagcatgtgactgcttcataatgtcttttagagtttaggcctgagcatttatgtattgaaacccattattttattacagtattccttttatttctctttcatattacagtagcagcattatattgattttgttttttcattatgtgtataagtggtttagattatccatgaatttcgtttcagtatggtaaagaggatattcaaaatatttgttataaaaagggagcatctggcagcattgagaaccactctaaggttcaggaggcagggacttcgcctcccctgggttactccattcttctttgtgcctagcatagggcctggaatatcacagatgcacaaagaatcttttctgaatgagtgatgaaggaattgaggctgatactctggtttggtaaccacctaggtatgtgatgaggccctctgctgagatgggaacacaggagagagggcaggttttggggagagtaatgagttcagttttcattgtgaaagtttggagagccctggaatttctaggtggagaggcctgaggcccagggctgtgtgggccttgatttctctcaaggccacagaagagtggaaagtgcaaagtcgtagtaacagttcatctctttagtcagtaatcattgctgagtctctccatgcaggatgaatagaccagtgagagctgcccatgaggtgtctccctcctcctgtggtgatctgtgtacctgcccaggccctcagaggctaggagctcctccaaggtaggggatagaaatccttcatctctagcccctctgacttcctgccccatcctgacatagtaggtggctcggcaatgatagctggagggaccacgcagtaaaacccatctgtggaaacacatgtattcagagcaactttttttggcctgaagtcactgcagtggaacatttgggagcaagtttccccagggcccagctccttcccgctaggctctgccatgcctcctgtttattaacagggaggcgtgacaaagggaaaaatctcctgattgaagactcatctcagacatcttttcactcctctagggaagggtgcaattctgggctttaatgacatatgacggggcaggcagtagaggtgttgcgcattttaggcaatacatgtgctgctagaaagttgaggtatagggactttttaggaacacaatttttattgacaagtaacctttcaagaacaataaagaaaatcagaaagaaaacctatgttcatagcagcatcattcataatagcgaaaacaactcaaatggccatcaactgacgaacgtatgaataaaatgtggtctattcatgtgatggaatataacttgaccgtcatgaggaatgaaggactgatgcatgctatgatatggataagtcttgaaaacatcatgctaaatgaaagaagccagacacaagagaccagatattttatgactccgtttatatgaaatgcccagagtaggtgaatacattgggatgtaaaagagattggtggttgccagggtctgggagaggggagatggggagtggctgatggaacaagccatatggaaaagcattccaggcattgggagcagtaagtgcaaaggccctgcagtgggaggaagcatggccgattaaagaacagcaaggaggtaggtcggcttcaagggagacagtggtgggggagaagctcagagaggggctagcaggactagaccctttagggctttatggggcactgccagggcattgccttttacttggagagagacaggatgtcgctggcagctttgggcagagaaggatgtatctgtcttatgtttgaacacaatccctctggcaggagatggattttaaggggtagaagtagggaagccagtttgggggccactgtgttggttcaggcaagaggtaactctgacttggaccctggtggcagcagctgccaaggggaaaagtgtccaaaactgaacctattttgaaaacagctcatcttcaggcttttggcctcagcaactagaaggctggagttgaattttattgggtgggggaattctgtgggagggagcaggtttccttctactctttgttcacatataaaaagaagttataagagaacatagataatagtttaaatttttatttttttctgaacattcaaccataaacatttatcaagatgctaaagtcttcataatactcactttaaaaatgttttttttggccaggcgcggtcgctcatgcctgtaatcccagcacttgggaggccgaggcaggcggatcacgaggtcaggagatcaagaccaccctggctaacatggtgaaaccctgtctctactaaaaataca

SEQ ID NO: 39 - DNA, 20684 bp, Homo sapiens
acaaacagagccatgaccactgtacaccagccactccatgtcctgcgtctgctgtgtattcctatacttatacacagcaggtgcttaatacaggcttgtgggatgagtgaccagacttttccatctatgccttccacagcagttacgttatttcagtggctgcagagtccctgcctagtcttaatctttcttctctttctgaacatttagtaacacctatttcttggttttaacatcactgacaaaactgccatgaacctgctcatcaactgatgtttcactttttcttctgttcacttgtttccctgggactcaccccaaggaggcagtgcacaggtagtgaatatggcaggtgttcttaaaagcttctcagggctcagggtggcctagaagtgtggcaggggaaaaggtttggtagtcagggtcaaattctagtctagcttcagacccttaggcaagtcattctcctttctgagcctcagtttctgcatctgtaaagtggaaataggcctctctgaaggggacagtgtgaagagcaaatgagataaggtacaggaagtctataggccccagctgataggaaagagtacaacagctccatccaccacccaggtcccaaaggcatctccccagagtcggtagctctgctgtctttcccttctctggagtcaccaaacaccctgcccaccactacaccctcagctgccctgggagctacagccctatgtctgaaggaaccctttcttacacttttggagagcaagtgccccatcactgcttggttcctgacagtacacagggacacagggacaggtcttccggcaaaggtcaggtctgggtcatgaggagtggaagggagggaaggagagagggggcctaacccaggagtgatgggctctcagaacattggcagcagaaaacaggacaggctgggcttttacagtagaagcccagacgttttcccagttaaggcttgagttctgcctccgagcctatattcaccctattccccaactggagtgccctctcctctttctccaggttgtccaaaccctttctccaaagctcaactcaagggtgacttgttccaggtaacccacctgcctcccatctcctacatgcctggtctgcctgtgccagctgtcaggagccgagccatgggccctcccagctctaatggaaatggctctccatccagctctgccagctcaggcctcagcactgcccaggggaccatcacacggctcaaggtcagtctccagtgatcttagttgatccccacaagaaccctgtgacatgagcacagctgggttagtagttcccattttagaggtggagacacttaggcccagaagggaacagtggcttgctaaggcccacagcatcaactacccagctgacttgaatctagggcttcagaatctttgtctagagttctttgctctcctggagccacgccttaacaaatatttgttcattcatttgacaacatcctccaaacatctcttttgtgcctggacagaggccatacaagaaggaagctggagtgtaaacagtgaggtgcccagtataaaccattctgtggccacacaagggactggggatgtatatgtgtcaggctccctgagtactcccagctgaatggattggtggagagagagtcagggagcccgtcccaaagaggtgaggcctggcctggacagaaagatgggccagactaggttagcaaaggagcagggagagcagcaggagaacaagggccagaggtgagggagggcttggctagaagcccttcagtgtgcctaaaactttgggtgcaaagggaaagggagtaagaaatgaggctggaggcccggcgcggtggctcacacctgtaatcccaacactctgggaggccaaggcaggtggatcacctgaggtcaggagtttgagaccagcctggccaacatggcaaaaccctgtttttactaaaaatacaaaaattagatgggcatggtggtgggtgcctgtaatcccagctacttgggaggctgaggcagggaaaattgcttgaacctgggaggcggagctgggatgcggaggttgcagtgagccgagatcacaccactgcactccagcctgggtgacagggcgagcgagactccgtctcaaaaaaaaaaaaaaggaagagaaagaaagagatgaaggaagagtgagagaactaagagggcgggtggctggagggggatgggcaggaggggcgcaggagggagcagtcagacctccagtttgcaggagactgagcaggcctagcccagggccctggctgtcgtgatggaggaggggacctccaggtgacccacaaaagaggctgagtcacaggccttgttcttaactgaaaacatgggctgagggagagcagagagttgaaatggctggaggagcagcagtgggtgttggagaggctgtgacccctgttttggagtttgaggggtctgggggatggccgtacaatgcagaggagtgttctggacagaagcttaaatgttgggaatcaccggcaccgggaaccaagagggtgcaccctgcccaggaaaggttagactaccaggctgggaggtcccaagaaaccctaggtgtcacttaggggagagggtgctgtaactcaggctcacccccactcagcccgggctggcaatggctggctggagagccagagggtaggagatgtggggctctcaggtttcacagctctcatttctcccaccccgcctggcagggtctagctaggctctggcaaagaatcagaacataacactgggactggctccgatgagtaacccaatgccaggctggttggagtgggaacctgggctccccacccccatgaagctactcctcacttctgagcatggcttgcctgcttgcccctgcccactcccaagcctttatccacgctgtcccctccacctggaatgcctcctctgggccccactgggcaaaacccgacctatcttcccaaggcctgctcaagtgctgtatcgtttctggactttgtcccccttccctgctggcctcccactgcccactagtgcccttccctagaacacactccaccacctgcctctatcacaagggccacacactggaggtgagagtctgtctctgagtgtctgagactgagtgccttgggaacaaaaagcacacatggcccagcccagcccactcccaactaaagaagtgagcctaggagtcaagattcgaaatcctgtgtgagccctgaatggctcctcagcctctgtttacacgtctgtaaaatgggctaataatccacctcactgtgatgatcaagtgagttgatgcgtagagggcatcaattactgtgcctggtacacagcaggtgctccataaatgcgtctcccctcttccttcccagggcctcacctggggagctgagaaatccattactgacaactagggcttctaggaggagaaggggcctttgttttaccttcacccacatcagaggacccacacttcacacctgctttccttcacagccaaagtaagcactgatgaaggcaacaagtgcctatggagaccctgttggtgttcctcctgcccagttacacaggccacaacacaatcctgccccctccgcctggggagtcaggggagaggcatcagatgtgggacttgaagggtgaaagagatcctctggaggggggaaaggcatccaggcccaggaaatggcatgggcagagggagagagggagggaggaatgagcctggtgagctggagcaactgcaaatggttttaaggcggctgccatgcagagggcagggaagggacctggggagactgaggctgcagagataagctgagcaattggccagggctccgggtaagccaaggggttgggcttcatcctgcaaccacagcgaagtttttacctgggtgggacggtattgggattccagatctggaaagctggctctggaggcaggaaaacctagaaaggtctaaggaggtggctactgagggcctaagggagctgggagaggtggccctggaaggctgctaccgggcttgcgttcttgctccagttatctccatgctggggtcagaaggagcgaaccccagccgataaacaagacagtcccaagggaagactgcatgtggggactgatgcaccccactcctagaccagacaggacgccagctctcatttctgctttacagagactcgctctcctgggctccttcctggggctggggggcagggagcggggagggcggtcctccgtccagcctagtttactgactccctctccgggccagatgggcgctggaatgggtggctggagaggggttcgggtcctgcctagggcgagagtagctggagagaggcgcgcctgagaggttcttccaactggaaagagctcttattccaccggtggggaaactgaggcacggcgaggggaagtcaccggcccaaggtcacgcgtcgagctgaaggcagaggcagggtttgaacctgggagagctggctctcgggaggcctcggccagcgaccgagaaaagggaggggcggcggggcggcggggcctgtgttgggggccgggcgcgccgagctcacctggtagttgtctagctgctcttcggtgaagatggtctgcttgttccccatggtggccgccgcgccgccgctcgcccgcccgggctccgactcccatcagcggccgccagacccggagccagcgccccgtgcccgcggccctcggcagccccgcggctggcagcggcccacggtggccggacccttcccgccccgcagctcgcctggaggaggcgcgcgggggtctcggaggcggggacgggaacccggagcggcagcgactccgccgccggcgggaagagggcggggcacccggctccgcggctgcagcgcgcccgggtcccggcaggaggcgacctggccccgggagacgctgcccggcacgaacccttggctcccgcggccggaagtgctgggggcgcgcgggggtctcggaggcggggacaaagacccggagcggcggcgactccgccccgcagcaggaagaggtgtgagcccgggtcccgccgtgggagtccaggtcgcacggcgtgagggtgcggggcctgggaaaaaaccctctcgaggcgggcagtggggcgagtggcgccccttgacctggggcgggggcggcagcgaggactgtgagtgcgtggatctagctggggccgggctccgccaccgtctcgcgtcgcgaccttggtcaagcccttacccgggccctgtccctctggggagaaggagggggtcagtcaagctgacatctgaggccctcccggccaggcctcgggaagcccatctggcctttgggcgcggcctaggcagggcatctcagaccttctgtgttccttagggagcaggacaggatttacttggcttggttacaaacgtgagacttgagaggatttaaaggacttgactgtgtccacagaagtgtgacaaaggccaagacattttttggagcttttaagcagatgccattgtaagggaagcaggactttacctctgccctcctagggtctttggctgggcttgagaattaatttggcataagacagattaaggggagaaaaacagatttaatacaagttttacatgacgtggaagccctcataaggaaatgaagaccctgagaactggcaaaatctaaatacttttttttttttttgagatggagtctccctctgtcgcccaggctggagtgcagtagcgcgatcttggctcgctacaacctccgcctcctgggttcaagcgattcttctgcctcagcctcccctagtaggtgggactacaggggcatgccaccacacccagctaatttttttttgtatttttagtagagagaggtttcaccatgttggctgggctggtctcgaaatcttgacctcaggtgatccacctgcctcagcctcccgaagtgctaggattagaggcctgagtcaccacgcccggccaattattgtattttttttgtagagatggggttttgccgtgttgcccaggctggttttgaattcccaggctcgagcaatccacccactttggcttctcacccaaagtgctgggattataggatgtgagccatcatgcccggcctcatctcctgttttttagaaaaagaaggatgatcaagagtgcccttcttgcatctgctatttttcaagtgcctttaactcaaatactcaatatgccagagcagcatatgttgtggtggcatgttctgaactccttccccatccaccaaatggagtcaccgctatctttttggggtccagcccatacaactgttatttctaaactcaggacaactgaatcagtaggtattatctccatattataggcaaagagttgggctgagagaggttcagtaacttgcccagggtcccacagctgggaattagtagaacctggactggacccaggcactggctcaacataccattccacaactgccagtggactttgaagagatcaggatttttttttatttatatatataaaaaaaaatagagatggagtctcactatgttgtccaggctggtctccaactcccaggttcaagtgatccttctgccttggcctcccaaagtactaggattacaggcgtgagccaccatgcctgggcgagatcaagactttatgctttaaaatgcgtggtttgttactttaggatagtggttctgaaaccacctgggagcatgtatcaaaattacttgggaggctgcacccctagattttctgatttagaaggtctggggtggctaagaatgtgggtatcgaaagggttcctgggtgacactgatgcagctggtcttggaaccatactttgagagtgcttaggctgctgaagcttgtgggttctgatgggaacagggcttcaagtttggcagatgatccctcatgcttttagttttcttttatatctgaggctactggttggggttttccaaccttattttgccactccctggtgagaacagcagccatcagctaaacagacatgtcaccctgttaaaatcacaagagtcttcagaggcaccatcaattgctatcagaggggtaagaagcaattcattagcctggggattggtgaccagccttcaggggtcacctcaccatcttttcatcattgtggacacatgcaataggggcctaacccatgggaaagaaggcaggatgtgtccccagagatttggagcatgtggaattttagagcagagaaggcacatttaaaagattctctcttctgtacctcccctttttcctgtgttggagttggggaaaaggaaacccttttgaaaccacataaccactattacacaagttttccttcttcccatcttattagattccacactgtgcatgaacaagccagaattctgtgtgttcagatcctgctctggcgcattcttgtacaattgctaacatgctgcttatttgcataccaggtgttccaggtagaaaatctggaacctatacaaagaggactgtgttttcagtcccgggagcccttcctctcataggagagaaatagaggtaaccaactgaactagaaaattcctctcaaaaatccttttaggccaggtgcggtggctcacacctgtaatcccaacactttgggaggccgacacagacggatcacctgaggtcaggagtttgagaccagcctggtcaacatggcgaaaccctgtctctgctaaaaatacaaaaaattggcctggcgtggtggcgtgcctgtagtcccagctactcaggaggctgaggcaggaggatcacttgaacccgagaggcagaggttgctgtgagccaagatcgtgccattgcactccagccggggcgacaagagcgaaactccatctcaaaaaaaaaaaaaaatctttttggatcattattaccatggcctatctgaagctctctctcttgagcaatgctgtgaggaggggcaaggaacacaattcccatgttacagataagaaacctggggctcagagaggccaaatgacttgcctgatgccccccagctgggaagtggcaaagcaaagctctaacgtcgttctctgattccaaatcctgtgctttagctgctccctgatgttgagtgtggtccctgaggagcagagtgtgtgtgtttgctgggagggaggatgggccgagggagaagaataaaacattactgattacttatctagtgcccagaattgtactggatgtgctatatttactgaatttgattattccacaatagcctcctcagtctgtggagtttcatattattatcccatttcacaggtgaagaaatagtttcagagaaggtgacttgcccaaggtcacatagctggtaacaggtagatttaaatctgggccctgactcttttcttttcttttttctttttttttttttttttttttgagacagtcttactctgtcgcccaggggcatgatctcagctcactgcaacctctgcctcccgggtttaagtgattcttctgcctcagcctcctgagtagctgggactacaggtgggagccaccacacccagctaatttttgtatttttaatagagacggtgtttcaccatgttggccaggctggtctcgaactcctgacctcctcagcctcccaaagttgggattacaggcatgagccaccgtgccctgccggactcttctcttgatcacacagtctaggacagggaaacgtggttaccagtgtttaaagggggctgactccttgtcaattgcagtcttgtaaataatgtaaaaggaaaaggcagcaggggtgccagatactcattaaatgttagcttattttttttcatttctgattcacacaatgaagtttattttaaaatttggaaggaaaacaggaataaatgctaccaagtgcttctttgggatgagaggtcatcttgacctgctgcccaagtgctcgtttgtgatgatgatgcactttgtgatcaagatgacctctcatcccagagaagccttgtagcatttactgcagaacaactcaatctgcaagttgttcttctaagacttagaatctagatagatctttttgtttgtttgtttttgttttgttttgtttttttgagacggagtctcgctctgtcgcccaggctggagtgcagtggcgcgatcttggctcactgcaagctccgcctcctgggttcctgccattctcctgcctcagcctcttaagtagctgggactgcaggcgcctgccaccatgcccagctatttttttgtatttttagtagagacggggtttcactgtgttagccaggatggtcttgatctcctgaccctgtgatccgcccgtctcagcctgaatctaggtagatcttaatgacagagatggaagatccctgggcccaaggtctgggtgggaccatctcttaaagtaaacgaagcctgcagcctgtcttctagcagctctgtgggccctgtgagtcattccccagtcctccactcaaatcctttactatcccacctctactttttatcagctcaggaccccacctgctatcttggctcatgggaatcttctctatcttaggggcaattcaaatcttactcttatctttacctataaagcattgtcatcttggcgtcttccctgacatggctgtgatttatagtgtgtgagcagttactaggtctgcctcagtctctctctctttctctctctctccctctctctctcacacacacataccctgcaaccccttgtttaacctggcctatatcctagcactgaacagcttgtctctgtttctctagcattttgcacatagtaggttcttaatgagtatttggtggataaataaatacacaccctgggactgtttttttttttgtcctgaggagggttatttttccctctcaaacactaagaaacaggagggctgggaccagggctgggaccacatgttcgtctgtatccccagacacagaggaatctcccagggtctagcacatggtcttagcaaatgtaaaatcaacaccctttaaaagagtacattttcctggacctgttcatacatttaatcaactagatccccaaatattctgacttgaaaaagattttcttactggaggatttagtgaccagtcgtttagcgcagagccaacagaatgaaacccctttctctcttccgggagactgacctgccctagagccttccccagaagctactctggatgtgagaagttactggatggctcaaatgggaccccagctggatggcgactgtcctgttgttgagggaggagggggtcaatttcctccacaaatctgcttcttctggatcgtgtcccacccacctcttggatgcctttgacatctttggaggcacccttgatttctctccttccctcagacccctcagtccattagcacagccagtcatatctagaagccagccacttcttagcactccattgctatcactgtggtccacgcccccctcacctctctcctgttatggccgtatctatcatgaaatgacctaaaccaattcatccacaactaggttcattttactgcagatctcagtaatctccagtaatgagtggtaggtaggggtgttgtgtttccttccacaaaccttgctatgagggggtctgaggcaagcaagtctcagactgaagtccacaccttgtaccatcacttatcagcaagcaggtccccaacagtcatataaccttctctatgagctcaatgaaggcctagctccctgaccttttgcatatttcaataaactttcctcttgaaagatttagttcaggctgggtgcagtgctcatgcctataatcccagtaccttgggaggctgaggcaggaggatcacttgagctcaggagtttgagaccagcctgggcaacatagtgagaaccccatctctaaaaaaaatacaaaaaatagctggacgtggtggcacacgcctgtagtcccaactactcaggaggctgaggtgggaagatcacttgagcctgaggggttgaggccgcagtgagctgagattgcaccactgcactccagcctgagcaacagagtgagactctgtctcagaaaataggggggagggatttcattcaaggaagttgcaaacaatatttaaggagcaagatttgaacaaccttcaatttgggatcaggcaactgcattcttactcagaagcttgaacctgaccagacggactcctaagacctagaccccatcaaaactccctaggtttttgtgtcctgtctgtctgtgtaagggcagaggtacttggacaacccttcacatatctaaaataccactcatttgatcaatggacaattatttcagccatccattttgctaatgaacagaccctctgctgctggaatggcatcaagacagctgaagcccttgtggaagggtctctggagtgtgggcttctgggtaaagtcccaactgcttctagaatggcctctctcaaagtgtgatcgtgggtctcctggggtctctgggatcttttcagagagtctgcaagggcaacaatatctcataataatactgagacattatttgcctttttcattctcattttctcacaagtgtagagtgaagatttccagaagttatatgggtatgtgatattgcaacaggttgaatgaagaagcaaatgtgagaatccagcagttttctattttgtttttgtttttttgagacagagtctcgctctgtcacccaggctggagtgcagtggtgtgatctctgctccctgcaagctctgcctcccgggttcatgccattctcctgcctcagactcccgcccggctaatttttttgtatttttagtagacacagggtttcaccatgttagccaggatggtctcgatctcctgacctcgtgatccgcctgcctcagcctcccaaagtgctgggattacaggtgtgagccactgtgcccagcccgagcagttttctattaagccaagctctaaagacatttgcaagcatgtaaaacaatgccactcttctcaataaatatttttgtcttcaaatatatgattatttttcataaaagtctgttaactaagccaacatataatggttttgtctttgcagtgggtaggaagaacccatcgggtgattacacttgccaagctttcagtatcagagaggaaggtgggggtgtccgtagggtgaaaatagcaccccaaatgtcttagatcctcatactttttttttgagatggagtctcactctgccacccaggctggagtgtagtgatgtaatctcggctcactgcaaccttggcctctcaggttcaagcaattcttatgcctcagcctcctgagtagctaggactacaggcgcccaccaccatgcccagctaatttttttttttttttgtattttttttgtattttttttttttgtagagctagggtttcaccatgttggccaagctggtcttgaactccttacctcaggtgatccgcccacctcggcctcccaaagtgctgggattacaggcgtgagccaccgcaactggccagatcctcatactttttaagaacaggctgctttcatcatcaagaggagctcttcatcacacttaaggtggttctgcaagacctctgggagaatcccagtgagctggggtccctgtgtctgtagaggcctggcatcatggtttacacaaaaggaacaaaagaaactacctgggaatcccttaacccttcccaagctctatcaactcaggtcacattgatgtctctgaagcatcttgtcataatatgaactgtcttccagagctatctttgtggctctcccaggctactatgggttcctcagaggcaggccctgaatgattagatgttcatttctgtgtttggaggattgttgggaagtttgtgtagggagggttctcatttaatcagtttccctgcatcttctgatctgatcagcccaggagaatgggagcttcagcaggtctgtgtgaccgcaaccattcttgtgttgctataaagaaatacctgagactgggtaatttataaagaggtttaattggttcatggttctgcaggctgtgcaggaaacatggcttctgatgaggcctcaggaagcttttattctcggcagaaggtgaaacagcagcttgcgtaacacaggtggaaagcaggagcaagggggaggtgccatacacttttaaatgaccagatcgcactataactcactatcacaaagacagcaccaagccatgggggacctggccccaaacaccttccaccaggccccacctctagcattggggattacacttcaacatgagatttgggcggggacaaatatccaaagtatatcaaagtcttttgtcattctattagcttcagcttactcaaacatctttaaagatgttataaggtgtcacattaatcagagagtcttctgaattctccgtgggagtgttaataactccattttacaggtgagagaatggaaggtcaaattcacacatctggagagtgtcaatgtgagaactgggacccaggtttgcctggaggatcttccactattgccctggcacctatactgagaataaatgttgtccctttgaaaggggcagctagttcctttgttcaccccagagactatgagaataggctttcaagtatttactccattaaccttgcagcccaaggctcagctactccaggaagagagagggactgggagtcagtatctgctttgagggaagttttatcactttttatagcaacctctgaacttgacccatggacttaggcagatagagcaaagccagtccctgcagtataaacagatgggagataagtcaggtcaatttgatttgatcaacacccctgattgcatttatttccttatttctaggctggctccagagatgctatccccaaatgggcctctggaggacaaatcttttggtgaacattcattaagcaaaataatgcacttatgagtaaagcacatggtgacttggatggtgtgccattacctccccaggacagagtccaaactgcttgccatgataggtgcatgtggtctggatcctgcctttccccacttcttcccacctggccctttgttcctggtatcctttctgcctggcactccttttccttcccttctttctgtttggaaaattggcctcccttaagtcttgtctgcttgtaacaatctctgctttaacccccatgacactctcatctcccctagttcttgaggtaccccaggcttagaggacccacagaccctggaatccatattacagcatttgtttcagtggattgggatcaactgtttgaatatttaccctctagatcagtgttcgtatgggagggatactgctccctaaggaatgttttgagctgtatgggtgttttgtggatgcaatgacaagagggtactatttccacttagtgcctgggttttggggatgctgatgttctgtaatgccgggacaatcctgcccactggagaatgtctcatgtcctgcaggaccttgaggagatcaaccagatactcctgtaggaaacaaacctgtttataatgacctgagcttggaacccaactctgttttataaataaactcctttttgtgtgatcttaacatatgttcagttatccaggaatgcaaatcaagggaagactaaaatttactttgttcaaaactttaacaagactcgatcaccattttggaggtaacatcggagatggcaacgtgacttgtgattgagaaagaagaaattaacccagatgcctgtggcaactaagaattttgcttgatgtggcctggtgcagcagctcatgcctgtaatcccaacactttaggaggctgaggcgggaggattgcttgagcccaggagttccagactagcctgagcaacatagcaagaccctatctctacaaaaaattaaaaagttagctgggagtggtggctcatgactgcattcccagctacttgggaggctgaagtaggaggattgcttgaccctgtctcaaaaaaaagaaagaaaaagaattttgcttgaccccatacaacacacctgtattcatctgcatttgtgaacgtcaccatcactgtgattcatggtctattaacatctacttttttagctcttatttttaaatgtcaaagataaaaactgtggcctgaatattatcatacctctctcaaatccaaacttacttgttataagtaggtgcaagcatgtgactgcttcataatgtcttttagagtttaggcctgagcatttatgtattgaaacccattattttattacagtattccttttatttctctttcatattacagtagcagcattatattgattttgttttttcattatgtgtataagtggtttagattatccatgaatttcgtttcagtatggtaaagaggatattcaaaatatttgttataaaaagggagcatctggcagcattgagaaccactctaaggttcaggaggcagggacttcgcctcccctgggttactccattcttctttgtgcctagcatagggcctggaatatcacagatgcacaaagaatcttttctgaatgagtgatgaaggaattgaggctgatactctggtttggtaaccacctaggtatgtgatgaggccctctgctgagatgggaacacaggagagagggcaggttttggggagagtaatgagttcagttttcattgtgaaagtttggagagccctggaatttctaggtggagaggcctgaggcccagggctgtgtgggccttgatttctctcaaggccacagaagagtggaaagtgcaaagtcgtagtaacagttcatctctttagtcagtaatcattgctgagtctctccatgcaggatgaatagaccagtgagagctgcccatgaggtgtctccctcctcctgtggtgatctgtgtacctgcccaggccctcagaggctaggagctcctccaaggtaggggatagaaatccttcatctctagcccctctgacttcctgccccatcctgacatagtaggtggctcggcaatgatagctggagggaccacgcagtaaaacccatctgtggaaacacatgtattcagagcaactttttttggcctgaagtcactgcagtggaacatttgggagcaagtttccccagggcccagctccttcccgctaggctctgccatgcctcctgtttattaacagggaggcgtgacaaagggaaaaatctcctgattgaagactcatctcagacatcttttcactcctctagggaagggtgcaattctgggctttaatgacatatgacggggcaggcagtagaggtgttgcgcattttaggcaatacatgtgctgctagaaagttgaggtatagggactttttaggaacacaatttttattgacaagtaacctttcaagaacaataaagaaaatcagaaagaaaacctatgttcatagcagcatcattcataatagcgaaaacaactcaaatggccatcaactgacgaacgtatgaataaaatgtggtctattcatgtgatggaatataacttgaccgtcatgaggaatgaaggactgatgcatgctatgatatggataagtcttgaaaacatcatgctaaatgaaagaagccagacacaagagaccagatattttatgactccgtttatatgaaatgcccagagtaggtgaatacattgggatgtaaaagagattggtggttgccagggtctgggagaggggagatggggagtggctgatggaacaagccatatggaaaagcattccaggcattgggagcagtaagtgcaaaggccctgcagtgggaggaagcatggccgattaaagaacagcaaggaggtaggtcggcttcaagggagacagtggtgggggagaagctcagagaggggctagcaggactagaccctttagggctttatggggcactgccagggcattgccttttacttggagagagacaggatgtcgctggcagctttgggcagagaaggatgtatctgtcttatgtttgaacacaatccctctggcaggagatggattttaaggggtagaagtagggaagccagtttgggggccactgtgttggttcaggcaagaggtaactctgacttggaccctggtggcagcagctgccaaggggaaaagtgtccaaaactgaacctattttgaaaacagctcatcttcaggcttttggcctcagcaactagaaggctggagttgaattttattgggtgggggaattctgtgggagggagcaggtttccttctactctttgttcacatataaaaagaagttataagagaacatagataatagtttaaatttttatttttttctgaacattcaaccataaacatttatcaagatgctaaagtcttcataatactcactttaaaaatgttttttttggccaggcgcggtcgctcatgcctgtaatcccagcacttgggaggccgaggcaggcggatcacgaggtcaggagatcaagaccaccctggctaacatggtgaaaccctgtctctactaaaaatacaaaaaattagctgagcatggtggcgggcgcctgtagttccagctacttgggaggctgaggcaggagaatggcatgaacgcaggagaatggcgtgaacccaggaggcggagcttgcagtgagccaagacagcgccactgcactccagcctgggcgacagagccagactccatctcaaaaaaaaaaattattttttaattttatttttagagataaggtcttcctctgtcatccaggctggagtgcagtggtgcaatcatggctcactgtagcctctaactcctgggctcaagtgagccttccacctcagcctcccaagtggctgggactacaggtacatgccaccatgcctggctaaatttttatattttgtagagactatgtcttgctatgttgcccaggctggtcttcaactcctggcctcaagtgatcacctcggcctcccaaagtgctgggattgcagatgtgaaccaccatgccaggccattgatcacttttgaaggctgcatgatggtccacttcattcatttcccctaaattacataaccatttcttctgttaatcatttagactgcttttttctctttttagttttcaaaattaaggataattgtataatgaatatctttgtgttgatggctttttctttctggatttttttccccaagagtttaattctcaggaatggatttactaggtgaaagagtaagaacagttaatgtctctcttaagacacattgctaaactgttttccaaagagattgtggaaatgtataaggccagccaagcagtgcgccataaattggatggtataaggcattgcattttattaatatttttaaataaaaataattttttttagaaatttgcatgcatttgactattgttaagattgaacatttatttaaaagtttatttggctgtgaattgattattcaggtccttttcccgttttgttttgtttttttttttcccgagacggagtcttactcagtcacccaggctggagtgcagtggtgtgatctcgcctcactgcaacttccacctcccaggttcaagtgattctcctgcctcagcctccccagtagctgggactacaggtgtgcaccaccatgcctccctaagttttgtatttttagtagagagggggttttactatgttaaccaggctggtcttgacctcctgaccttgtgatctgcccgcctcggcctccaaaagtgctgggattacaggaatgagccaccatgcccggcctatgttttttgttttgttttgtttgagacagagtcttactctgtcgcccaggctggagtgcagtggcacgatctcggctcactgcaacctcggcctcccaggttcaagcagttctctgcctcagcctcctttgtagctgggattacaggtacccgccaccacgcccagctaattttttgtatttttagtagagacaggctttcaccatcttggccaggctggtcttgaactccggacctcgtgatccacccacctctgcctcccaaagtgctgggattacaggcgtgagccaccgcgcccagtccccttttcccatttatttactaaagtcctaataccttctttaccaatttgttggatcttttcctaacttagagatagggatgaaccctttgccaatcatatctttaatgaaaataatattttaaataaagtaggaaaactgttgaaatgaatttcttttgtaacaaaaaataaacatttggtatgtgaataatgtatattctgttttgctgatttattcacttaaaaattgctatcttgattttattatttatttatttgacacagagtctcgctctgtcacccaggttggagtgcagtggtgcgatcttggatcactgcaatctccgcctcccaggttcaagtgattctcctgcctcagcgtcctgagtagctgggactacagatgcacaccaccacccctggctaatttttgttacttttaggagagatggggtttcaccatattggccaggctggtctcaaactcctgacctcaggcgatccacccacctctgcctcccaaagtgctgcgattacaggagtgagccaccgcacctggcctcttgattttaaaatctttttttttttccttagagtgaagcacacctggattggatagtgcttgttattacagataagggtgcactttctagattcttctcctgagtggcaaagttttcccaccgtcttgtccaaacatactttgctgatggtatctctgggcactacacagtgcaagggacaaggaaaaagggcttttccagaggagagtgacctgcatcttggaggaactctagaacatgttcgaggaatggtgactggggcttctggagccaagggctgactcagggaacagatctcagctcaaggtgaggtcatttctgtttcctgcatgtccctccagctgctgacattttacctcttcaaggactgattcaaatgccatctccattgtgcaatcttccttgatcaccccccaacttccatctgagacttctgagtttctccctcactagatctggagggtaggagtgggtcttgttcattttttgttctcacagtgcacttgctagagaatggcttgggaagcctttgtaggattggactggccctcagcgaaagttcagcagttaggagaactgccttagtacttaggaagcttcctagtgtgaatgccagcatcatcacttactagctgtacttcagttttctcatagggttgttgtgaagattaaatgaagactggacaaagtcagtcaatgtttatttcacaatcactgagcagcaagtattccttgtgtaccagtctctgttccagaaacaacgtcataagagatcatcaagattatctctggacttaaggcatatcttctctctatctcttttgagacagagtctcgctctgtcacccagactggagtgcagtggcatgatctcggctcactgcaacctctgcctcgtgggttcaagcgattctgatgcctcagtctcctgagtcactgggatta

SEQ ID NO: 40 - DNA, 257783 bp, Homo sapiens
ttagagttgggtagataatgcatgagtgtgggtggcttccttgagaatttgagaatttaactctgattaaataaatgtcatatattttatgtaacatttgagtataaagtttggtatttgacattccaggagcttggacttgagagagtgtttaacatgaagtgaacagattctacatagtgtaaagcctcctatcaggtaagatgatgcgaggcactacaggtgcctgggtgatgatcagtggtgttggacaggaagtatctttgagctgtgccagtggagaattcttttttggttcctataccaagcaggaaaggatgatccttaaggaaagtactttaaagtctcttctatcaccactacaaaaaagaacagtttgtttgagcataagaatgctccttccagctgagacagcacagacagaatgcccaggtgacccccagctgtgacagctgtacacagccctcccagggttcatagcaaacagccagtgctccaagactactttcatcaaatactcagccaaagaccaaggctctgtaataagggccctgatacaaacagcagagatcccagctgagctataccagcctacaaaggctagtctggatttggaaattagcaagaatgagacttggattcagcctaagtagcttgtagtttggttaattattgagctacaaaaacagacagtgcaaaaataagggtacaagtaagtgagtgtatgcagcatcttcccaggacctcccaggttccacacagaaatgctcccaaattcggtaatcaatactcatgcctagtgggaaactcaccaagtcagaacaacaaaagctagactcccagtggtgaggcctaaggagctctcaaatgtctattccccgctatttttgaggcctttactgcatgccatagttgcacacttctgagcattggcctctgcagctggacgagccatggctttccatagaaccacagattttacagagagggaaggactgggccagcaaagagcctccttgtgcggccacattaggagttaaaggtgctcaccacttccctcatgaggaagaagcatgtacggacagaaaaatctcttcatatcctttatggtttgttttgtatggattctgtgtactataaagcgaataacatttttataacagaatgtggattgcaatatttccaacaaatctttttgttcttttcatatgtttgtgagttaaaatactgcatccaggtataaactcacacaggcagaagtttcctcgccatcaggtcaagatcctggatcccaaagagggcaaaaatgacaaggctttttggtgtctggcatggacttaattagtggtcacttttagattctaaatctaagttttacttcagcagcatcaattaccttttgtctagtagtccctcaggtaacagtattggatcagataatttctttatgtttggtgttttagggaatttctgaagtttggttatctgagaaaaggcaggatatcaggatgatgaatagcacagactttagggtcaggctgcttgagtttgaattcgagcgtggcattttctagctgtgtgaccttgggcaggttgccaacctctctgtgattcagaaatggcatctgccttatttggctgttgtgagcattgaatgagttgctgtgttttgaaaattcataacagtgcctgacatgtgtttgctattattatttccaaacacaagactcttttgtgaagggcacagtattatctagactgctcagggtttgcctgcttctgtcatatagaatttttgaaaggagcttgtttcttaactagctttatggcaataacactgtctgtaaccactggaaccagctgatgcattatccataatcctaatagcaaaatacagattcaacgtcttttactttcttaacctcatttttcacagtgttacacgattttgatgcaggtcttctcagttggtcctcccatttttcagacatgtgatcaatggttaaataatgacgtaggggtcccttagcttgtggttgcagcctgaatttgaatatacacgtctttaggcacttagctctaagaagtgtccagtaaaacataatgttcagaagtaaatagcatggaagaggtctctaactcaaatcttgaaaggtctggtctgcaattgtggaaggtgtcttatcctttaatgacacttgtttatgagttgggatcttcagcatagttttggtttttgcttttagaactttgaaaaatctatcagctgtcacagatacgatttttgtcatctagctcttttgagctctagggatctgccttttctaaatttcataatataatgtggctatcagttctcaccaatgaattgaaattaggcttttcatgtgcacaatgcaaacatgagaaaccgtagtttgttactgagtaatgaaatggcaaataatcagttcctggaagcttttaggagttgtaccatgcaagatatgactacaaatcatagcctgagtgcctggacacagtgattttcatacccagccatgtatcctgggtagagcctttaaaaatgtggattcctgggtccattcatgacttgggaatccatatgtcttatgaacagaattatgtaaaaaatttcatagtgattctgatgaaccactttcccaaatgacacattaaaataatttcaaaactctagagtcacatttcaaatattaacattaaagcatttggacactggtaggaacttacattctaccattttacaggtgaataaattaagactgggaatggtgtagcaattttagggtcatagaggtttagagcaaggagcaagtacaccaattatctgatatgtcattggcgctttataaatgaagaaaatgaaaaccagtgcagcaagtaaagatagggctgtcatagctccccaatgcagcaacgagagctatagcaagaacagactaacagtcttacccaagagtcgtgggtacatcaatgaagacggcaattagagggtaaggcctagggcctatatacccatccagtggcctacacagatattcgaaagttgtcttggaatattatacaattagagaaaaaaattaatctgagatgtcatctgagtttggagtgatcttgttgcttgttaatgggggagttaacagagtggagggaaaaaacatttggctgagagctgggagatctgagatctcttctcatgtctatcattaattggctctgtggaaccgtgtgtaagtcacttaacctcttctagcttcagcttccctatctcagaaattacagtgataatgtctttactaagtatttttcagaattgttgtgagtatacattttttaaatgtacagaaattttagattttattgtactaagatgtgtttaatggcaaaaactaaaaggaaagcaaatattagtttttcttttcccaggattccctatcaagggaacattttgatgaggaactaggtctaaaactatatttatttcttttttttcctggcccttatgttaaagattaatttaacaaacattcataaaagtgcatattatgtacaaggtgctgtcttgcactcaaggaataggattttattaatcctcttacatcagtcagagtccaaccagaagacagaaaccacacagtaatttgagtagggtaaatacaatataaagcattagtggtgtgacaagggattggagtaatgagggattggctagtaagaagtaaagagaactctgaagaatagaggagtagcaagtataggagcactcactatgcccaggctgagatagagctttcaaggaagaaataggtctcctgtacccaggattaagatccagaactcattaggaagtgcataatcatggctcactagatggtagaggagacatcaaagtacctcactggcagaagttactgcaagcccatcttctggagtgctggagaagctgttcacagagatgggctgggcctccgaatgtgcagcaatactgtctcagaagttttggggaagctgctgggtgctaggtggggctggccacttcatgatgcacaaggtagtactagagaacccatccatggtaagggctggatcctggaaagaccacatattgcaggagcctgttgagtgcagtgtcttggaactgggtgggaaaccactgaaaatgtctttttagtgccctttcatgatggtgctttgcttacaccagctggcaaagagaaatatttgaagggccccgatctatttgtgcacaacagacaacaaagggtgaatatggagcttcaaaatcaaaacattgataactggaacactttttaacagttctgtgaaataggtactattattatccttattttatagataaggaaactgagacacagaaaggtgaaacaacttgcacaaggaaggtcacaggagtaataaggagcagagctagggtttgaacctgagtattttgactccatagtctactctgaattcctcccctgtgcggcctctttgtctccttcctcaccggtgatgcatggtcagtgttatcttgcattatcctgtgactttatatgcaagtcccactacacttgaagattgactcttacatttacagacatctttaaagtcctggaactatttagcacaaagttttcttgatactttttctgccttaactatttcttctgcttgtttttgatgtttcttcaatttctgctacaatcatgtgtccaacccaaacctcaaacctactttctttttagatttcctgatgcaggtaaggaaggaaatgtgaaggagtggtttgatcttctctgtaacatttctctgttttctgctatcttgccacactagttcagacccatagaatttcttgcctatgaacacggcctgcctagcagtctgtctgctgcccatttaaggtccggttcatccggaacaccatcactgcattagccttcctgaatagctgccctggtcacatcaccactctcctcagtaatctccaatgcttccttaggcactgctctattaaagactattccctcagttcagcctgcaaagccatctacattgtggtcctaagtagacagctttccagccctagctctcctgtcttctactagtgcctattcttctgcctgaagttgctattcagtgtttcctcaactttgtttctgccctgcccctgcttcatttcagggatgcattatgccaggggcttttctgtccccatgtgtgtccaatgtcacccatcttagatgtccctctttccacaaagcctttcccatttccaaacaatcttgttctcttttgaagctctagaatgctatatttttctcttgtagtattgcttcttaggatagcagtactattctcaacctccaccctattattagatcacaaattccttgaagactaaggcaatattttactagtttttctttctttcttgtttcctttctttcattttgtttatatataattgtatttttttcagtctgagaggccactaaaataggtttcaaggtgtggattttcagtcaagttcataagactcaattagatttactgagcagaaattttacttagaaaaaatgtagaacagggaactcacctatgtaaagcagcatcatcacagaaactgcagccactcaggagcagtttctatctcttagtcatggctgggacatgtttttgtctaagattaatagtaaatgaatggagaacaaggcctatcagagaaatcacatgctctgcattcccttgatgctatggactgaatgtttgtgttgcaatcctaaccccctaaagtgatgatgttaggatttggggtatttggggtaattgattcatgaggatagggttctcattaacaggattagtgccttttcaaaaacagacatgaaagcttgctcttgttctctgctctgctaagtgaggatataatgagaagatgggcaactgaaaaccaggaagcagatcctcaccagacaccggatctgctggttcattgaacttggacttcccaacctctagaactgtgaaaaataaatatttgttgtttgaaccaccttgtctatggtattctgttgtagcagcccaaacttactaaggcattcagtttgaatgccctgctagctacacagccctgcaagagtaagggacattcactaccatggtatcctgcacacagtaggggatcaaattttttttaaattcaattttttgtcattttttggttaaatgtctgattttacagtgcactgaaggtcagtgttttcctcatattaagtgaatgccaggtctctgacctactgctggcttgatactttctatacgtacccttaactctctgtttctaattctcagccccattgagacctccagtcactgcttggttttcaaaactttcctaataatttggactcattttcagtgccaacaaccttcttgatctttgaaggcttgtcttaacctcctctccagttctgggtcctttatattgctctataatttgccccagagtagcctgactggccaatatagtcatttgtgagcaatataccatgagaatacctatgcctagaaataaataatagacctcaacattgcagactggatttctgagccactcagcaggggttcctggtagaagcaataaaagaaaaacagtcttaaaatcacattttttatattagcaaatctaaatctaggggatatcagagtgtgtacttatcagataatttccataatactttttgtaaaacttgtgcccattaggtttcttatgtgattaattggagatttcagtttgcattaaagttttgcatacactgaacattcaatcattcaataaaagttagttaaataactatgttaggcacatgatgttctgttctcaattactagaagtgtcattgtttgctagaaaattgactctgaggagcatgcaggtgtttctgtgttctaaactttgttgtgcataaaaaccacttcccatgcaaattaaaagtgtacatttctgggaaccattttgattcagtagagacagaaatgggcccagacacctgcatttttatagtgtccatatggttctgatgtatgtgatctgaggaccatacttgaaaaaacaataaattagtctttaccaaaagcattcaagagtttcacagttttagaggtactttctgagttgaactccaaaatatccttgaggaacttagagagatttttaaaaacaattttattgaagtataatttatctattataaaatttacctattttagtgcacaattcaatatttctaatacatttgttgagttgtgcaactgttgttgcaatgatttttacctcctcttccttgcctggattgaaggaattctgttactccaagggaagaccaaagagtcaaagacccaagtttgagttttggctacatcatccagtgtcctgagacctaggagcaagggacatgggtctttccatgtcttagtcacctcatttataaaatggggatgctattaatatttcctttataggatacttgtgaagattaagtgagaaaagatgtttggagtgcaatttgtaagtttattcaactatctagtgaatgaatacctacctttggttgcttacttgctggtctaggaacagactattaatgagtaaagacagataccatctctgctctccctgagcagatagccagtagggacagtgtgtgtttgatgagaaaatacagcaaataaatttgatttgagtgggaagacaggatcctgtttaaggaagtcagagaagttttactgaaggaggtgatgtttgagataagagctaacagattaactggcattaattaggcaaggagatggtggtgctagcatatcagggggaaggagtgagggccaatgcagcagagggtacatggaacattacaagtatctgaacaaatgctagggtagctgcaacatgaggctcaatgaagagggtggtgctgggggcaggcaccagaccctgcatgccctgcagctcatgtgaaggtttggttccaatccctgaagggctttcagtgtgtgtattttcatgagcatgggtgtgacatgatcagatttgcatgtcaagtgcccaccccgggaagatgaaaggggagtaggatgagggcagaggtcatcagaaagccaaatgggaagctatgcaacagttcaggtgagagacaatgggctaaggtagttgtggcagacctggagagaggtgggtgcagaagaagcagatttaagggatgaaattgattgggtttagctatgggttatatttgggggtggcgtggggagaaggaagtgtctgaatgactattagatttctgacttacataattgaataggtggttgttaatacattagggcatggaacacaaagatgaagaatttgaaggtgaaggggtagatcatgagtgaaacagaagcaaagcatttacaccagtgtttgacataaccagggatagccactatgatgatggtgataattttaagatgtcattgaagcatcctagtgaacatcttaagctgtaatgagctatactattattatcattactttggtcataaaacttggcaagcaatattttaattcatgttttaatttcttaccgcatatacatcaaaatcacttataacatgaatccttctagtagttcccccagtggtataaaagcaggattttaccgtattacataggtgcacatgtttcataatcttctaagtttattgattgaagctgaaagctgcagctagatcattcctcagagtgcctctagggagtgttacattagaaagataacagcaggcttgtaaattagtacagtttaccaacccacaaacatttgtcaccctctcccctcctcacaggagaaaataagcagtctttcctcagcacctcctgcctcatgatttgtttggcataaattgctacctgccttgtggctgggcagtaagctaatttaaaggctgaatgagaaagctcagaaaacagccagagtgttctattgaagtagacggtcagtcaatagggaaaaaagggaataagctgattaatgataaaatcaggaacaccctttgaaaagaatctttatgctttgtcaagctaatttcagtggatctcatatcactggtcacctggtacccatccaatattcctgatttcaagtttagacagttctcagtatatcactgtcaaatcatgactgatattcctttcagtggaacaatactcagataattgcaatttagcttttctctctattataaatttagttgtctctttacctgtgcaacaaaatcataattagatgaatacctgcatatttataggtatatttcaacccaacagacggtctagacattttctgctaacaaactttgattgattgttaagggcatgtggaatcagtagttggctatgttgagtacatctctgagctttgctttttccatctgcaaaatagaaataatattatctccctcatagggtaattgctggaactaaatgaagcaaatatctgtcgcatatatctgtaaaattctttgaacagtgcctcttacataaaaagcattcattcagtgaaagctatattatcgttaaagagttccttctagctcagcctggggagatagtgtgtaaccatttctccatccttggataaacactgtgggtggagtttgagtcagaccaaaataaattgcccttcatttgtgagatctcatatttgctaagcatctttttttttatgtcttgaatgtaaatcctggagttcagaggctacagctatttcttctataaccccagtgtctggcctcatgtgctgcaaagggtctaagttcaatcactgtttgttgcatcaatgaatacatagcacagtgatctgaagtcttttcattggccctcaagtctctgtggaaggaagttagggtcttgtaaaaggaaagatatcagtctgagactattaattttatgcctatggtcatttggggaggcgggcacattagaggaaataggactagatccatggccaaagataaagctcaaacacaatttcttgtggcataatccaaacaagcgatattcgtaaaaacaactccatatctgtggatattttcttgtttttagatgaccaaatttgtctgaaggaggcatgaagcaccatgaagtaaaaattctaacacttggtgtaattttgatatctttattaaatgacattatccattagtgcatgactgctgagcctactgtttaccagcttgaggtgaactgcaaaacttatatatcttatttaaaaattaaaatgttgattctacagggttatcaaagaatctaagacatgatgatttcatattgcaagttatgtaaatggaattaattttggaagacattttgtacaatttaagtagcttatttccacattaataaatatgatgtggtggctaggataaacaccttgctttggaagagcacgtttattttccaaagacagtgttaacttgtgccctgtcatagagagtaacgacatatgtggaacatctattctctttatttctttcttcttttttctctctctggagactaacgtcttcatttacctaaggtctccagcaattggaggcaatcgtaaggaaattggtagtcctctgattcttctgctccattgtattcccccttctttttctgagtgtgtgcttgttagggagcttgcaaggatctacagtgggcagaagcttgtgtttcatctgagagaggagagtgacaaaaggggactaggaaagtcaggcgtgacatgtctatttggtgtgatctgagtttcttcctgtgtttttcactatgggcttcactcacacccatgaaacagttaacacatgttccaacaaaagcaaaaccaatgtgaaaaatgtctcatcaatgcctttgtgtggtgagcaatgggaagctgggcaacaacattttttcatgtagctgagaattagcaatgattatttcttcttaaagcaacatctgcttaatgacagctcttttaaacttcatcaggaaaaagtgagtgaaaaatcctgttataaatactacagtgaaagattctatttagatgttcactgtttcaaagtcactagctctgagctaatcctaagcttcagaagcttactgtgcaccctgacatgctgactattcaaatgggtctctctcaagatggctgggaaaattgttcatatacaaaggagctcagctttagcacctagtggggctgaaagccaggtgtgacaaagggtgcctggggaggccagagagataaacttgacattttgcccattttcaacattgaaatgactgtttataagtcaatgatgaatgtaatcatagtcttaattagtaattactaatgtttatcattatacacaaatattaagtgaaatactttcacaaacattattttatataattttcacaactaccttctgaggtaactaatatgcctgtctcacagatgacaaagttgaggcatagggaggctgagacaattatctgtagtagaatttgcactcgaatctaagattaaaaaaaaaatctacatgttctgcacatacaattctagcattagccccactaacatatagggccacaggggaaagtaaaatgttttaaaattttttaaagtttggtgactgaaggaatattatattttggttttaggtagaatgagaagtgtgggcacaaaagcatggaaagcctgctcctttttgaagaattatacaaatacatagtcatataatgtataggaataggtaacttttaaaaatactttatatgcgtatgttcataatgtatgtatttataaccactatcaatattaatttaaatattctgttataggttcaaactgagggattagtatatatttaaggcatttgccactctacactgaaagtatagtctctctcaataggcacttgctttttggctccaattcattttaagtttgaacttctgaacccttccattggaagtttccatttattttgtcatgggctcttgggaaataaatacctgtagtatgctgctactagtctgatcttctctgcttccctgaccttggatcaataaaggaggggtcaaagtagatgttctccactttgcagaaaaaccttattttaagtagaacaatagagcttggtttaacctggaatccaaaaagaataggacttgaattacaattacaggcaagtcttctaaaaaaattaatgcattatgtatagcattaaagaattattctaacccttagtgataacaggcaatctggggcattactcatatctcatttgtaaatacttgctatttttccaggctttgtgttggtgactttctgggttaattactgaagagtctgttttcttttccatagaggccacaactcttgggacagaggctgccagccacaattttgcatttcctttctgcatgtggaacctgtcctgcctatgaatgttgtcccagcctttgatttcagatttctgctgcatgcggcctgggctccactgctgtctggcaccctgctccctctctcagatgtgaggctggtgtgtacagtatagactgaccctcattcaactagagaccttgacatatctccttcactctgtaaggagtggagatgaacagcctaatagtagaacaaaagaagaagctgcacattgtacccaaaggatttggggaagacttttccacctctcttccaaccccctggccccagtgaacttgtagactatatgtcaccatgcgttacttttctggcaccagtatactacagcaaataacaattatttctgttctgatgctgaattagattcttagctttaaatcctctcacacacagcaagtttgtagaccctactgaagattctggcacaatttcagtcctggtgcaggcagcttcaataagacatggtccaggggactgaattgaaggcatattttcttttatcaaggttgactgaaagaaagtagccaccgggaggttctgacaactcaggaatggatgaccctgcccagtagctctggcccttggcgctcagccagggcagatgctagagatgagtctcactacagctgcagatgccaaagctcaagatgcataatcctgagcttgacagctgccaaactagccccctgagtgtccaaatgagttggctcttctgaaggagatgacaggaaggaaccagagggattgctgtggctcctctccaaatacagcattaaaaggaagccaagagaacttagcaattttgcctgtattgtaagaagcgcaaagaatcatgtgataatcttaaccaactgttatttcagtggttggaaggggttatgagctagatcccttatatttttgtaaccctttttgaattttaaaacattcattaattccatcatttgacaaacatttatgaaatgtccactgcatgacaaatagtgagaacacagaggtatataaaggtaaaggaacttaccttaaggaagtgactcttaatctttttgaacacagtctaattagaaggggacaatactgtggctcatcaactctagcctttccccttttggtaggggatatttgagagggtgattatgatgaatttactttaggattagtggttcgtatttgaatcatagtgcccagtctagtaatttaaaaactagaggctaaaatgattttgatgcaaatacacatttcttcatactataaagttaaccaagtagcacaaagtaaattaacaactagaaagttaaattaatagtatttcttactaacggtaacaaatacaaaccacccccaatttattgtacccataataaagtgttttctcccaactgcaaaattctatctgcttatgcatgtgtagaaaaggagcgtttccatgttgaacagaattgcatggcagccagacttcttagcagaaaaccaaattagaattctaactacattcttagaaacagtaattttcatttacaaacactaaatgttagaaacttatgacacactggatatattactagcaagtaatccttagtggtacaggaagatgaagctatacagtatcgaccctcagtctctctaaggacctggaaaaaggtgttctttctgagtgtgtacagagtcaatatgagaattactaaaatagaaatatgcatgtggaagacatcatagaagaaggagggaaaagtgcccaactacccaagtaatgagagaacgttacttgggactggtggtctttgaatggggtcatgaacatggaataggaattttacaggtggatgaggatgcaaaaggaacagtccaggtgcaggaaacagaatatatagggatatcacagaatagaatgaagggatatcacagaatagaataggttctcagtctcttacctgcaattctgaattccccacatctttaaaaactgaagggttttcttaactcatgtggcaacaaaattgaccttacgtgttgtgaggctacatgtagtttctacttatcagcattaatattcacatatttggttgcagaaatattaaagtgttgattacaatgtataccagtacatcctgctggaggttttacttaatagatgctacatgcatctatttctaaaacctgaataattttgaattccaacacacctggccctaagggcggcaggtaagggattgtatacctttgagtagctaccaacattgcattatggtttgggggaacaaggaacatttggagatgtgattagagataggatgaaaaaggtaaggaggagtcatctgaacctcttgaattccctttgagctctccactaaggctttcaagagaaccacctatgtcctatggtttgtcagacttgcctgcgtcttgctccatgtattcgttttctagggctgccgtaaaaaagtagcacaaacttggaggcctaaacaacagaaacgtattgtctctcagttctggagactacaagtctgaaatcaagatgttggcaaggttggttctttctcagggctatgagggaaggatctgctccaggcctctctccttggcttgtagaggaccatcttctccctgtttctcttcactttgttttctctctgtgcatctctctgtgtcccaattgttcctttttataaagacataacagattggggtctatcctaatcatctcatctttgctaattacttctgaaaagactctgtttccaaataaagttacattctaaggtactgaaagttagaacttcaacacaagaattttggaggtacaaatttaatccataacttaccacatcttgcctgccttcaatacattctgctttttatattagtaggctgaagctataagtgttgcttctccttcatagactctctctctccgacatttttaaagccttattatttgggaaacgtacaagttatttttctcatttaaaaaatcctcacttctaaggatgattcagagaggttcagtgacatccttgaagttgcacagcgaatagcagacttgggaatcagtctcaagtgtttctactactatggacaagcatttggcttttgcccaatgcattggaaaatggttaaaacaaaaagaagagtccattccctgatgctacctcaggatggtagataaaacttcatatcccccatgtgctgtgtgtgtcatgattgtggacttatgaaagttatagggtctatgttccaagtgggtagatcccatcatctcattggtcttttagactcttagcttgtgagataatgtaagttctgtacatctctctgatccaaacagacactgtgcaagactgcatattaattttttaaattgcatgctattctttttcaccaagcggatgtccatctccactccacttcctgcccctccactcacctccccttgctacaagtcagtagttcagttgagatgatttaacccagattacacactctaaaggaaatttactttactgtcttagtttccaaatgttttacggtcagtttaattcatatggcccatatgtcttctgtcccacacagaggcagctgcatacttagtgccttttctcccttcccaaagaacattagaataaacagagcgttgcagaaagtgatgcctgtgtgtatgtgtgtgtgtgtaagagtgcacacatgcaagagatagtgagactaagaaagagagattatagtttacaaaatgctttccagctaaaatgaccttttaaaggaatttctaatctagctgggctgaaaatgtttcccatgggggatgattgtaagtgaggcaagaagtctgcatttctgggcagatgtgtgtctaggtgggaggtgggataaattagagaacagttctgcagcatgtccaccagtctgtgtgattttgcttcatcatcatcaattaatatttattgagggatagatcatgggacacatggtactgtatgctgctccaaaggctaatattttatctcctgccatggattcctggagagcggctacatttcacagctaaattgtggatacttgaacagttggttaaagggattcattcatgtgttgtttataaaaatgcttcacattctttggaatcaagaaaagcttttatgaatcagtataattttagctgattatcacagagaggaagagaaatgtatatattgcaccaaaagtagtttgctttaagaatagattaataacacaactcatgaattccacattactttttaccatggtgttctaaagggctgtaaataagacctaatgcataaatttggaatcattgttgagaaacgtttttattgcaggtgttatcattttcctcattcaacaattggtaggcctgagcgttttaatcacgtctgtaaactcacatgtggaacatgaatctgatcacatcagccctctgagccaaagcaaattgaattaaatactaatttttcttctgtatggcccatgggttactcattactctgctatcttacctaactctaaatcttcccttcttctgttcttaccacctcatgttcccgcagcctctcacacactcatgcatacctatctggtgtgcatgcaccaacttctgtcttagtcatatatttttctgccaccaaaccttcgatttgattgtttactcatctgtaacaccataggctattattcaaatcctgcttgcttaagtcttggacatctttaaggagctattcaaatatcaccagttatcaagaccattttttgatgtcctttcctttccatcattagtaacctctctatttttacctctttagccattactcatcagttggatcgtctactatatctctttcctcccgcctccgcaatttctcatgctttatctacttgggatttgcttattagttgctgaatatttcatgttactggctgggtgctctcgtaccttaaggcaatagaatcatcaatcaataagaaaccagttactcagaatatttgtttcgttgtctactgtgaagtaataaacacaaagagcattacagtgagcatcaaatgatgatttaatactgtttttgctgattaggaattaaattgttttgtatgaaatgtcatttgaaagtcttcagatatcacctggtgctcaaggatatcttgatcctgctggggtttccattaagttgatcaataaaagtgatggttttgtcctcgaggaacatacttgcccaaggccaacagcagaatgggggaattgcttcatctaagttattcttgcctttattatatactttcagttattaagaggaggtagaactctggagccttttgagtttagaactttagtgagaagtggagagggagagaaaaagaatgaatctcttgttacttattcccactcaaacaggtttgcaaagctgtttattaacaacaaaatcatgaacgactatagagagagccaatgcccagggtgcagaaggtggatggaaagaaagagggcagatcttttcccttcatgatgtgtggtctggccatcttaggggcttctgtttttgttttgtcctttagggtttaattagataggattcatcattgaacatctaagaaagcatgtataagtcaataaattataaacaaacattaatcaatggattgatccaatccacaaatgtactgagcacctactatgttccaggcataataaagcaccaagaacacaacagtaaagaagatagatgtagcatttgcctttgctgagctagcaaactagtgtgcatagtagtgactcagcagtgagcaacagtggcgggtgactaggctgttacaggggaaggacagggtgttgcggggccacagagaggtacctcacccagatttggaggctcagaggtagagttgtctagaaattgggactaaagggtaaatagcatttaactgatcagagtgaggagaagaggattgtaggcatgtggaggacatatgtggaggactgggatgaaagaacatggagtgtatgactgttgacatggctgaagcatagaagctgggggcacagttcggtgctgtcagatgtaaattttgtttctgggggagcccatctcctaggtaggggagtaagaagtggagtctggagtgatccttgcacatcagtgtttggttatgttgcttaagatctgactctgagtttgaagcagacagatacacaaggactgaagggatatttctctttaaagagaacatacggcactggattactgagccctcccagaagagatctctcctcatatttgtgcctgggcttctgtttacagaaatggtggagcggaggtcagggaagtggggagaggaacaacattgatttttcttatactctacttgggacatttacagaggcagttcctggcaattctttgagataatgtaacataatgcactgggagagagctagggagataatccctgacatctctgaagaaccgttaggagtgaacagagttgcctgggaccatgttttggtgaacagaattgtttttgaaattgagtttcacataagcttgatgtcctgaagcagtttctttccaccactgcaatattcatcaaacatgcagataaaaggtagacaggaaaagcaaattcttaggtgctgaattttagtagctatatttgtgaaactttgtaggcctgaggtatgccttcatctaaattatgacagtactttgtacatagtaagtgtaaaaaaatattattagattgaagttaacatttgaatatattactaaagggtacaggtcaatatgaaattcaaggaaaaacccagacttattttcttccatattaagaacgatttgtttacttcttttgcattattcctacctggtactgatcaggggcctgggtatgtaatatttgttgaaacatggaaggagtgtagtcccaaataagagtagcataaatgtcttcatcatcaacaacatagttattatgtctcacattttcaaggtattttattatatacctaacacataaaattattaaaaaagaaaatattgatggcaaaaacagaagaatatataaagcatacatttatttcctagctccaagtagctttccgtccccttgtttatagaggcaggtcttgctgtgttatgcaggctgggttggagtgatgcaatctcactgtaacctcgaactcctgggttcaagtgatccttttgcctcagctccccaagtagctgggactgcaggtacaggacaccacactcagctaattaaaaaaaaattgtagagatgaggtcttcctatgtctccccaggtggcctcaaactcctggcctcaagcaatcctcctgcctcagcctcccaagtagctgggattataggcgtgaaccactgcacccaagtagctctttctaatccatgggttttggagccacataagcttgtgcttaaacctaacagtttccactgttgaagtaatataggggcaagttcttaaattctttatatctccttccccagcttcccccatcccctgttcattttttttttctccccaaaggctggagatagtgcatgctgattttgtagttttgtgaagctatgaggagattgtatctttatgtaaagcatgtagcagagtgcttggcatgggtaggctattgttatttgtctcctcaactttccattaccctttcctttgttctgaagaatcaagcttctgagcagtatggctaagcctcattagtattatctcatttattctgaatttgttattttgccaagaatagacaatatattttgtatactctataagggaagatttccttaaataaatgaatggtgtaaaaaattataaaaaaggtattacatttactcaaaaaacacctttagaaagtgtgaggcaaatgacacaaacattaattaaagttgccccttcctatgtagacagtccctaaaagaactgagtaatatatattctgcaattcacttgtttaaattcaggatagcttagccatgttgtttgatttagtaaaatttcctacagtgtttcccaacattaaaaatgctattttgttttcagcaatgaacacatttaaactgaagatacacttaaactaagggattccaaggaaataaaaggactaggttatacaaggaaagagttctaatatggaataagcattttcattgctttttttgctgtgaaattgaattgtcagttttcctatcttcataaattgcaaaacagcattcatttccttgtgccttcttctctctctccctcaccgctccttatgtttttacctttccgtatgcgtgtgcattacttgaaagccatgcatgggctgaaggatgttgcagtagagaaaaataagaaggcaaacaaaagcttattgaattcactgtttgttaacaagaaaaaaatatatatacacatacatatatttatacacatgtatacatacaaatacatgtatatgtaggtggacatgtacttgcatagacattaatgtatcatttgaaatgagaaagtttattgatgaaaacctatcatcttaaaaatctcactgccacagtagctacagataaatttctagtgtttttcactatctccatcataatgtttataaaaaattatttatataaagatgatgcataatatatatattttcattatacaaaaagaatggggttataaaccccaaattcaaaaatgagaaatacggattgaaaaaaactccttgatcatgtgtcacgagaatctggaataatcttccaatctttcatgctgacctggattaggcactcagaaaatccattgccgctatccatcctctcctgccagtagtagctagacaacccaaatataaggtttttttgcaagtcactgtctgactttttcagacaattcaacaacttctttttaaggggaaaagcagcagcatttgttttccttcaaagcattcttgttctatgattgagatgacatggtttttggactgctccctgcaggaggagaagccagacggaaggtggctttctctcagctctggcaattatagcaaagtcataaaaccccaggtaaatgggaactctttaaacatttgcagatataagtccgacacggtaggaaagtgacccaaagggaagtgcttattgatccatttccccccaaagctgtcagtgatgaatgaacatcatctaatttaataggaacagctctaagcctgcaaccttgcaggtattctccctggtttttcttgtgtgactgtttgaccatgcccaagaaacttaaccttttcagtgtcactcttcccatctgttaatggggataacagtgtttcagttctgagccttcttatctaaggtagctcaggagaaatatgctgttgagttgcattgtatcataaacatatttcatgccgggttttgtcacttcattttctctttggtaaggccttgtccatcactgcagaattcattctgtccttataaagcagtgaagggggacatttcaaagttgtggcattcacatgcagttgattgagacagccacaagaaattctgacatccctgccaaattcatttgtcttgtaagctgcactttttctgcagctagatgttggagcaaagagctatggaagagacataacttgatcagatgatgttttctctgtcagttttcagattaaatccatcaataaatacttcctagggtgattctagtatatatgaggtgtagttctagaaactcaagcagaatcctgaagatggatatgatgaatgttttgcacttaaagactctagagtgctcagacaagttagagccactaccaaacaatcaaagtgcagtttaaacctgcttggcatcactgatgtcccagtccatttgggaaatatgatgtacactcactgtgatagagagtgccggggctcatctacatccagttttcctattctcttggaacatttgccagtgctatagttcccagcccccttgctgttaggtggaactgtgtgatgaattctagccaattgcatagtagtgggtgggatgtatgtcacttctgggccaaggcattgaattgctgagaaagctacctccaagcttgctttatctttccccaccatggtatccttgaaggccaggtgttgagatggcagcattgccagatggagggagctgggatctctagttgttgaatgatggagagaccctaataatccccactggactttatgtgagtgagaaatacacttttgaaggggttcgcaattgagatataggagtttttagacatcattgcatagtctggcctattttgactgattgaatgttaaatcataagaattaaatggcaatgtaagacaatggcagtgtaactgtcacaagcaggtagaaaaataattaccaaaaaagaattcaggtgaacaagcttcctcagcacatgggaagataaccagtgtgggtggaagcgatttgaaggatatggagatttggataggaggaggacagaggcaggaggagagatagcctgagaagaagacaatgagatgatgttgtgagccaagactacatggctgcaagggagagtaggatactgacactgctaccttggaaaagggaagaaaaaagaaagataaactttgttttattgaaatactaaaagctataaactcatacacatataggtagttattgttcttaagaggcattgtttcaaaatttaggactacaatgcattactgacattcagggtggagaatatcacagttgattatttgaaagagagcaagacaagttacaattgaacaaagaccataagaatccctgggcaataggaggccgttcttgtgaaatccaggacaccaagcatgagtctagctctatcccttggtcccattttctgctgggctagctctccagttgtgtgcagtgttgacaatgcaggcatagcattcattgcacagcattgaggcctgtaaatcagctagttcatacaattgaatgtgatgactaattatgtccaacattgctaaaaagtcccttagaaaatggatctaatttgttttatgtagttaatattattttattgagtatgcattattgattttatagagtagacaattctttgagagacatgtttatgaatttgtatcagctctagcaccgtttttttaaagcacaggagatgccagtgagggacttaaaattcaagtcctcattttgtgattgttaattttattccattgtcatttagattaatttcctcctgcatttcagaaaactaattttcctatttaaaggctgaattgtgagcccaagtctggttccctcagcctatatcttccataaatgccaaagctggattcattcctgcttcccacctctaggtccagccctaggtgcaccctgtccttctggtggagacagtgattatattatgatctgagttcaaaggcctgcaggctctgtagagtctactttgtacccatggggcttccccttagaaagtgttacaatgtgtcacagagcattggctatggagacagatgaacctgaatttcagtcccagctctgtcatataccagctgtgtaactttgggcaaatacactttttgtgctcaagcttcctcatctgtaaaatgggaatatgcaggtatactagttgtgagaatgctaagagaggatgtgtttcatgtcagaagataacaggcatgcaaaatgattgttggatgagtggatataaccagtaatgctggcacagtttagtccagtacttcctttgactgcactggacctgactgaggtccatctcaagcccatatcttccagagttacagcagagagcctattgttacctttcacacttggtgcctcataacaggcacactcagaatttctaatattgggagatgttaatctgacctcttctggcacctgtatattgaagctggggtccccccaaccaggttttcactacatgaaaattcttagagtcttttcttctctcatgattgtacaaaaataactgaaggatttgataaatatgactgtacatttgtcctttatgagaattaagtacaattttctctacactagcacttctaaaactgtgtcccaaggaacactaattctctgaatgttctaaatgttcttagagggaaaagaataggattctaaggattagatacatttggggaaacttgggttaagtaatctttttttctttttgttcaggatttcttaaagcgtttgtaaagtaatttgtactaaggagctctaaaagacctgacacagactaggcatacaacaaacatttgttccatgagtgaatgagtaaatgaacagctgagttaaacctaaatttctctttctggatccagttttgaagcctcatcagcttcccctcactcctcacccttcatacattctatatcatgggtctggacatgattgctgtccttccccactaaccatttgcttttgccaacctgcatgcccctatccagaaaatcaagcgtgagagaaaacactagtgtttctcgtgtgtcaaggatacaggaaagctatcttcagccgggcacggtggctcatgcctgtaatcccagcactttgggaggctgaggcgggtggattacgaggtcagcaattcaagaccagcctggccaagatggtgaaaccccttctctactaaaaatccaaaattagctgggcccagtggcaggcacctgtaatcccagctactcaggaggtcgaggcaggagaatcgcttgaacctgggtggtagaggttgcagtgagtggagatcgtgccattgcactccagtctgggtgacagagtgagactctgtctcaaaaaaaaaaaaaaaaaaaaaaaggaaagctattttcatacttgtgaatccttatagaatgaatgtagtgaccccaacaaatcttggtcaatatatatcctcttaaggcttggctcttttccccttgagatgctatgctcttaaaaggagtacctcaggtgggacttacaggagtctttctgcaggatctgcttcagaggttcagctgtcccattttttccttccttacttacactgactgacaattaccttttggaaatcatagcatggattgttcctctctcctttgcccaattaaggggacttttgtttaaaatgacaatgccaaggtgtctgatatggtttagctctgtctccacccaaatcttaacttgaaatatatctcccagaattcccacatgttgtgggagggacctgggggagataattgaatcatgggggccgatctttcccatgctattctcaggatagtgaataagtctcatgagatctgatgggtttatcaggggtttccacttttgcttcatcctcatttttctcttgctgccaccatgtaagatgtgacttttgcctccaaccatgattctaaggcctccacagccacatggaactgtaagtccaattaaacttctctttttcttcccagtctcagatatgtctttatcagcagtgtgaaaatagactaatacagtaaattggtactaggagtggggtatcactgaaaagatacccgaaaatgtggaagtgactttggaactcgtaaacaggcttaggttagaacaatttgaagggctcagaagaagacaggaaaatgtgggaaagtttggaacttcctagagacttgttgaatggctttgcccaaaattctgatagcgatatggacaataaaatttagggtgaggtggtctcagatggagaagaggaacttgttgggaactggagcaaaggtgactcttgttatgttttagcaaagagactggtggcattttgcccatgccctagagatttttggaactttgaacttgagagagatgatttagggtatctggcagaagaaatttctaagcagcaaagcattcaaggggtaacttgggtgctattaaaggcattcagttttataaaagaagcaagaataaaagtttggagaatttgcagcctgactatatgatagaaaagaaaaacccattttatgaggagaaattcaagctggctgcagaaatttgcctaagtagcaaggagcctaatgttaatccccaagaccatggggaaaatgtctccaggccatgtcagataacttcaccgcggtcccctcccatcacaggcccagaggcccaggaggaaaaagtggtttcatgggttgggcccagggttcccatgctgtgggcaggctagggacatggtaccctgtgtccaagctcctctagccatggctgaaaggggccaacatgtagcttaggctgtggcttcagaggtggaagccccaagccttggcagcttccacgtggtgttgagcatgtgggtgcacagaagtcaagaactgaggtttgcgaacctccacctagatttcagaatgtgtatggaaatgtccagatgcccaggcaaaagtttgctgcaggggtggagccctcatggagaacctctgctagggtagtgcataagagaaatgtggggttggagcccccacacagagtccctactggggctccacctagtggaggtgtgagaagagggccactgccctccagaccccagaatggtagttcaccaacagacagcttgcaccatgcacctggaaaagctgtagacattcaatgccagcctgtgaaagcagccaggagagaggctgtatcctgcaaagccatgggggcagagctgcccaagaccatgggaacccacttcttgcatcagcgtgagctggatgtgagatctggagtcaaaggatatcattttggagctttaaaagttgactcccctgctggattttggacttgcatgggccctgtaatccctttgttttgtccaattcctcccatatggggtagctgtatttaactaatgcttgtacttctattgtatctaggaagtaactagcttgcttttcattttacaggctcataggcggaagggacttgacttgtcttagatgagactttggactgtgaacttttgggttaatgctgagatgagttaagactttgggggactgttgggaaggcatgattggttttgaaatgtgaggataagagatttggagaggccaggggtggaatgatatggtttggctgtttccccacccaaaactcaacttgaattgtatctcacataattcccacatgttgtgggagggacccaaggggaggtaattgaatcatggaggctggtcttttccatgctattctcatgatagtgaataagtctcatgagatctgagaggtttatcaggggtttctgcttttgcttcttcctcatttttctcttgccactgcctcgaaagaagtgccttttacctcctgccatgattctgaggcctccccagccatgtggaactctaagtccaattaaacctctttttcttaccagtcttggctatttctttatcagcagcatgaaaacagactaatataatgtctcagcagaagtaaggcacaggtaaatatattgtcgtgcataaacttctgtttcttggaagacaggggctatcatagcttttaattcctgttcttgtaataccagtcaggaccactctgatgataatatctcaccagaaattctcctatagtaatttcccagcagaatttgccccttaccaaaaaaaaaatgggtagaattttcctattaattggtatttgggtaaatcaggtttaatagcttcctcttcctctctcattagtggccaaagtaatattaataactgacattgagtaggagaaggcaaggccattttgagtggccgcttcctattatgtggagattctggttcacgctattgttgcaaggaaccacgtagtgacgtgtcgcctcccatgcagcctcagcttttgctttcttggatgcactccagaggatgaaattctgatccatgcatgatggctggacagtaggcagaagggggcactcagtgaagctcagatggcctctaaattgctttcagaatcttatctgcagtgtatacaactcattttccagctgcaacattttgtctttttggataaaactaacatggctcctccttaaaaaatgacagcattatggctttggcaaacccatagaggggtcaagttagatccacacaatcagaagggggagaccagtgcaattagttgggaccaggacttaaatatttataaatctggcaggaattagtataggtgttccatacttttgaatgagacttttccgtggacctgctaaatggatccagactctggcaggagagaaatgaacttgttgaaattagctgaatctttgtcatgtcctccaaatggctcattcatccaggatccaatatgaaattgtttgacagacattttcctctcctgaagagacctaactattgtaattcaacatggcaaaaggacacccacaacttgatacactttttagtgtgagagatgggaaaagaaggaacatgggatgtggaaattgatcagatagattttaatccactgtcaatgacccgtgacatgctatctatttctaattgatcatttggtagaaaagagtttcctcgggaagaatcttctctctgtagactattttcttcgtgttagttttctttctgtagctgataaaactcatacgggtggttctttgacctagctccaaaagcacaataaccgatggttcgaatgagagagaggagctgtggaagtggggagagaggagtggggaagtggtttcatttacagaaaacagaagctagagaagggagcaaaggcttatcttgcaaagcccccctcctcccctgaagggcaagctttggggcctgtggcagtgcccaccagcagtggcacagattgtgcccttctccatggtacctgggctgcttgctgaggtaatggctctggggggagccagagtgggtggaagtgcccatgcagcttggggctacagcctggacattgcaggagaatgtggtggaatttaggcatgactttggtttgcagaaatgcttttgtttttccgacagattgcatcccacaagtaaacaacatgtacagacacatgattcattttaacatgaaatctgcacagatgaagtgcaaggcataaaccatattgaatcgtctgtcttgttttaagagtctttatctgaaaggatgccttatttgcatatgaaaaatatgttcctttttgcagtggtctcttctccctcattcttctttgaaggaacagctttagtttgctactgacaatcataaggtttactttgttgaagagtagaaagagaccttaggaaaactgcacatacttgcttcatattttaagttttatattaaagttgagacatctgtttttcttgtcccaggtggaccttgaaataaaagcagaagcttatgatacagaagagagtacatgagttttctattgctctaataacaaatttccacaaatttagcagtttaaaacaacacatatttgttatttcagtttctgtaggtcagaagttcagcatggcagcacttgcttctttggttaggtactcaccagactcaatcaaggtatcccatgtagttcccatctggggttcagtgtcctcttccaagttcaccagttgttggcagaatttagctcctggacctgtttcttgtaggactctattcccttgacatatgacacctgtcatcatcaagttaacagtgatgcatttactccttctcaccctggttgtctctctgatgttcctctctgtcacatctctctgacttcttctgtcctttgattttaaagactcacgtgatcacattgggttcacccaaataatctacagtaatatctattttcaggtcactaataaccttaattatatacacaaagtcccttttgccatgtaaagtgacgtagtcatagatatggcaccagggggccaaaattctgcctgccacagagagggattacagcaggaagcacagtataggcagctgtgtgggtgcagtacacatgggaaggtaaaaggacatatgattaagtgttttagaaaggacagtagagataaggagacttgatgggagtcatgataagggttcacacctgccaagatctattgttcatgctggcaagaaagggctccattaccagtagagtacagtggctaagtgtggatggcaggatcaggcagcctgcattcaagtcttggctttgccagttattaaatttattaactcaatcaaattatttaattatattaagcttaaattttcccatgtgtataacaaagataataataaagcttagcttatagggatgccatgcagattaagtgagctagggcatagtctggcatacagtgagtggtcaatacattttgtaatttttattattacctccttttcttcctgaattaaaaaaaatggtccagagtaattacattaagctgagaatggcatgaatttaatttctggcctctctcttctaccagctacctgggtgatctttctttgtctcacaattttgtcacttttaaaatgaagattatgttaattatgctaatcattccaaaagtaagttggtgattttagagcactttgaagtaatcactagttatttttgaaatgtgtatgataatttaggggaaaacaatcctgatttcttttagctcattctgtatcagagtcaccctacaactaatggtagaggcccaggacacttaccacgggatgtagagaaaaaccaatcatcatgaagagcctgttggaagtggacttaccctatggatgggcagggtagctggttggctaaggggtatgagttgtgagatgtcagaaagacaaactgccctcaaatatgtgtgctattaacctgtagcaaatgcctcaaatattaattttagagatcttatcttttccaatattgagacctaaaaagcaacgtgttagaatacaaagaacatttcgctcacaaaaatctagattggttctaggactaattagccacatatcatacatcctttgtgagtcccatttgtgaatgaaggaggttagtctagaatgatgtttgaagtcttctccttcttctagattctgtgaactagacatctaagacctttgatcttggagtataaaaatcagacagccattctggtgagcagcagttgctccagaaggtcgtctctgaggagatgagcaagaaagacggttgttgtagggtttctgcaagtgtcagtgaaaacttgcctggaggggcatgagggaggaggtgagtcaacagaggagatgttctcaggggtgaggtgagagcagagggtgccatgcaggcccttgcccaattgtcagccctgctgaggagctctgactacaggcatcatctattcagacatctggtttgtactataaagttactagcctgtttcctgggctgattgaactctgttggcaaaagctttgtctataaatgaagttaataccaatttatttgtctgaagggagggggttaaattatacatgtttttgaggttcagttagcaatgaggtatatttattctgggatgtacattatctcttttgcttcaaaagaggacagaatgtaacctaaggttttatatgttgtagtttaaggagaactagaatggggatcagaaaacattattttcatctttgctctggcactgaacagagacacaaacaggggcattctgaaacccatcaagattctgttccttcttggcaagtggagataataatatctgccctgccagcctattaagccatgtaaagtgctctgcacagtgtttcacttagtaaatcctccataactatgagctattatttttccagccctggcacactacctgaaaaatttgaaacagtccataaatagctatagagtgaatgaacaaaaaaagggtatagtgaagttcaaagtaacttagtgtgatgtactacataataatgtcatactctatttgttgaatgaagcaacagtttttacatgtacagaaacattgtagaaaaattctttaaacatctcttcccaagtgaggtggatggcataatgtgtcacctaatatcagcgatctcttctgtgagcaccctatgtaactagaactcccttcagttactgtactctctattctctatcttgccttattttccatctcagcacttacttactaacacctgatgagcatttttttgcttgtttattgtctgacttcccccactggaatgtgacatctataaaggtaggttctttgcttgcttttgtaaattcttgttgctgtaaactacattggtagaacaatacatggcacatagtaggcacataagaaagatgatgagttaatatattttggggatgcctccattgtgacaatgacttctcttaaataatcaagctgttttcactctatccaccattacttgcagcctacaatatgttccatctggtgttaaagcagtagcagtatttttctgtgtctcatagtaggtatctcacatatggttggatcttattaccaggacctggaaactatttgtatctgatccttcgtctccttagggatggtcaggataactacttcccaaatggaggtaccctcaatcccaacagctacagtggtgtctaagttagggacaacaccagtaattctgctctgtgctccataaaaaattaacagccataaaagtcaaatcagcttcctctctagcaaatgaactttacaacccgctttagcttacagactcttagtaaccaatatgtaaaaaataccaaccagggaaagatattttcctgctttataggctttaaaaaaaccatttaattcaatctggcacccaggctgaatgtaaaatagctgcaaagcagtattgatggaacaacacaggatataattaaatctatgtatcaattcatccagtgtaagataaaaatcaatcccgctcaaacagacaccttcaggcaggaaagaaggaaagcatttgctgcagcctgcccctatgttgtaccctgttggtttcttattggagcaatactctcacctgctctgaaattatcctttcatattttttttgggggggggggagggggctgctttttacagggctctgaataaaatatgagtttttgagcttccactgcggttttgaagttactcctttctggaaaaaagtgacagaaagcgactttcctatgtagaccactcaggagcaaaaatccatgatctgaggtctgagaccttcctggggaacttgttaaatgtgcagactcttgggctccatcacagagattctgattatgctggtggtggtcctcagaccgtagcgtcatttgcgccctgggtgagaatccggaccctatcactcaaacattctatggccttgggcaagataattacatatttttatacctccgttttctcatttgtaattcaagcttatgcatggtaatgtgctctgggtacattctcatttaatcctactttctaggttagtgtgggggtaaatgaggcaatgtatgttaaacatttagcttagagcctgataaatagtgtactattgccactgccagcagccaggattactgagtgcttgctgtctgaggggcactgttctgagtgctttacatgtattccctctttttaaatcttaggttggtactgctattatacttattttatagttgagaaaacaggcacagagaaattaagtgacctgttttaggtcacacagcattgaggtgatagagcaaagacgagaatccaagtttgtatgacttcaaacaccacatattttacccactatcattatgtattttcagctatagatcacctatctttttttcttctagctttacatctggttgtcatcagcccaatactgaagttgtcttcctggttaatctgttgttcttttataggttctggcactagtatactttattagtgaaaggactcttaacctatgcttttagcatatattctaaaattagaatccatatcataaaatgtaagaagtgcaaataatctgatattctgtctccctcccctataaagatcaacattaggtgacatataggaaaacttagcatttttaaaaaaattcaggttagtgttcatcctcaaggggaatcatgaagaaaatgtttaaaaaccaattgaaaatttagtattgtttatggttatttatggctagcggtattataggcaactcgcctatctctttacattttctgctttttccaaattttgtactacaaagaactgatactattaatacttttataatcagaaagaaattctttctgtaaataaaaagcaaattaattacaaataggacccagtggcattggtcccacgtttcttcagcctgctgttcactcctaagcatgcatcctggtcatctccataggacacccagagaagagctgatcaatattttggtgtcaaggggaggaagaaggagctggtgagagggaatattttgaaattctttctgtgagctctgttagaagtatgcctcagttcactgacgttgaaaattaacctagggtgatcagaggactaagccccagaataaacaaacaagcaagataattcatttttaattttgaccaaatgttaacaacatattgtgcttccatgatgccaaaacttattagtttaatgaaaaacaacatcagttaagtcattggaaacacacaaaaatcaatatgggtgttattctatagatcaagctatcactttatagatgggatttctctaccattcatgtatttgtttatcacttgacatagttagaggtcgctctgagcagatgctggtgcctcaaagacaacagttatgaaaaaatgaagtcggagaaggaaatgtgatgaaaaagtctctagtacccttcagagccataaaggaaccactggaaacattccattttctaataaagtgattactaaattttaaaaaatagcacagtggaatctatttactactaggttgaaaacgtttgggtataaagaaattgtagactgtgtaaaaacatcttccacaccaataataatctcccagccacgctgatgcattaagctactttataataagagttgctgggtagctaaagggataggaggctctggaatgaaggtatttcatatctcatataaaagcatagtatgtaaaatagggagagatgttattgtaagttcctaagaatttggagaagaaaagccttttatttatctgtgtaagctaaaaaagaaatatcaaacaataacagtatcttacatttataaattatcgtactctcaaatatttgacatgatttcaggtctcttttatcactctattcctgctaacagcgctgtgtcaggtaggcattatcacccctgattgatgaggaaatgaaggcattgttaagtcatttgctcaaagttactggtagggcaaaaactacaacgcaggttatgtacctactaaattggagtttatttatacactgcatttttttgtctgtcttgagcatttgtcatcatggcacaaatgtatctgaatgaaacatgaaagaaaataagcaaatagacaaaaagaaaaaacccagtacctaatttgctttgtttacatatcatttaatatttagacatgcccaaatcaatgaaagtaaagtgcagtgttccaaaaaatgtctaggtgattgactactatctttccttgtatccagatgctatagcatcatttagacccagataaagttaaaatatagacagacagacatgaacaccaaaaatctgaatcaaattatgcatttggtagtagtcctatctttgactcaggtttgaatatagctagatgcctgtcacgtttaggtttgtaccaacaaaaaaaaggaaacaatcagtggaaataatggggacaaatttagagatacataatagaatcttatgcttcatttgggattttttgaaaagatttgttaaaagaatgttccaatttaagcccttgatgatgtacttctgaataaccttggctattaacaaaaatataccctgaaattagatgacctggattcctatcacgtgagactgataatggatatgtgctgacactgtcttggtgactgggattaattgggatatggaatatagcactggaaaaaaaaatccagacaaaccaaacacaagaacaaaccaagaccctgctgtcatggtggtcagagtctagtaagggaagaaagatagaaaataaaaaatcctaactatatgccattccaaggggctaggatgaaaaataaagcaaggtaagaagaaagagatagagagtgactggggtgttcttttagataagggatcaggcaaagcagtttgtggacaaggtaaaattttaataataaatttaattcaatttacaattttgaaaaagctggatttttcaaaggtggttgatgtgaaaatattaaggcaatacgtggtggcagaaccatgccatgtttaccttttgttcacctgctgtttcctttgccagaagcatctcctttgttcccatatcccacccaggtatctcctttgcctaggtgattgtggtaactcctgtttatttttcaggtctcaacttgtgtgatcctttgctcagatgggcattctcttcaattccccctaaacaccttgtacttctacttttgtaataggaatcacatttgtaattgtgtgtttattatcggtcttcccacttgattgagttataagagtgctaagatcatgttgctctgttaacctttgcattttctttcttctatccttgtggagcttgcagataagaaaatatgagtttatctcctagttggggaattgaactcactcacatgtatcaacgcatataataatagaatgtttgaagctcaatgctgatcacatattgaggggagtaaacatgggtgtcagtaagttagattttggagtgataagaacatggctttagaacatttctgtttttttgtgattgcattgtgtagctagcaatgtcctgttgttgtttgctgttcttaagaaaggtaccatgtaacaaactctggtaactgaagtcacgaatggctctttttgctagtagtttgcctagttaactggtagctgacaagctagttgtatttttgggggttctttggggaaagtgcttaataagctcagctataaactacagaaaggaggctattgtgaccattggtagacttaaaaaaaggaagtgacgtcattggttcacttgctcttagagacattctggttgctaggtagaaaatgtattgtaaggggcccagagaagaagaagagagactgtttagaaatctatattaatatcccagacaagagaatatggtggcttagagttgtggaaatggaggagagaagcattcatatttaggttgtgtcttggaaatcggatcaagaggatttgttttatggatacagggtgagaaggaaataaagatgtctgctgatttctggtatgagtatccagataaatggtggtgccattcactgagatggcaagccttgatggtggccaattgatagtgagagttttattatgaatagttttaagtttgagatgccaaattacacatacagctctatgttctgggctaagactacaaattactgcatttattatgatgtttggaaataatttttaaaccttttctctctgaattgtgaactccttctcagcatagcatgcttttgtattccctcttgtactccttatttctggagtctctcaattacctggacggatgaacggatggatgatgacagggacttctacactgcttactctttatttctctgtatttcctctccctctccccctattcactttatgtgccacctccctgctttctgaagtttaacagaagcactgtattaatttgttcttttgttgctaatacaggcatacttgagactgggtaattcataaaggaaagaggtttaattgacaatttggcatggctgggaggcatcaggaaacttacgatcgtagcagaaggggaagcaaacatgtccttcacatggtgacagcaaggagaagtgctgagcaaagggggaaaagcctcttataaaaccctcagatctcatgaaaactcattcactatcatcagaacagcatggaggtaaccacccccatgattcagttacctcccaccaggtccttcccatgacacatggggattatgggaactacagttcaagatgagatttgagtggggacacagcaaaaccatatcaagcactaaactgggaattatcacatttgtgtactagctgtgtgacactgggagctctaattaatatttttctgggcctcagcttcttcatctgaaagatgaggcagttggacatgatctctaaatttcctttcagcttgaaaattctgtaattggtatttttttctctgagatgttcaaatcaaatatgtacttttagaccttactttttatattttcaaaggcatgcatttttagaaagagacaatttagagataatcagttcaactcactcgtgtgaaaggcgaggggaatggagccctatgatatgctcctccatttataaagtaaggctaccaatgatagtaacaatagcaatagttacagcaatgatgattgcttctcatcctttggctaagatcaagtgtaataatagtaatgataaaaagaacacctatatcaaaatattcttgtggaactaaaattagataaaacatataaaagtgtctagctaggagtaaatgttcaataaatattgattctcacagtggtttttaatattaaatgtcatgtgacttgcccccaaatatctggctggtgactggcaaagctgggactgaaccatttccttaaggcatacaagccattcatttttcttctaggccccttcttgtcttttcctccaacaatcagagctaaaccatccttcttcatacaatatggagataatacagtgaaatagttatgaacataccttaggggtaggataaaacctgggtttcaaactaaattctgatattctctttctgggacactgggtaagttactgaatgtttctgaatctcagtctcttcatctgtaaaatgaggataaagataatgggtaccaacctcaaagagatgtagtaaggataaaagacattatgtcaagtacttggaacaggtcatggcatgaataaggtcaataaatagtatctatcttaattatcaacttttcccccacgtgctaagtggcagaagttctccacattgtctcctcattgcctagacagaagttattacacgtactcttgaaagaagacttggacattaccactcatggcagaaaaatatatcaattcaaatgttgactggagaaatattgtcagaatcattcagtttggatgttagaaggtgacggtaaagctgaagtcccagacagcaagctgtatggatttgagcagaaggatggagaggcatttaagagggtgggcaggaaagagatgaaattagcagactatccaatgtgttttgaatgtttgaaaaatattactagtggttggtagatgtgtggaaatattttaaaaattcagtgataattcatgtaaatctgagtaaatgaggctagtaaaagaaatgtcatcattggacatcatttggctcaacagcgaacaatattacacagacaaagttatgcaaacactgactacctatgtaaccataaattgcaacttcactctcctgggaagatgggtaggtggaaggggaggagttgatggtggtgctgaagaaaagcaccactatcagctaaattctcatctaaattgacaagaagctaagggataatatctaagcttgataaataaaaaatataagatttatatttagaaacttgcagaaaaacagctaaagaagctgcaagtggctatacttggagaataggacatggggagttagaggtttgttggatagaggccactgtcttttcttgtaagcatttatgaactgtttgacttttaaaacaatgatcactctgatagcagaaatagaaaaaagtgataatacatactatcttttcttttcgtaaataagttatatatgagttatcagtaaaatttacatgaaatttttccttttaaaatgcttatcaagactttcacagtggttgcagaactacaaccctcacatattatgtataaggatgtttataaaataccgtattggatgatagaatttttctcacatttatatacagatattgttaatgctggaaataaagcatgtattgattaaattatcaatgcacatgtattaataatattaccagacacatgtccacaaacaaaaattaaggttataatttttaaaataaatagataccataataatgcatgataatgcttattgttttactatacttttcttacattgagtgcaggaattgagtttttctcatctttgataactcttggaacccaacaaggaatatatgagttacaaatattttcattagtgacttttgttaattatatttcttcttatgaatatgtgcaagacagtaaacctttatattttgttttagataatttactttgttaaaaatatgattttgatagtctcatttagtggttttgttgtatactttttggaaaatatgaaattctattacacgctaattttatagcagatttattagcagatcctacaatcttaaaaacaatatagtagtgattcttatttggggaagatcaatgacaatcacagaatcacctgggaaatttcagaaattaagttactacccaccttggatattcgaaataactctcccaataccatgggagagcagggtgatggttcttatcagaatctgaaagaagtaatccacttgaactgggacttctgctgtcggtaaaagtgaagtaattggggccaaatttacactgaaacaaccaagaattaataaaatgtgtgaaacgacaagtttaaagatgttggacatcagacactgaaagatagtgaatccctgagagtagaaaaataaacaaggtgagccccacagtttcccttacttattgccttgagagggtttccaggccactgtgcagggaaggaaaacccaagtgaagcccaggggacaccctaagtgaggagatgaagctgagtgaatggggaggtcaaggcggttaggattcacatacaaaaaaagagtcctcgaaaggagagagctgcttttaaagagaatttccaaggtctgcagagagtacctttcaattcagtggaataataattaccatgtaaatgtgaagaaattaaccagcctacagaaggaaccagctgaaaatgttaggggtaacagtggctaacactcacacagtgccagcaatagtgctggtttcctccagtcagacttgaaaacctcatgattcatgggctgaaaggttcttgtctcagtggtgaagaataactaacccatgactgagcatgctccagaccttcccaacaaatcataaaaccaaagccagaatgaatcaaactatttctaagtaacaactcttccagaacaaagcttaagtatatttattgaaatccaaaaataatgagcacccatcaaggaagatctacaatgtctggcatttaattgaaaactatcaggcatgtaaagaagcaggaaaacacaaccactaatgaggagaaaaatcaaacaatcaaaagttatccagagatgacatgaatgttagattgagtagatatggaagagatggacttcaaggtagtcattacaactctatcccatatgttcaaaaagtttagatatggaagatacaaaaaagacctaaattaaactctggaaaagatgaataaacttgaagacataacaatagagattatccaaaatgaaacacaagagaaaagaggatatgaaagaggacatcagtgagttgtgggataacttcaagcaacctaatatatatataattaaggtcactgaaggaaagggagggaggattggaaagaaagatatttgaagaaatgatgcttaaaattgttccaattttgataaagttataaatccaagaagtccaatgagccctaatcacaaaaaatatgaagaaatcttcaacaaggcacatcataaacaaatttatcaaaaccagtgataaatataaagagggaagggcattaaaactggttgccacatgggtaaataaagaagaatttttggtataatttaaatctcaaaaattgcttaaaccaaaacaatcacaatgtaatatggagttaaaaacatgagtgagaatcaaatacatggcagtaaaagcacaaatgccagaagggggaaaatggaagtatattaatataaggtttttatactatatataaagtggtataatatcacttgaaggtaaactgtgataagttaaagatgtatagagttaactctaaagcagtaactaaaataacaaaactaacaacagagaggataaaatggagtaacaaaaatatttagttaatccaaaataagtgaaaacagaggaaaagagaaagaacagatagaacatttagaaaactaatagcgagataatgatagatttaaacctaaccatatcatgaattaaaataaatgtaaatagcctaaatattttaatgaaaaggcagatattgtcagattatgtgaaaattaagatctattaataactatatgtggcttgggagaaacactttatcaattataagaaaaaaaagaaaaaatatacaatgttaacattaacaaaacaaagctgggttggctatatttaatataaaagtggatctgtgagcaaaaaaatagtactggatataaagaaggtaatttcataataattaatgggtaaattcattaaatggtcatgtaattataagcatttatgtatctaatttcagagcttcaaaatacatgaagcaaaaattgctagaacttttatagcagtgagagagttaagagattccaacaccactttctcagtaattgatagaacaagtaagcaaaaaaaatcgtaaactatatggaatatttgaacaacacaaccaaaaaattgatctaatctgcaggtatagaaaactctatgcaacaagagcagaatatacagtgttttcaaatctacatagtgtgttatccaatgtggatcatattctaggccatgaaacagtctcagtaaattagaaaagtattcaagtcacaaaaactagtttctctgaccacagcaaaaataaattggaaatcagtaaaatagtccatttaataactaaatgaaattacttatacaacaattcaagtgaaagtctcctttgattttagggacaaaaacctatcaactctcacctcaggaggaaaaattattatgttagattatgcaaaaattaccaatataggaataccattttaggtacaagtttacacaggcaaaataatgtgggtactatgagaaagacttattcaacaaatatacatgtactttggataaatggaaggaattaggagactttgagatctggaaggtataatgcatagcgtaattttattttctctttgcattgcaaatacagcctaaaagtcactgaaaacacttttccttcagacaacatttaaattgaatttacatgcatttgagctatccctccttgacccccatgatgattgtccttttgggggtagatattttgaaattggttctaccatgtatgtgtagctaactcacttcattcattatttctgctcaatacatatactgctactataaaactcttcattgaccttcaattgcatctcatccactcccacctatgtatttttgctcatgttgaaactccacattgaatatattaataccttttccttccattttgctttccaaaccttatccatgcaagctcccatcttacctgctatggacttctcctctattattctgatgtgtcacttatgtttcttctctgaactcctacagaatttcatagataattacgactaaagcaatatcacacagactctcttgttaattaattttgtattcagcaggttttaaactatagtatacattataattacttgggggtgattgtaacaatgcagatttggggccaaatcctcaaaaatcccagaccactaaaactgggggctcaggaatttatattttataaaaaatcccaggagattctgatgtgatgatttgcaaatcacactttggaaaaaacaaatttctttaatggattttaataatttgtctagttcacacgtagatgcacagtatctaatccttcttttatatttttatgtcaacaggtagcatgctaagcatataatggatccttaataaatgcttgtccacctattgacgtagtacagttaaacattttgtgtatgtactcttcagttagctttttaaataaatgattgcataccaggtgttttaatttttaattttttttctaagcttatgattttgcttttcatttgaataatggaattttagagctggaagggatctgtagaattaatttagctcggttctctcttattttttctggaggcaattgagggcaaaagaggttaagtgacttaaccgagttcatacagttaattagaaagagagctacatccgcaatccaactctccaggctcccaagcctagtgttcttgctggggcacatgttgcctcttaccaagaaatttgcccggtagttctagttagtcacacaagtgagaagattcaaacatgcatttgtcaataatttgagtgactaaaaactttatgtcactctttagaaatcacagcaactgttgctttagcttgtttgctgtggataacttagattcaatacttctttgttttgggggctttcttgtacattgtagaaattttagcaggatccctgacctctaatccctcactcattgccaggagcaccctcctaccacgattgtgtcaatcagaaaggtctttagacattgaagaatattctctggcaagcaaaatcacctgcagttgaaaacctctacttacagacaaagacatagatcacagattcttgaaagactcataaagaatgtttacatggaaggatgcttggcatttgaaatgatccctacccgaagacatcataggcatatgccataaacaaaagaatagtgaagttaggagtgcagtgcaatgttataatgtagaccgtactgaggcagatgatggtgtcattttgattttacggcttttgtatttgtatgaatttttattatgcttcttaaaaattttacttatcagttctaaagtgcctgtttctttaagtagagcattatgttatggtataaagagtggttttcatcatttacaaaccaacatatatctattctagacatgaagcatttgttttgcagaattttcaaaagtcaagaaaaattatgtagctataccctttagaaaatgtaaatacatatagtgctttgttatatgcaatgtcttatcttcttttatttactcttttctttgattgcagaagcttagggaagctatttgaccacttagtctagcgtgaccttaacagaatagtttcttaatggatatctactcatctttgctgcagtactgaaggaaacaacttctttctactttcacagaagaggatataaactgaggtttaacagatgagcaacatgttatcaagcagctaccagggaaatgtctcttcagtgctatcaagggtccaaaataaaggaagaggaatattattcagggaaagttttatcccaaagagtagcttgtgaaattgaggcagcatggagggagtagaagattgagtttcagttcaggctttgtcactaggacaatttctactcttgggatcatttttattcatcaattaatgacagtgttgggccagttgatcttgtacatgcctgtgctgcatatctacagtagaaattgtaattatttatgttgctcaaaataaaatatttttaagcaaaaagatgaaaaatagtattagaaaaatgcctcaactgataacataaacaacataaacctaatcaggaaatactgtcctcttgtagagttaaatatgagattttacttcgagggcatatgtacatatatacctcaatacacaatggttctaattaaaataaaacaaaatactaatctgcaaataactttctttttctatgtttgaaacaaaatactgtatttgctcttagcaactctctgctcagttaggtcaattagtggtttaatatttaaaggaaatactcagctttataatattgatgattttcataattaaagaaattataaatatcaactgcttagactccagtgagcttattaacatgcagtagagaatacaaatgttcataactgataccatttttcttaatccatggcaactaagcactgtcagcccttaatacaattacatcaagctctcatacaagttagcttatggccaaatggtctgacacaggcagtcaatatctgggcttaattatgttgataaacaacaaaagtcacttttttgtgtgtaggctaaatgctcacagtgggtagagagaccagctgttgtacttttgatttcaccgtaaagattgtagcaaaaggtcagaactcttttgatgccagctaattaaaatatcaataattatgcaacttataaatttgctcttagtgtgtaaagctgaaacctctttttcatatattttgtggctaggtactttagggtaattattttgatgtgttaagtgtcaaggagattgacatgttaaagaatactcaggcaatcattcctggagttgggttttcttccttcacaaaattgagtacatgaaagtatggtcctcccattcatgacaaagggaaactgagttcgggagagaaagtcacaaatatggaggaaagtatgttccatcagatcattactgaaacgagatggggatattctttactagtggtttttgggcctattattatatgcctgtgagtattccagcgtaattaattgtgttagcttccttaaaaatttgtccctttagatcacactgcaatctatggactctgtcttagagtcactgagtgttcttattaaaatgcatattccctggcctcatggtcagatgttctgtttcagtaggtctggagtagagcttgtgaatatacttcataaatatttgttctgatactcattaaaagttctcaaaccactaacttaggttgcaggaacctaaacactgttaggacaaatattttgcctatttgcttgcttatctttctgctcattcatctcccagtgacccctcttccctgctccatcccctaccataagcttgtctaggtttcagtgaactgtcaattagtatctgctaattggtgcttaacgtattgatgctcatggtggtatttttgtttcaacaacaatagtaataacagcaacaaccacaagaacagtaatatctggtttacatatttgaaaccttgtatctctttgaccctcaaatacttctggtgccacaagttgtagggaattttcatactgtgagatgatactggccttggactttcatgtaatcacttgaaatgggtcagcaaattgggaagtaggagtactcttgaacatcctcctaaactgagatggttagcaataactgaagtctatatggaagtaactgtaaaccatataaatatttcccattaaggtccaactaaatgtaacgattcacaacccaatgcccccttaggtgaatgccaaaaattcctgcacacaatcgctgccacagcacacaaggttattggaagtgtgagggagggggaaattggaggagagaaagatagtggccttaacgtcattgaagtatcttcttttgcaaattttagaaaaacatatagattacgagaatatgtgttgtccttctcttaaagggttccagataagtaaggggccctgaagcttaagcttcactcacttctcagtaagacagttttgcctgtacaccttgctcagtaatagaaacagcacaagatgtatatatgataaataaatgaaagactagaaaacgtgtaattcttttttaaaaattattttagattcaggtggtacaggtggtacaggtacaggtttgtttcatgggtatattgcataccgaaggggattagtcttctagtgtacccattgcccaaatagtgaatattgtatctgttgcccctaggtagtttttaaacccttttccccctgccccactctcctgccttttggagtctccattgtctactatttccatcttatgtccaagtatactcattgtttagtccccacttctaagagggaatatgtggtatttgattttatgtttctgagtgagttcacttagcataatgacctccacctccatccatgttgctacaagggacataattcttttttcatggctgcatagtacttaatggtatatatatgaatttatccagtaaactgttgatgaaaacttaggttggttccatgactttgctatcgcgaatagtgcttcaatgaacatacaagtgctggtgtttttttgatatgatttattttcctttgggtagatacctactagtgggattgctgggtcaaataatagttctatttttagttctttaagaaatctccatactgttttacatagaaattcaactaatttacattcccaccaacagtgtataaacattcccaaaaggtataattcttatcctcccaccttttcagatgaagtgttgaagttgacctgtttgaaatcacttaacttattacaatgggacaagtattaaaaaggatacttcctgttcatggagtttaccatgctcctcaatgagcactactcctagtgtagctcactgtcacttggtttccatgttggacatcgccctggtttcagagaccaatctgcatggcgacatttttttctttaagaaaatttctatctgcatggacccattctttgttaaaaggaatccagaagaatgtgacagccactattaggttatttcttccagatatcaaaactctttgacttagttaacttgtgagttcttaataagcctataaagtagctgtataaatgctgggtaatagagagagatagagggatattcagacttttgggtagtttctctgcgagactgcctaatgtgccactgacgctgtctctgacatgagaaggacttaaatgccagtttactaaagttagtattatacaggggttgatagcctgatttatggagttggcattcctgagttcttaacacagctttgctgcttactatgggacctgtgctcattcacttagtcctatttcgctatcacatattcactatctgttaagcataactgttttgaggattgaatgaattaatatgattagtaagtagtcaataaatactggcacttactgttgctgtgcttggttttgtctttgacactaactagcttcttgacatcagcatcagttttctcatcagtaaaaggagtagttaaatggtagttaagattcataaaattctatgttgaggaatattggattatacatattacactcagaaaaaattattttgaagtaaaagctgttgtagaactcctttgtttaataattgaaagataaagtcccactaattatccagcatcttaaaagataaattaaaaaatccagtaagttggtttctttctttctcttcggaaacaagtttactgaagagccagtcttgttgcctaatgaaccaagaacccagaccctggatttcattactgttatgattccagatcccactagagtctcttatcaaatgtggcctcattaagtgcaacaggtaatgcaattctccattaaattatgctgagttaactcgtgactgacatgagccaaaatgaaatgtaattattttaaatcgttcctattggactgtatttgcacatcacagacagatattaacacatgcaccactacttgtgaatcctcatttatccaggctttattctgagtaagtatactgaatgccaagtctttttaatgaagcttctgtcaataataaaagcgaaatataaaacaactcctgtgttatcctgttttgagtaagttgtttctaagattaattcagtagattgttttcttccccctctatggaagagagaattacttataaacagacccagcccccaatattaatctctgctttttggaattttgtaaagatatttataactttgaaaaaagagagagtacactgccttataataattgctaagattttacaccagaaatgcttataaatgccatatatgtgtaactaattagctaattaacttacttaatctgtttttacagaggaggaaataaatgtacacagagattacacatttacccatttatacattttagctagtggaagagctggattcacaccctggaagcccagtttcagtgcgtgtttgtaaccactaaactaccattgtttctcaaattccctctaaattatactggtttccttaggcagagagacacactaagcactgaacagtgaggattgaacccacagaatgcaagtttgtatctggtgatatatatgtcttattttgtttctcagttagaaagaatacaatatatcaaatgcaacccaatttttaaataggagaaaccaccaataggtagttataaaacttgcctgcggtgatctggagactttagtgaaaagcaggaatagtacaagcttgtgactctcactctgtccttggctaaagccactagagaatgtgtctgcctagtgacagccatcagtggctgtaggggatagagatgacttggacacaattagtgattccagagggaagtgacagaacatgaaacgcctgggggcaaaaggggggtgttgctgggatccagcttatggtaataacttcaccaacaacctcaactcaaaacaaaatggataatatattttaaagggcattccaaaaggatcttactattcaacccttgggttccactgttatagagtgagcctgcactttcattcctgaagtctttttttcagaggcaaagacacatgggcaatcctataaagtcttcccatgacttattggaagcatagtgcttctgtttttcattgacttttaaaaatagtattactttatatcagaaataataactcttgaatagacatattatatgcaaaataacccataataccaactcagagaggaaatgggaattattttagtcccaccattcagaaactatcagttaacatttttctatatttacagctatagttatatctataacaacttttgaaccacatgcatctgcaattttggatcttgtatttcacttaaggtgaatagttctccaggttgttacatatttttaaattttaaatttgaaataccatttaatgggtggataataaccaactgcacattgtaccataatttattctacatgctcctgttgagcaattagattgtatacagatgttttcaattttgaacaacacatatttttatacttgagtcctggaattttaaaaattatttttaggatagtctttcttaggataggcatttgtcttcaaagaatgtacagttttaaataaaacttctaatatgtattagaaaattgtcttactgaaatatcttagttttttaaaaattctatcagctgtgcaaaaggatgtctgtctcatgagatcctcaaaaaattaaagattatcattaaaaatatttggttaatttagtaggtcaactattataccctattcaatttctatttttaaactatttgtcatctgtgtttcctcttttacaaatgaattgtctactcatatcctttgtctaagatctaatacattaaagaagtgtttgctactgtatgttgtgatcaaaatgatgaattctgagcaaacttggttaaagcaaaacatgctaaattccaacttcacaaggagtttaaaagttttcctttactaaataaaattcagccagacttttaaaaatgagatatgtggaaagatttaggtgaaacaaataccatatttataatatcttataaaatggtgatgaattatatataacgcagaattatcctttacgattttggaacaaggtaaaatactgtgtttaaataaaataagaattatcctttacagttatcttttacaattttgaggaaattatcctttacaattttggaagaagggaaatgcattcttttttaaacagaaaaacattcttttaaaataagatttaggaatatgtttcattcctaagtcttatttactactgtaactgctcattgtttctgaattcctacagtgcattataacgactttgaagagcaaacaaatgagcaagaaaacagtgttgtacaaatattgtcaaatattttttctccatgtccaaccattttaggttaaacagtctaatagctttcttcaccttgttcaccaagtcagcttccaatttgttcaagtagatctatagctttaaagatgtgcatattttttgaacgttttttcccttaaatcctctgatgtctcttttttcttaaacaaaagacacagtttgcttagctgcaaaatttgtctgtacttttcagaaattaatgtgaatcttcccaagtctaagaacaataattctattttggcttaactccaattgtctgcagaaaaaaaaccaaaaaaaaaaaaaaaaaaaaaaaaaaaaccaccaaaaccacacaaaccgttaaggagagtaatgtaatttgtagaaatctgcaggaggccttggtccttggtccaggagtactactgctgacaattacacaaataatgttcctatgcaattatcccagcaataaccgatagcaagcaaaaattatagaggcctgatgggatttatactcagaggtttctatgtagcactttgtttgaatgaaaatggctgtcttaatttttttttcttttctttaaagaaaataatcagtcagcttcttaggagaacataattttcttccatctaggtttaaatggcattagcacagcaatcagatgtcaaggtgaaagaaacatgtctgccccgggtacataaatggcaaaaataccaggtaatatgggtaccatttccctggcttttgcattttaaattgcattaaccttgtgctgtgtagagttatgatttcttgaactgttttcactctaaaatgggcaatcagttctacaatttaaaaatgtgctatgtgctgtcaagtttttctcttggatgcgaaggcacagaaaaatactcagtttgttttggttttcatgtttgcatgattactgcactgtatttatttccacaattccttcaatgtcaccattcgactacccttaattaaaatctgcttgtatttgctctttgcctaggagattacatctcaggacattatgtaatacatttcaagcaaatcagattggaagaaattattttttccttttttaaaagatgcaggtattaatggtcacgtatgaagtgtattgaaaagtagtaaagatctatcgtttaggaagtcagacagccatttttacaaaaactaaatacaaccacaaaatctaagaaggaagaaagagagcacatatgtaccaaattcccttccagtgatcccttttataaaacttgactagaggcaaagagagaatgaaaagcagtttttagtgaagctgtctttggaaattgtgcagattctctttggctgaaaaagaaaaaaagcagagctggacaaacaaatttatttctctatccttaatggattaaatggaaaatgaattccagtgggcaaaccagttttgtcttcattggggtttaaaaatttatattccaaaggaaatttggtagcttttaatgaaagttccaatttttttttctgaggaaggtggtgggcatttttttttttttttgcttattatgtgtattagaaaacatgaaacaatctaataattttctatatttaaaatgatggagcagaaattggctggtacataatcattagtaaataaatgcttgttggattaaatattacttgacatagtcttgacttgaagcctaggccagttttatgactgactgactaatgaggaagatacccaggttttagccttaattcagaatgggtcttaaaggaatggagggactgtccagcaaactttctcagggtaatagtttagaatatatgtggcagtaaatctctagtttcatctatccacccaatactgtcttttccttacatcttccagctaacttatctccacagatttaatgcatcaccaagtcccatcaggctaagatgttcaaacacccttggtttgaaaaaatcatcttgagccatgatcagtgtagtcatttgttctgttggataaaaataaaacaaactacaggtttccccaagttgagatctattactaattccaaatcatcacataattctctaatgagtgttgagatttcctgtggcattggaaaaatttttcaattatatttatttccaagaacatttcttaggaaaataatcctttgatttaactgtggaatttagtattgaatctctagaaagctgaaatggttatgtcagtggctgaagtgtggttttaatctactgtgctgtaagaggtacacaaactgattacaggtggagttatgcttgttaagagctaagtaagatcttggtctcaacaagatgtgggactcagggagcttataacatgatggaagaaaaaagcaaaaaaaataagactatgccaatgttagatactatcattgcttaggtgttaaccttcaggcatttaggatgacaccgaagttgtctaaaatacaataatagccaggggcaatccttcagtctaatgagacagatgtgatccaaacctggggatgatgcacttgtcagaggaggagcaataccgaccatatggtgggagattgactcacatccatcagaatgagccggtcggtgctcttaggatttgaaactgagaatgttgtgcttatggggatgtacatgtttttgggtgtatgtgagtgggtaaatgagctgcagtcctctgtaccctgaattgtggtccataaagacatttataataggctcttagtacattaatatgtgttatctatgttccacatacttccacatcctttcttaggttcacatttcaggaaaagcaaaagagtatttgggtagaaaagaggctctagagatacctgtcttaaaacctgtgttaaaaaacagaacatggctgatctatttcctgaattctttggccttttaagtataaagtccttctgttctttaggaaggctctttgcttgaaataatacagcccgttcaccagaacagttacgtttgtaacagtatgtgaaacaagactttaaggatttaaaaaatgaaagaaacaatcaagaccttaacttttctaattccagtttaaattttttcttgatcctattagaattttaggagggatatcaaattgatggaaattgccatgacgtcttgaatcacaggggtgttaaatcccttttggatcaagacacacatagatgtcatcttctgccagagcttgatagtagggaagggcagtccttggaaggcagtgtggtttggcttcgtttctgaaaaagtgtaggtcctcaataaaaggcattgaatgaaaggactgaatgcaacccagatatgctggtgtcaagagcctgtggttctaatggtcaggagtgaatacagttcactggttggggaaaactaacacgcaactgatagactgaagtccagtgggagttattttctgctcagcactccattggaggctgcatttgtgaatcaactaagagcagcttttattgatatggtcactttgcttttagttcccattttgaagtgtgtctctttgatggatgtgtaaggaatctgcttagacacctctgacagaagacaccaggcagaagatacgagtagattttgaacaatcctgattccacaaaagagatgacacagactgctgagtaaaacacagcaagccagtttgtaaagagaccaagcattacatgacagaagcacctaagtcacttttcaggttgcttgtctttgagggctggagaggaggcttctttctgaaaggagaaaagaaaaactttcccaaggccaaagcacaccaggttgtaaaagcttggagtagagctttgctgacctcttgtccaatctccccaacctcatttctttgttcgtcttggcaaggaccctctgctagaatttaggcagtttccttcacagatcttggctataacttgttcattaccagttttgaacctttgcgtttgttatttctcacttactgaatgtattctctgcctgattcctgtgtgtctactttatattttttatcttaaaaaatctggcttacatctaactcttggggaagcatttcatatctaagcttctcctgtctatgtcctatgtccccactgggctttctatctgtacttggaacaaatggatctagtttagacagtataatttgcactggggttaaatatttgttaactatagatagtcattctctctaactataatataggctcttgaggggaggaacatatttttactcatgcagttgtattcgtccttcttccctccatccaggataggccagtgattggcaaacagcaggcacttagcccatgttatggctattgatccaaaaataagtatctttataatgggccccaactcagagaaggtgagcatcaggaaaatggaaaagagtgattacatagagtgtgtgttctgggtgtctactgctgcctaacaaactatccccaaatttggtgacttgacacaacagtcatctgccatttagcagggtttggaagtaattgctcaactctgctgtgtgtgatgttagctggattttctctctactgagtctggagcatctacctccaagattgctcactcacctggctgtcaagttggttccggttgtctactgggagttcagctgcaagtgttggctgggggctttgatttctcttcatgtgggcccctccaccaggttacttgtgctttcttacagagtgatcaatgagttccgagaatgctccagcaggcagaaagtaaaaactaactggccagttaagaactatgtatgtctagaactgacacaacattacatcatcagaaacaaaccctacctctttttgggggagtaacatgatagtattgcagaaaaccacacttgttttaaacataggtatttggaaaatacagactgctatatattgtgttactgataaaactactacacaaagtcacattacataaagcatggaaaccccttggtagtgaactcttttcaaaccaaagatgatagttaacatttatttaatgcttactctgtgtcaggcatgggctaaagggcttatacatgatttctcatttgattctcacaacttatgggtcagacatttattcctgtccccattccagatgaagaaacagatacgatgaggtaatgtaccttgctcaaggtcataaccattaagaggcaaaggcaggatatgaattgaagtcgtctaaattcataacacatacgcttaactctcctgtttcctagtcgatgactacatagaatgagacattgtaatgtagcacagagatatgagaaataccagtggtcacttgtccagaggtttagaacctgtgtttgggtccatacatgtgcttatgggacagttgaaacctctgtgattgtgttacagcattgttcatgtgggtacatcccgggcttttgttagtcttaaaagggcatgcattgtaaatgcttaagtgttaaaacaacaacaacaacaacaacaacaacaatgtgattagacccctcttcctaaggcaggctcaatctcaaatatctcataacaatgtcaatcaacaccttcctttaaaacattcagaaggaggcttccatggtatactggggtcatgcttgctttgggtcctgtgacagacttggtcaaaaccctagctactcctttgcaatccttttaatcttgggtaaattattgacccctccactcagggtctggtttcttggtttgtagactagagctaatgtcaaccgcctttaagggttttgatgacagaataatttactgtgtgtaatgtacccagcagtaatggggttttacccattgttatttcctttaatggtattttgagtattgtacagaactggtgcagtaaaaacatttccttctcaagtagctgctaccttctaaaggcaggacaaacctccagtgaaattcatctctcacatcactcatatacagcgacataaactgctcagctcacttttcaggattcagtagaatgctggacccatattttcctccttgtgctaaaacattctgcagatttagtaccatgtaaaggcatacagaaaatcaatccaggcaattgcttctttactttctgatcagttcctcccagtttatccccagctttgaatgtacttcatctcttctatgtagaccattatcctctctgcccgcacagtcctatcataaaaaaaaggttcaaagcacttcacacacataaaaaggcttgttattaaaatttctcttctgtcctccctaatttgatattttctgaataaaatcagagagagatttctatgaaatttatgtatgagaaacattttgattttaaattcttacaattaggttttatatgggtttctttattatctatcagctttcaagagtcaaaattgtatctgtttatttggttatttttttcggtgacacattttatctattttattttattttttggcaaacattaacaagtctttttgggaggtgggaactcctgtgcataatggaagcgagttgtaattcttccagagtgtttttctcaggtgccactggacatcctgttagacttgaagagttagagcagctggagcttgggagagaatattagtaaatggttaacagtaaaatcggcttttaattttatctttttaatgtctaggagacattggagccaataaagcttagttactacataaaatgatatctattaacaatgcttccagtgtggtctctttctttgttcttagagccttttcttacaagtaggtttagttctttaaacctttgaatgtggctccatactgagctagattcttatatctcataggctcaagtcacctatgagcccaaccttttccttttatatgattgttactgatatttaataagtttcatttctccttgttatttttaaattaagtttcatcagcctacagcagatttcgaggtattttctagttagaatcgattgtttaaactgcccacctttcttgcttgcttttcattttgtttcatagatgactgccgtcttttgtgttgattatcttgctatagtttgtttgtttgttttgatctgtttttggaagtatagtgaactgcaggaaaaaattaaaaacaatagaatattgattacatcctaatattgggatctttttattttattttattttgagacagagtcttgctctgttgcccaggctggagtgtggtggcatgatcatagcttactataaccttcaactcctgggctaaagtgacttccacctcagcctgctgagtagctgggactataggtaccatgcatggctgatttttaaaaattttttagagacaaggtcccattatgttgcccaggctggtcttgaacttctggtctcaagtgattctcctacctcagccttccaaagtgttaagattataggcatgagccgccacgccctggtggaatctaattttagaacattaatatgaacatacaaaaaagtcttaatttgattgaaaaagaaaagtcctttctttcttctgtcacctcccgagtgtcttagaagatctgtatttacaatttcccttaaattggtaagacatgcttttgccttaggtgttttcattaaaattcataaacaccagacaaactcattatttggatgcccaaatttaataaaaatataaattcttttggttcctattttctccctactttcttaagacacagtaattaatttatgctgagaacactcatttttgtcttagctgagttccctaaaactttcagcgctaagttaacaggtacatgagcttttttcctcagttagatgccactagtccattcagtgttgatagaaggctggggttgggtctggtgccttagcagggccaagtgtagaccttataggtttaggtccgtaaacttcaccttatatttttccttccagataatgctacatagacatggatttcagtcatagaaactcaaatgtgtcacttaatacagaatgagtcttcatgatgtcaccaatttggagtgggcatagcatactgggccagtagtcaacttgcctgccaaatctgatccatttgtagtggttgtttttctgaaattacaactaggctgacatgaaagattgccagaatcgattattgatatctaccatgaagtcgggagagaagaatggtaacggtagagccatgcatttgccgtctttaggcattatttatgaagaaaacaaagaaggactccttttcattttactttgatgcctcagttacaaaacagaattctacttgaaagattaatataactcattgctgcacatcttgaataatccacttaatttcaatattcgtaggatagtcaggtcatataaaaaataatagcatatgtaaaagtctagtattatcaaaaaattataagctgtgaagtttgacttctcaaacccaaccttctcatactataatgcagatgtgctttgctttactccttggcattagatatttcaaagactgttgacatttgaaaaccagagtagctgaacatggattttctaaagaacacactctaattctagaaaaaaggcagtgtgatctttattattttgtttgatgtgacagactgcaagggagtatactctgtggtcatagggatactctcatttcagaagcagccacttacttgaatccacattattactgttacgccctccaatggtaggttgttggcaagtatttattaccctttctgcagtgtgtaagttaaatttcttttccaaggcaatggggccctaagggaaaatcaaggaagggggagagtgagaggagcctgggatgagacgtctggttctataacttccttccaagccattagttgatctcttggatcagcttttctcaaccttttgtgtgtaactttcctggcagagttgttgaattatgtgcagccactttcagcaagctgcttaggtcagggggcttttctttggcatttagctcccacatacttaaacaaaacctcaatttgctaaggtttttaacactagaagcttgttctccttatctggttgtattatttcttccacacattgttattcataacacatctggctgcaggttacagcattttggctgagcttcaccatgctaacctttgttacctctcctagggtttaggaaacaagcccctctggattgaaatattaatgatcataagtacaacagcaacccctctgcttttcaagtaatgcaattctaagccgaagggcagcagcaccaattataactacgggaattctatatactctcccagtaggatagacagatgcacatacagggactcagctgggctctgatacttgtaactcaatgcttccttgtgctttggtgtttcgaagctctgaaagagaaaaatgattctagcaaggagatttggttggtgagggagaaccgctcacaactgctgagctagctgtatagcaaattgcccttaggtagggtctccttacttcttgtaacactcagttttggagatgagggaagcctatgtgacacacacacacacacacacacacacacacacctctctctctctttttctctttctttttccctccctccttccctcctctgggctgttttcagtaattagaatagtgtaccaaagaatgtagtagtacattttattttcaactcaactgccacctgagagacgccctgagacattcagcccaagggtgaaaacaaatgagccaagattataaaatgggtcgagtcacatggtatagggagcctgttggcagaaacagattcacagactgaatcttttgaggctgacttttctgctagactagtccctaactccaggctgacagtcaaaagccttagatgattagagggcataatgaggttttgtaaaggtccatgagttctcaacaggaagaaaagagaaaaaaagtgtagagcaccaggcagggaaaaatttaggtatttacataaaaagagagtggtgccaaaagaataaaactgcagaaagtcggcaaacaatggggaaaatgttgctgagaaacaaaagaacaaagcagtatgtgattttttaaaaaaagtattgtatatatttaacaacatgatgtttcgatatacatatacatagtgaaacggttactacggtcaaacaatattaagcatccaaatgagagttacagataatggcactcatcatttattgaatatctatactgttccaggcaccattttaagtgcttggcatgctattgacttatgatccttgtaatgaccctgtgaggaagggaatattttattaccattttacagataggaaactggaggcacaaaaaccttaaattttaatttgctcaagatcaaccttacatttttaaccattatacgtcagcttcctcccaagagattgaagaggctttttaagaagaggttggaacagttggaaaggccagatggaaaatattgatcctcaaaaaatctgtaggattgagctaggcaggggagctgatgtctattccaggcagatgaataatattaacaaaagtacttcagcaaaagagataccttacaaaagagagctttgtaaatgcatgatttttaatggttgattcatttccttgaagcaactgattaacttactttccttttcctctataactctgaattcagccctggtgataatgaaatgagttttttttttttgttcttttcttttctttaaaccgtaactttcttaaatgtgatttttacagatattctttaatgactaacacattcctgtgcttgagtgatgttaaatggaaactttaaaataaatctaaaaataaatacagttgatggatatcctaatagataatatcctaatggatattgtcttaacatatcctaatggataatgtttaatataaatgggaatgctcatggtataaaaaatatgtctggtataagctagtgttgtttaaaaatgtgtattggtatgtgcatatatttcaaaaagattgaaaaaacatatctctagttatctctgagtggtgagaatatcaatgacatatactttttctgaatttcctaatttaaaaaatgacatgtattatctctataagcagaaaagatgccatcaaaagtaaaaataaatatggctctaacatcatgttttagaaatggctccagtagataattaagttatgaattctaacctataagcatatacatacttagttctactttttatttgaattaaatcttttgactttatatgcaagatagaacattgacttccaaatctgtaacagaattagtcaaacctcaggaggtcaaaatgaaaccaattctctatcacacattgcaaagaaaactgccagttcctgttctaaactttgggtccttgaattctttatctgatttctagtgtacagcactacttaattaggagaagaaaaacattgttgtgtattttaaaaaagaagaaactgtgtcttaaggcaaaaatcagcctaattttctgtaggttatattcagtcattgtgtctgaattcttagagctctttgagaatgcccactaactaagaatttggatatatgtgctcctagttagagcctagaatgagcaacaaaattggtgtattccattacagaaatataaacttatgaaagcataatatgttgatgttaccatttttattgatgacataggaaaggaggatgcagaagggattgaaacaagactcggaagcactttctgactatgagcaataaggtgtgaaaaaatgtggagagctagtatgagagctggtaaagggaaaggattttaggagaagtcaaatttccttggggtgattctggttgggggaaaaggttacccatttggaaattcctccttctctatagattgagacaaatatccccagcaaatgctttatctttttacctggagtccaaggcagccactgtgctctgctaataatgcacgcagaaattctttgggaatgccacttattgtggttaactggcttgcccaaaccataaaccctggagggagcttagttaaaaattgatgggccattgagattaaaagagcaaaacaaacagccacaaaacaaataaataagtgatgcttcttcagttagccaatgccagaactcttcactgccagttggaatttgaatagggtagaatatatgcaaagaacaggcaaaatgcctctctcagttccattgcataaaactaagaaacttcccacctccaatccttcctcttgtccccagagcacaaaaattatagatttagcccatgctttttgactatctgctcactccttgggcagaaacatcaatcaccttgccatccgcttactctgatggggctgcatagtttttctttttcattgtctgtttgccatcctagcctcctatagcaaaacagattcaagccaattgcaaaattaattttaaaaataaatgtcttaaaccagcgtagcagtaaattaatttcatgcctaatctaaatagttctgttaataaaagtagaatgcgtatggtacttgagaatgactgtacaggggatgattttgctggctttctcctctggatgtgacattgctcatggctcttcccaactgctgccagaagctgtgttgattgtaggttgtgggtgcttaacagccatctggaaggaaagttggcaacacctagttgaaagcatatctcaaactgagggatcctggctgccatctcggttagtaaacactgtagcttccccactggattgaacacttactccaaattcctaatgggaagagaaaatcaagaaggagggaaaagaataagcatcacttgaatgctttacaaactggccattcattaaggcaggatgcttttcttttattccagaactcaatccaggtgaagtgtggtccatttctttcttaatctcattagatagagctagtcaattactgctcaagtttaaaaagaatatgcactctgtgctttttagaaaccagagtttgtaacagtctttgctggaaataagcaaagaagcaggagacataggatgattttgctgtatgtttattcaacactacaatgccagttctggaattattctattgaatctttttctcttatttgctggactgtgtcctctcaggaagtaaacaagtagacttcaagagtcccttaaattttggattagaggtagcagtagtaataaaatagggagcttttgttgagaactctttcctgcccaatcacctgtggcatataagacggcaccacaaatcagatgtggccctgtgtattctttctcatattttctttctcgtagttttcagggtcattctcagaaacctggagagtgatgatggatagattccagcccactgtcactctgggtgggtcctttcaaaacatcaaaatgtgattttgctgtcatttgagtgtcaatttcttttctctcaagagtatttaccaagaacatcactggaaagagtttgtcttatacccatattttaagcacgcaatgcaggatcttagtatttttaaagccaaataaagcaaggaagacataagtcaatagagaaattgaaacatagaatctagatttgttgcttaaatctgattcaagagcttatgcaatccttagaatgggactatttctatagaatcacagtgagtttgacataaatataaaggagagagggtttaggtataacaaaccttgttgtgttctaaactagaacatttttatccaaactagatgttagtttacttttatactagagaaaaaacatgaaactatgtagcaacaaaatattgaaatattttgacttacgccacatctttttaaactttataattttatttttttgggtgtttcactggtgtgtttaggtgccctcacaacatattttgtggaataaacttatactacctcttggcccatcgttacttttaatgagagttttgtgaagcacaactttacagtgggtttggctttctatttctatgattcctggtgaattttagggccacaaattcaataacaaagttgttaaagtattcatttagtttagtattctcccacaaacctcactgtagcctaactctcttccttgagttaagaatggaggatcctttgtgtgtcttaaagtgctgacagtttcccttggaaattctgttggtttggggcaccctggttactccaaagtaggtgggatgatgccagatgaggactttactgtcaagagaatccagttgttattgcttccttcttatccactttgcttaccaagtaagcacagcattgtgttttctgagtctctcacagaggctcgagcaaaggagcttcagtctctctagttctttggcaccatcgattctgatgactcagatacttgtccagatggaatcattggaatcttctctacataatgacactgtggtgctctcttttggaggaccatgaaattgttccaaaattaaacctgttgtttagctttggttgcatggacagagactatgatgattaattttaaatgtccacttgactgaattaatgaatacctaggaaagtggtaaagcattattttggggctttcctatgaggatgtttccagaggagattggcatgtgagtttgagtggactaagtagtgaggatctaccttaaagttgggtaggtagcatctaatgtgttggagccttggatgaataaaaacagaagaaaggcaaattggtctctgtctctcctggagctgggacactcttctcctgccctcagacactaggaccccaggtcctccatccttgcaattcttggacttacaccagtggccctcatgagttcgaaggcctttggctttgaattaagaattatactattggctcctctgatttagaggtgtttggacttggactgagccatgctaccagtatcacagagtctccagcttacaggtggcctgggtcttgggacttagcctccctcatcatctgagccaattcccctaataacctcatattcattcatattttttttctctctctctcatctatctatctactgttagttctgtccctctggagaacactaatacagaaatcatcatttactcaaattgtttcaagaacaagaagaaaaaaagaatacttaaagattcatgtggcctaaaattttagtgaaacattcaggcttctctcttgaccgtctgctttatctctcacacatacacatctgtgatggaagctttgcttttctacgaatcttcattatacacttcctactaactggtttggctctggtcccttatactgttagtttgcttcaaatcttatgtttccaactctaaatatgattttatctcccccaaataacagtttaagttcttttgggttttctagaaaccatttcttgagaagccctgtttcattttattttaaataacaggtcctttcaaagatcacttgctaagtatgaattatttgcctttggttcatgtttgcgcctctggtcaaatcatttctgcaggggtcttatagtaaatactgcacctaagaactatgagcattacatttctttgtggaaaaggctgtgggcagggcccacaatgactaaccacctgtgtatctgatatgcaatccttagaatgggacaatttctatagaatcacaatgagtcagacatacaccttgtttcattctaaactagaacatttttatccagtaactaaagtagatgttagtttgcttttaaactaaagaaaaaacatgaaactataaagcaacaaaatattgaaatatttagacttatgccacatcttttcaaactttataattttatctttttgagtattcaatgccaccagactgaagcctgcatatttctctgaggtgctctctgaggttagtttcctgctagtgtggctatgtggagtgtgatgttcttataatcgacctaaatatagtttagttaaaggagaacatatggtctttcagtgttgctcaaggcatgatttcactggactaatttcaatcaggtactttgttttcagtgcggcacttaacagaatcataggcagtctgagctaggagtggccttacatcgtctactccaaatcaagtccaacccctttatatttatagaaaataatttggccgaatacaggtaatctgtgtgggtgaaaataagcttgctgaattgcagggcgagtcttttttcaacgtcccatgctattttcgggatagatataacatatagctttaaaattgatattcatcctaagtccttcaaatacaggtaaataaaatagagcagattatgtgacactaactgtaaatgtcctgagaatggtagaaacctctgttgactataactggttctaaaccaagatggtggaattttattttctcaaatgttttcagcatttaaaatttcccttgtatgtctctcttaaggtcccaatttcctcgaataaataggcaaacaagaactaataatgtattttctttagctacattctccctcctgatgctatgatttttaaaaatctcatgctttctgcaaatattttaaatgataaatttttacacaaggccccaaaatagcagcttatgtgcagatgcataaagagaaggctgtattttgtatgtaaactatgttaatgcaatgaggagaccattttttgtttcttttcacagcattatgacctcctaactgtggttctgttattttgtatgtgtgcaaatctccaaacttgatgctttgatcaagcaatatgtcatcaaatatcccttacataatgcataaaagaaagttttcattcttagcaaaaaaaaaaaaaaaaattctcatttcaacagaataaatatttattgaatcagtgccaaaatgttcagtgaagaactgagtaccctgctggtacttgaggtctatgtcaactacagtttgatggagggctttttctttggtccttaaatgggtagtattttctaaagctagagacttttatctgcctccaagtcagtactgagtgcagtgtttgatatctttgcatttgtaacctgacccatttactgagcaatgcaacagggatttgatcatggataagaattccaagttaacaaatgcaaggggattatggaattagaaaaaaattataattttaaaagcctttaaaatattgacccttgacaatataagtctatgaatttaaaactgttttgatgaaattcgaacacagagtaattaatgcatcaggttgccaattctgatgcatcacatcaatctactaatttgggattaccagacattatgtgcattctaatcaataactctggacatggagagcatcacctatgaaagttttgcaaaaataattgaacctaaatctaattaagcttctacacctagctaccagttctacataaatgtcatgagaaaattagaaaagggggaggagccattgtactttaaaagaaacaatatacataacaacccattgaaagggatatacgttgttaggatttaaattcaaatatgactataaaagaatatttttgagataatcaaggaaaaatagacaagtattagatttcatttagaggtattaattttgttaagtgtgataatcttataactattttaagatatctgttagcaatacatactgataaacttatgagtaaaatgatataatatttgggacttactttaaagctgttcagtaataaaagaaaatgtgggagggcaggagcagtcatgaatggcaagttgtaattaatttttgaagctggatgatgggtctatgggagattattacactcatctctatttttgtgtgtgtttcagagttttcaaagtaagaaaattacaaaacaagctaacagaggtttgtcttcttcctagagtgggcaagatctttagaaccacaactcaggtttgacttggtaagaaaaaatgatattctgtaggttcccacactactcaacactgaaggctgacaacttatttattaggagagggatacctacggtattactttggtctattactggttgtgtgtctatgggcattcacctctgtcagccattagagttatcatttgtgatgtgaaaataatagtacccatagtatatgattgtaatgaggtttaaatatgacaatgtatgtaaaatagttggtacaatgcccagcattcattcactcctcaataaagtggagctgttactgtctttacctcacttaacaaagatcaattgagtgccagttatgtgccagaacctgtgcaatatccacaggattttatgacaaaaaagatacacttctccccatgaatggttcttaatttatttaaaaaattgactcagaagagattgatgttttgttgatataaaactgttaaatatcagcagtttcatgcagttcaacttggtaactaaagtgagatatgataatggaggcagcatagttaagatgatagattctagcactagaccttttggacttgaaacctggctctggcatgaataagctgcgtgatcctgggcaaagtcatctttttgtgcgttagtgtcattgtgaagtgagggatagaatagtacttaccttataggattgttatgaagacggcacataacatacacagcacagtaattagtaaataatgagccttgtatactatagtaatcagcatatgtagaaagtgatgtgcgaaggcacccaattgtgggaagtgcagataatcatattgggtgttgggggtttttactgaggggatcatagaagttttcacagagaaagtatgacatttgagattcaacaggaagaaggagttatgcaggcaaagattactctaagtacaacttagacaaaggacctggaatgtacaaaggtctggaagtgggagggaagagtttcaggagcagagagaagtggagtagggttagagtttaaaatgtgggtctttggaatggaaaggaacagggcatgatacagtcatggtagattgggtggtttatattttgataatttggtaggcaaaagagtcataaggagatcttaaccaagagaacaatagcagtattgtgatgaattgcaattgagggaagacttcttgggagtttataaaaataacctactcagaaggtggtttctgttatcaacagaatcagtatatatatgtctgtctatctgtctgtctatctaatctaatctaatctaatctaatctaatctaatctaatctaatctaatctaatctaactctggttagaaatgggaattcctggtcccacttagaattatgtggtcccacctcacccagaatctttaacaagatctccaggtgagctatagcatgttgaaatttgaaaaacactggcttgacaatgtcataggagagtctgggctaagacaggaatagtgggatgtaaaggagggtgtgaggaccactcccagatatatttaagaagtggaactgaaaagatttgactgatatggtatggggatagtgggtagtaaagaggatgcccatcgagaatatgtctgtgattacttattagggtttctttgtggatggcaatgggaaacacaggaaaaggggaaatttggggggaacagaggtgggaaaaagaactcattttattgcatattaagcagcctgtaggacatggaagatccataagaaatggattgaggaaaaaggagtcactttataatgaggaaaatcttaagaaagcggttatcttaatgtcaaggaagagtcccaaaaggacaaatgctagacatatccctctctactgttcttctacaacagaacaaggacaaattagaattggttctctagtaagcattaactactctgaaaaattttgagcttgtaaagtcaaagatctctggttcctctgtcaagtataaatgcataaaaataaaaccgtaagacacaacaaagcttggtaatttgtacgtaattctcctccatagacttggcaggaattcaagctctggaattggagaggttaaggagtcctagtgattccttggcatcattgttggtggacttgttaaaaaaaaaaaaaaacacttggtttggaaggatgtgaataatttagatatctgaattcactatctgctgagttgaaatgaaatgctaccaaggggtaggcttgaaaggttatttagccagattgtggaatctctaaatatgcaatcactccccaactcagagttgccacatttagcaaaaaacaggacacccagttaaatctgaatcttagatgaacacaaataattttttagtatgtcttaaataatgcatggaatatacatatattttaaaaagaatcattatctgaaattcaaaattaagtagatgtcatatattttatctggatacttcctccaatgccctaattatattaaataattgcaatatatatattgcagatataatgaaaatagcaaataatgtttaagggctaagctgagaattttgtaaaacattatgtagaaatttaaagcagtgattaatacaaacatgtatatattcaatttggagaaaaagaaacagaacaagcttgctggaaaaattatgccatgatttttcttcctgtgcttatgataaaattactgacttattttttaaaccctgcatacgttttagcacctcattctataatcataatacagcatttagtggcaagacagtctattattaaggtgtaaggtatcaaacaaacagtagacatagagctgtgaaggtaaagcctgatgcttatttttttaaagcagactctgatattaagcagatgtgcttgtagtgaacaaggcaatgttgaaaaatcaaactctattgcaggtagcatctaatacataatggaaacctccttttcggttggatctgttttttaaaattttaagacttgggtatatattagttttttttcaattaaattcaacaaatatatcaaacagaatatgcaattaaaaatagttggaagtaagaaatattatgaggccacagagaaataaggaattacttccatcaagggtcatttgagaaggtcttacagagggcagcatgagagcatcttcttaaaatacaggatttgaaaaaacctcagtatgttattttttttctgattaaaagtaatacatgcaggaattttgtagaggggagtttaaaaaagcagcagaaaacaattaccctgaatctcaagacctagaaatactgatattgttttgatatatttccatccagtctttctctgagtttttttttttttacccagttaagatcatactgtgtacatgcaattttctgtcctgctatttcacttaacaaatgtcttaaacatttctccttgtcattaaaaactctctgttcacatcatttaaaccaatcatacattatattggtgagtagtgattttcaatataattgtctaactttgggtttttatgtactgataaggtttttaagcaactgttttacatttaaataaatttatatctctatttctgagtcttagaagtaaattttgggaattaagggtataaaacgacatgaatggtcttgacatacatactaccgaactactttataaatagattatcccaatttagacttgaagagtcaacagatagagacaggaaacaaaagagcactatagggcataggtggggaagtgtagtatgtatttggcaacaaggaacagttggaatattttggagcataatgcatgagtgatggataggtacaaacagcctgaaaaggcactttagaaccaggttatggaagctcttaaatgccaaactaatgcaatgagctttctttttgcagggagttgtgagccatggaaggcttctgagtaggagaatgccatgactttagaactttcttccagttaattataggttattaaatgtctctgaacttttggatcatgaccaaataatatttaaggtcatcagctatcaaaatttgaatgtctggaaataaactatgccattggctcctgatgtttaaagacatcattgacatttaccttattgaacataaattgatttttacacacttctgtcagtgactacataaagctcctggaaggtaaaaagtgctaggtcaattctatgtcatggaaacctttaaaggtgtactctggtggtatacagaactgtgagtgtcataaagatttattgaggatttaagatgttcttaggaccttctagcttaatgatgtgccctgtaagtgttcaggctctgagcaggaccagaagagcaaaaatggtataaaaaggctattcaggtacatattgtctatttaaaatctgtacacggtttgcaccttttccctaagtgttctgtttgtctatgacatgaaatattcatctgaaaagctaaataaaatactcaaatttattttatattttctaggcaaaactgtttttttaaattttcaaaattaaaaacatttttttaagagatggggtctttctatgttgcccaggcttgtctccagctcctgggctccagcgatcctcctgcctcagcctcccaagtagctgggactctgactcgaactgactttattttattttctctcatcacatagatgtttttatggagccattacagattcagtttaagattgctcagtctagtcaataggttgtctctttctgaaggaaaaagatggaatctgttaacttctttcacatgagtgcatacccacaaaaaggaagatggaaccccagatggagaaggaaggccaaacaacaccacaggttgttttcctggtgtctgcatcacatgtacttagtgggtgggacaatgaaagcttccaaatttagaatctatttaaacattgaaggttctgtgtttcaaattcaacttgatcttgttcagccttggattccgtctcctgctgtcacaacatcccttctcaattcgaaagggaagaaaagagattcataggacctcaaatagagtttctctggcatggctgtgcatcaagtgtaaatgaatcagaaaactgagcattaacttttacttgaaatagataagactttaaaaaatagggataaaaatgcactgatggtttgaaatagcaattcaagtagttttatggcacttaccaccagacatgcttggttaagagagtgaggtactccttcgacattatagcattcgtcggagacgttctgttaaatctaaaatgtaaatagcttctcccttttatattatgtttgactctgacattaatgctgtatcctttaagtgactaaaagagtatttctgactaagccttctaattttgtcataaaactttgctcagaatgaatttttgcttaaaaggccaactctaatccatttttcttttggccaatttaaagcaaataaatcaggtcagttctctttatgacacaaaagggaaaaatgataagttttcttacttcatactcttttatttttgaatttctacaactaaaatgtctctttttctcctttaagtacaagctgacaggtcattaatccttaatgtgaatttatacctctgggtattttgggaagaaaactcattaaaattcttttgttttatatgtgactgtcctaatagaaatttggagttcatgtttagaatttgtttcaatgaatagaaagcatagaaattcttttaaaagagttgaagtatatgaaattacttctacctacagtcaatgctgttgctctgatcttaaaagtctgctgctaacttttctgcagaaagaacataagttctgtaagctccatattttcaatgtgaatagatttattccatttgaattatctggataggcctatgcacttaatataattttctataatgtttcctgtttttctgtgaagcactgttttatttttctttaattctaccaaaaggtgaggcattgggcaatgatcttttttttttttaaataagctcttacttggtcaaagttagctagctatggcttatgtataggcccattttatggatactggtggatatattctgcagcctgttgctggatcatagtttcccattatttcctctctctccagtttcttccttctttatagagtgcttgaaagccttctaaatgaaaaagaactgctatcaacaaacttatatttcaagattattagagagattttatcatctgtaaaaacttcccatctcaataggggatgggtatacctgcttctctgattgtccagaatagcttctatctctttttattctagccactgataacaacacaagaactgatgaagagagatatgccttttatttgctttctttttcttaagcaagtatatcaaactcttccatggtcttaactgtattctaggcatatgtttgaaaactccattcatttcatgtttccatacttagcaaacatcaactatgccttgaacactgtgttgggcactgggagcacaataatgaccaaagtagtcatcatccatgccctttggggtaggagtgaggagaatgtggcaatcaatgctatctgacttgttccacagggaataaaagtgacagctgcgataagtggtattaaggacagacatggtgctatcatgtgtataataggaagaactaatttctactgaagcgcaaggaaacctttcttgaagtacgtttgaatgaaaggatgtactgagggacattctagacaatgtagcttatggaagaaagtggtgaatgactgtaatgtaggactgaaggaaggctgcagccttctttcacacgtaggcttaggaggggtcttgtgaggtgaggtgggaaagttatattgggaccagatcgtacatgactttgtggaacagacagtagaaaaaaaggatctaggagatagtgatttattagataagagaggtgagggagagagatgtgataggataagtaccatgtttttgacttgttccttgtactgatgatggttgttcttcattgaaatgttgcttttctcttgagttcattagattataaactcctatagggtcagagttatgtttccagatgaactagtaatcttgaatattaaagtaatcaattctggtctgcaaaattctctttttactctgaatggcctttactcttttatggtgaaaatttacaaatatttactcaagcatctgagttcctttagaaacaaggccaaagaaaatgcaaataatgttattattataactttgaaataatgttattattagaacatttgaaatgataataatattaatactgtattagtcaggaattctaaaagctcaaatcctccctgtattgtttaatgtatttgcataacattcacgggagtatctaaattgtgaatttccattacaaggataatgcaaaaaagattgactttggcagtttctaatcctcttatcgtttcttttaatataagtgataaagtttatttatctatacattttattcagagctatgctagtggatcaagtaagactgcattcagaaacctgggaattgttgcaggggtatgtgtcttctcccactatcactaaccttctcctcaaaaccaggagagtaacaatcttctttgctgtggtgattggggaatatgtatgtgtagtttcattacttgcttcagtattccttgtttttgtttgtttgtttgtttactgtttacatcaaaaactaccatttgttccttgggccaccctttcatctattgatctatgattccagccatagttcccttcaaacatttattatcaattacacactgtgcatgaggcactgtactagtgactctggacagagaaaatgacatcatctgtggaagccagcttgaaggcttccagtgctccttaccgcctgatactgtgcccttgtgtagtctccttccacagtgagtcaaggcttgcctgtgtaactgaacaagtattacggaggtgatgatgtgtgattttcaaggcttggtttcaaagggcattgggtcttccatcttgtttccttgaatcacttgctccttgaatcacttgagagaggcttatttgaagagggactgaggctacttatcgtaccaaattgtgagccacatgagtgagcagacaccttagaagtggatcatccagccctatgcaagccttcagatgactgcagtcccagcggacctcagacagaaacctcacgaaatactctgagccagaaatatctaaccacactacttttacattttttccccatcaaaacgttgaaagataatcaatgtttcttattgttttaagccactaacttttggggcgatttgttacactgcagtagactccaacactggttcctacctgaaggtattattctcccttctataacggaggagggtagcatggagctacttgatttacaaagggctttcatcctgataaacccattgtaagttgaaaatactgtaagatgaaaaggtcaaattcaaaatttgaagtacagtttccattgaatgtgtctcccttttgcatgattgtaactttgaaaaatcctaaatcaaatcatcgttaagtcagggactgtctatattcacatctcagccatgtcccaaacaataataaagttcaactatagcctcagcaaatagacagttacaattcgagcttttcagaattcatgccatagataatagtagtgacttagaattttctagcaatttgcaatttacttttgcagttcaccaagtactttcatacaataactatagtcctctgaaagcagagcagattttatagataaggagttaacaaatctgtattgagtaactactgcaggctggtcatgaactaggtactgaggtcatagcagaaataaagacggacaaagtctctgttttcactgaagaggggaggaacacttaaatggttaccagagcatgcttgctgccaaggatcaggcataagttgctatggaaacataaaacagggggaagccaaagtaatataaggaccaagaaaggcttctctgaaagcattttagttcagttgagccttacaagattgcaggagttatcaaatggaagaagtgtggtaggtaaagatgaggcagaatattctaggcatattaaagcctgagtcaggatacaacatgtgttgtttgaaaacctgaaagaactcaggtatggatggagcaggacaaggaagaggacacttggtgctagatgatgctagagaagcaggcagaggccaggtactcatcaccttagaccactcagtaccacatgtttgtgaaagttaaagggagaaacgtgaagtgcaaggctgcgtgtggctgatctagaacttgaactcagattttctttccaatcctttcatcttttagtactcactatttctttattagagtatccttgacagatagagagcgagcaaccaaatacctgctttaaaagagaggaataaaacagattcagtgatggcaaagacaagacttacctaaaattataactcatttgtggtagagtaaggaacttcgctattaatctaagattcatggaattcaagttttttttgttttttttttttgttttgtttttctgagacagagttttcacactggttgcccaggctagagtgcaatggtgtgatcttggctcactgaaacctttgcctcccaggttcaagcaattctcctgcttcagtctcctgagcagctggaattacaggcatgcaccaccatgcccagctaattttgtgtttttagcagagacggggtttctccatgttggtcagactggtctcaaactcctgacctcagatgatccgcccacctcagactcccaaagtgctgggattataggcgtgagccaccacgcctggccggaattcaagttttatgacacaaaattcagaatgtaatttgttttatccacttggtttcatttaaatcacatgattgttccacttgattgccagaagcatctttggcagtgttgcagagcatagatcacaggggctatcagagaccttgaaggatggtccagctatagccatccctattaaatccattggggggcatctagggatcatctagaagcgggtcaggcatttgtctgcattgaatgcctctggcttcagacctacagagaaaaagcaaagtctttacataaaaaacggttgatgtatttgttatcagaaacagtgagtggagagagatgggaagagtctgtgccattccacaactacttttggccaagaactaaaaagcataaaatgggcagtggctgttagttaaggagaacaaagtaggctgaggccctgaggcctgcttcactggggaacgggcatgtaaggatatggacgggacttatgaccttccatgtaagagaacagaaggaaggtagcttatgcagcatttatatgccgaatcaagaatgggtatgggcaaaggataatgctgattgaatatggagtttagaggagatagtcacaggctgctattgttaaaagtttatacttccactgcctatgacaccttgaaagattgaaaataaaggcaagaagagagacaggatgttactaacatccacttactcttggcagaaaaagattaggaaaccaagaattcttgaattactaaccagagactgcttcctcaggcaagaagaagctattactctgcttggagattagggggctgagaatgggagagaggctgatccttggaaaattgcaaagctgctgaagaggcagcagctgaacatattttccttttatttttgaatgtttcaatgtctgaagaaaaagatatcagtcatagtactgactggcagtgatccagaaaaacctctggagagcttagaattctgattggcacttgagtgaagttccctgacacccaagctgaatctgcggcattcatgcaggctgagttgtgttggtcacttttttttttcttcttatgcagagggaaaaaaagtagtttctggggcctgttaggcttaaattccttccagagcaattagggcacctgctttcttcaaatctctgtccttctatcagtgaaatattttaacatctggaacttggcagatggaattgttcttatattcttaacattttcctttttatttggatttttaaaaacataaccatcaattcttctagtcctctagtgtttctgaatgagtgctcatccctgagaaatgctaaatccctgagcaagaaagggagttacaatcaaggaccaaatgggagtacattacattcaccttccacctctaccattctagaaatctttggtctacaatcctagaattttcaggtttattgaaattttccccagaggggttaggatggaagagaaagccattctctttctcattcctgttcttcctttttttaaaaatatatacttattaaagacatctatgtatcaggcattggggaaataatatgtattagtccattcttgcattgctatgaagaactacctgagactgggtaatttataaagaaaagatgttgaattggctcatagttccacaggctgtacaggaagccatggctagggtggcttcggaaacttacaatcatgacggaaagcaaaggggaagcaggcacatcttacatggctggagcaggaggaagagagagaatgggggaagtgccacacagtttttaacaaccagatcatgtgagagctcactcactgtcatggaacagcaaggggaaaatctgcccccaggatccaatcacctctcaccaggcccctcctccaacatcagggattacagttcgacgtgagatttgagtggggatacaaatccaaaccatatcctaatgattagcacaacatgctggagtcttcacagagcttagagtgtagaaagaaacacacatatgaaacagagcttttatagtccagtgtgataggagccaaaataggaaattgtaggtaactaggggacaaagtagcgatattcagcttatttgggagggagagtacaggaggtcaaaaaggactccccagagaaattgccatttaaacaaagtaatagtgtcatgggctccttggggtgttgctttgctagccagaaacctctgtggccagttgcatcttctgcccctgctgcctctgcttgtgctaccagcccagatcctatacctgccaagggcgagacaggtgcagagtggtgaggggtgtgtgggtgagcaagtgctgggtctggcgtctgcacatagccaggcatactggctgctgtggcagggtgggcagctccgggcaccagcacaggtgctggctctgtgacaggctgttgctggatcagatgtactgcacgcagcttccactgtgggcactggcatctggatgaggggaacccagtggcactgggaagcttgtagatgccgggaatcacagagccccaaagacagtgtcatagccctggctctgagagcctccaggtctggttgccttctcattgaccacagtatggtgagtggggtctgtgtttcagccctgtttgcgttatagctctttcagtcctgccatttggcaggtcctgagttcttgtcctgtgaccaggaagaatgaggtatgtgcacacccaactggagggcgagcaaggtggagaggagcttcactgagtgatagaatagctcgcaggagacttggagcatgtagctcctttcttcaagcaggttgtcccgacgagtgtccagctctcagcagagaggagacctgcagtgggtagctctgcagtgggtagctcctttctgcaggaaggttatcctggtgacccgaagtgggttgcttcttcctgtagctggtagttcagacaactgtgtgagtctggctgtgtctagggggtttttatgggctcagaagggaggaagtgcatgctgattggtccatgggccccacaggtgggccagaaaaagcactatgagtaaattctcactctgggtgctaactccacctggaactgacagtccagcccccatgcttcaggctgtccctggcttgaaggtggagcttcactagggacccacccctttccacccaggagcctgtcagcctcctgctgccatcaattatgttgtcaatggcacccaggctgttcacgctgaggggcagctgcaggcccacgccaagccaccctcagcacccccttggccttcctcccatgcctgttggcacccaaagtctgaagggggccaagggggcaggtggctggcatgtcagcaccaccctgagtgtgcatacacttggccgggttgtgacagtgcccaggcttggtgacagatcccagctgtgcttagggatctgctcaagtataggctggatgctttcttgcccacaaggatataatgaggactcccatcctgacttctaaattgtctgccaatctgtatatctattatgacttcccaaaataggtacagagatctggcatttcccaaccatctactataggtagacacgcattgtaaagtgccttctggggtctggaatcagagtgtctgagtttgaatcctggcacagccatttattagctatgtgaccttaggcaagttacatggcctctctatgcctcagtttccttatctataggtaaaatgtggataataatagtacctgtatcataagattatgtgaattttaagtgaagtaaggtcagtgcctaacagattgtaagcattcaatgcatgtttgctatcattattattattattaccccattattacccccatcttacagtgggagagactgagttgcagggggtttaagaaatgtgttacacagcacttagtgatagaatcgaggatgccactaccctggtgaaggatgacatactctgcttttctggtagagagagcagatattgaacaggggccgagagcaacaagtgcagcaacagtggttcacagacatttgccaggtggtcaggacttgagaactgacaaaggtgagagggcaggtagtcccctcccattccctctttatcttttggaactcctctgagaggtggaggagaggtagggtagcaagttattctttcatgctacagcccggtcatggagctctttgttggatatggaagatgtaaagtggtggtcaagcttccagtagctaatggcatacagtgagaacacagttatctgcatggtctctcacagaaaatttaacatggctgagcctgtcagttctcccaaactattaataagtgtaagctaatttttcttcagatattactatgcattggatgctgttctgtgtactttacagatattaactcaattaatattcacaacacattggtgaggtaagtactattattatcctaattttatatacgatcaaactgaggcatggagaggtgaaacaacttgctgaatcttatagagctgtaaagtggaatcaggacttggccctagatagtcagactgtagagcctgtaatcttaacctccatacttagaactttcttaactgtgaagattaaaagagactattgaaacaccaataacattgttccccaatccctgtaggagcacagaatagcttagtttgccttcttcccctacagacttgtcttcctcaacaagaaaataaagctttagtttatttaacaaatatgcatgcatatttttattatatataagctatttaggtttcatagggggataaaagatgaataagatttcctttaagaggtcaagatctaataagccaagctttctatagagacaaatacacactcagagatccaatacaaaataaagtattaaatggtatcacagagggataaagtgatatggaaatatgatcagtaccatgggtttggaggacttgttcaaaaaacatttgtgatttattagatccttaaccactgattccaagtggaatctgggggatcggaatggagatggttgttaaggtttgaagttgtttgtgttcaccatttaaacatctagtaatttcacaatccttttgtgtccaaggtatcccatttcaaattattacctatctcagtggccttttcacattattcacaatcttacattactttgtactatgtatcttaaaacatttctgtctcatttagactgcttagactgaccacataggaattgctttggtaaccaggactatcgatatctctttctgtgttaaaaattgacttaaggcctctctacagtttaaaaaaagttgtcattttacattttgattacttttctatattggagatgtcagtagtgttcaaagtctggaaactggcctacctaatatttttactgctctcttttcattgggaaatatcagtaatttgggggactttctctaaaattattctatgtctgcaacatctggtaacatgaaatacttcgtttgcttataattctttcttctgtgtttttaaaatataaagagatgcctcttctgtttatttgtgcccttgtaaaaaggatccaacctgctgacaggtgcccagctctgcctgtggggtccaaatgaggtatgcttgctctgcctgggagtggggagttcaactgaagctttgtgtttttgctataaacaatcctttattatggatcttgaactctggctttactataacgtaattcttagagagtagctcaattctttcagtgtaacttgatataatcattcatgggtaaatcataaccaggattactgatgaaagagccagggttggtagaaagagtcgtagggacagggaaacttgccccagtcttgctgctcttacattgaagtgtctcgtatctaagagtcttaaatatgttttatgaatctatttgcatccttgcactcaatctggtaatatgatatgttttggctggactgtttatatttcaagaaactttgtttgtgtattaaaataaaaaagatgaatgtgcatcacatatgttgaaacatttgcaattagttggtgctactctcttaagtgattgggcagggcaggcagacagccagccttggcaatcttttcagattctttttcatgccaatttgcaatttgtgacagtgccacatttttatcgggagggctttattgagctttggaaagaagtacttcttgacctgaataggtgggttcttggctagaaccctagaactgtttcttcctctaatatttttccatgggaatgttggggataaaacattatagaaagctcagtgtggaacagacatcgacccttttacaagttatcatggagaggtttgcaatacagtttgctgtagagatggagtgatagtaacacagaaagtcttgaacgatctcatcatgaacacaccgtatctatcttagttggttagataagaatggaatcaattgactaaatcaaatgaaaattttaatccaaaaacactgaggaacctaaaatgctggaaattcaaatcccaaaacacgctgtttgggatactgtactagaacctcatagaacaggaatgcaaggggagaagattgtggagggaggttgtataaatgggtttgagaatttattcctgatctcaaagagtagggagtttagtatggaattcgataataattcatagaaacttaattaataaaagcccatgtcatatgaaccagtgccaaattgattgctggtatgcaagtagagaccacaggatctaagaggaaatgaggaccctgaatactgtgatggtcagagaagtttccaaagaagacatgagttttgttcagtcttgaagagtagagccaaatagccaaggtagaaaggggattaaggaacagcatgaccaaaaattctgggggaaggaatggcatgttaagagaataatgaatatatatatatatatatatacacacacacacacatcgagtagaaacttcacatactgtaagttggagatttattttaggataaaagtagtgattttcaaaacttttaaccttttgcattccagttggaatagctctaagatttttctttgtgttggttttctgtgttgttttacatatttgataatgtggagtaaggtatttcaattgatttgagttgggaattttaatgcatcagactatgaaggagaaagtaaaacaccatgcaatactctatcccttagagaaaagactattgttgacattaggtaaatattccaggcaattctctttgaatgcataaagatggatacatagataattattagataatcataaataataaaaatgggatcatgctatacccgcttataaattatattctctattattttcatgtaaaaatagtgtcaaaatacagttaagactttacatgtcagagaattcaaaatgacatttcatttcctagtcatatctcaggcaccatgtttctcataaccttaatacctttgtgacatttatttgaaaatagtggctgtgcaatcctttattttaaatttcctgggttcgtgtatatatctctaattcttattcacagtgctgcatttattcaagggcagatttttaaactttttttttttttatagaggggaatggagtgcagttttgctatgttgcccaggctggagtgcagtggctatttactacagtgatcagggtgcactataggcaccaacttttgagctcaagggattcttcccaatcggcatccaaaatagctgggactataggtgcatgccactgtttctggcttcaggagataatctttttaaaattatactttaagttctgggatacatgtgcagaacgtacaggtttgttacataggcatacacgtgtcatggtggtttgttgcacccatcaatccgtcatctacattgggtatttctcctaatgatatccctcccctagcccccaaccgcccaacaggccccagtgtgtgatgttcccatccctgtgtccatgtgttcttattgttcaactcccacttatgagtgagaacgtgcggtgtttggatttctgttcctgtgttaatttgctgagaatgatagtttccggcttcatccatgtccctgcaaaggacatgaactcatccttttttatggctgtgtggtattccatggtgtatatgtgtcacattttctttatccagtctatcattgatgggcatttgggttggttccaagtctctgctattgtaaatattgctgcaattatgatcagacacttctcaaaagaagacatcgatgtggccaacaaatgtatgaaaaaaagctcatcatcactggtcattagagaaatacaaatcaaaatgacaatgagataccatctcacgctagttagaatggcaatcattaagaagtcaggaaacaacaaatgctggagcagatgtggagaaataggaatgcttttacactgttggtgggagtgtaaattagttcaaccattgtggaagacagtgtggcgattcctcaaggatctggaaccagaaataccatttgacacagcagtcccattactgggtatatacccaaagggttacaaatcattctactgtaaagacacaggagtgaattttttaacatgttaaatacattgtattaaatgacactatggatgcaagtggcagacataacttgtactaactcaaagaagagggaatttattaaaactgcactgggatatctgatataaatcaggaaagacagggaaagttgtgtcccaggacagtgaaaaaaaaatggaatggaatctctgcttatttttgcacattggccttctcttgcacaacagaccacataactacatggtggggaatatggttgttcaaggctcccaggctttaatttccacagccctccagagaggtactgactctttttcattagttccatcttggaagactttggggaaagactggtgtggcttgggttaggtgcccaatggattttgaatagagtcacatggcacacacctggtaattggagtacattcctgtttatcttgtgttctaagatgagggagctgagcagccaccctcctctaattggtgccagatatatacataaaactacacttgggttgacatggacagggtgcttaaaatgcgattataaggccataaaatttagaacactttggaacttcattgtttacaattaaggaaataaggttgataagtgtacaatttatttacatgcatgctgtaatctttaaaaaatttcctttgtgtattagcactatatggaaatagaaaaaaatctagactatccaagtttgtaatttaagaataaagcagtatgttattatcagtggaggaaaaaggattcaaaacagctttctggtgcaataaagtttgcctgctttcacacctggataactgacttttagaaatatcaaatttaacttctaaaatatttttcctctgctctgggctgtggaaaggaggctataggtgaatattaaaaaatggtgactaatcttaaagtataagatgaaaatggacacctaaaatagaatctgagaatcagagaattagaggtggagctgaactatctttggcaggcccggtcacttgcatcatattaagtcacaaggtataagatttttgagcaagacttctgaaaattgtagtttttgatgggtgcaatattagtccttgaaatattactatccagaaggagaaagtaagtatgcacaccagcaaacaggagaagatagctgagaactatgtggatggaatcctgctgaagacatgagatggtggaagagtggtttctgagggagtatgtaccagagagggtattatacctagcaaaaagtgagggtgaggagatcagcttctgatgctggactccaggggcaggagacaagagcattggtcatgcagacagagcaggtgagtgagtcagaaaaagaacgaaaaagataacctgaagagaagttggtgaataagtataaatcttgaaccaaatatgaagttggggctgaacggaagctattaaagactatgctctgggaaaggacaaacagaccagagagcaggtctacagttgtagctgcaccatccaatagatagccaccatccagtagatagatagccaccatccaataaccaccatctaacagccaccatccaatagatagccactagccacaggtgactctttaactttattaaaataaaatgaaattcaattccccaatctcattagccacatttcaagtgcccaataaccacatggggttaggggttcaaagtcagtgcaggcatagaacatttccctcatggcagaaagctctattggatagcactgagaggctatgacagtgagcctgaagtgaacatgaacctgaagccttgacccatgtcctggcttcattcttcttttcatagttattggaggttgactatgttgggaatctacttggattctgacactaacatttgggggcaagcatctagcatcactagagagacagatactggagggtgggtttagatacgaaactctgcatccagagttctctacttccttccaaaatataaataagtaagtaagtctaggtctaggctaccaggtaaagacttgttttaattatggttagccaaaccctagagtgatccttctgcttccaatcaaggctgtatctaagccatataaaacagtcgactggccaagctctttttagatgttgcttcatttctccaaggacatgctaactttgtccaggatttagtgggaaaattagaacctttacagatgtcaggtctttttacataatagcgacaacacctgccttaccgcaagaatgtggtggtttaagatcctgaaactaaagccatctcatttttgcataactcaatctgttcatgaacaataaatgttaaaaattgaaattcacattctgctatttgtaaatattaattctttggcttggtgtatttattttaacttagatattttttgccctcatcaatgattcttcctagaaacagggacctttttacagtaattgactccaattttgttgaactggtaagcaattaggattagcatatttatttagtttttttgctaaattttgctcttttaaaaatggtattgaggaataatgtcaaggcaacacatagaagctcattttctcactcgttgaactgttcctatttttaactcaatggctttttaaaaaaattacatcggctttctgaggctattaggctactcttcaattaggtgttgcttctgtgtacacaatagcatgccagaagctggaaagtgctcatgcagtttcagaagtgtttaatttgctaccagggaatagcttagtttagaacagcgtaagaaaagcagagaggagaaaacaagatactatttctcacacctacagttaccaaagaaggataataaaaccaatgagacctaatgtttattgagtgtttacagtgggataaacattgtgtcgttctttcatgtgttttcttcgaccctcacaagaatgatttcaggtaggtaagattgttattcctattttgctgatgaggaaactgaggcttatagagaaagagcaatttactcaatgacacagagctagtaagtggtggatctaagatttaatactcaaattgtttgattctagagaccttgtttttaaccaccactttcatatcttagttgactaagatggctgtttactgaacaccttctttgctttcccacctgtatcttttctcaagctgggctggaaataccctactcctagttgtctttgaagttttatcatgctttaagattcttatctcctccaagattttccacatctcttcaaccaatatgaacattcttcttctcccttaatcttgcaaaactttgtgtttccattccattatttgcaaagcctgctttgtattggaattttatgtctgtactgtgagcttctgaggagtcagaactttaacatatagaagttttatttcccctggcacctagaagtgtgttttaatgtggtaggtacacaaaatatttttgttgctgacaattttgaaatttcactcacaacttaatgaacactgtatttgctgactttgggttgaaagggagggtgaaagggctgaggtttctttttttttttttttgatagtctctttagttgcacttccttatgtttgaggacaagttgtctgttgtcctttaatggtgaccttcagggttacaggcattcattcaacagatactcattatcatctttcagtcttctaggagccaggcatatgatggtgacaaagactgattgtgtcactcttctcttggagttaagggataatctggagaggcgaaagattgtcaaaagttgtcatctaaatatataactgtaagggtactatggaggaaaccaaagaggtgttaggatgaagtgattgaggaagtgatatttaagggaagacctgacaggtggaaaggagaaagctgggatgagcagaggaaggtgtatactcattatgggacatgatgtgtgagagtcctggggtaggcagaagcttgaagaattcagtcaccatctgttcaaatgtcacgcaatacataatatagcaacaattgctttctggtggtcagttctccataatccatgcatgacaggtttatgtgcatttcatggttatagtttaaaccgtgcccatatttccattttgtaggggctttagcagccacttaggggtaagtcatgccttttgtaggcttgtttacttttgaagttgtaaattgggtttaaattatagcttcttacaaagcaatcatcatatttactgttcattgaggacttatatgttaagtagtatgttaaccattttattcatattatttcttttaattcactaaagcagaaatcttggcaaatgtttccacaatgggccagatagtaaatattttaggctttacagagctcatcgtctctgttgcaactatttaactttgctgttttagtacaaaagcagctgtagataatatgttaataaataggtgtggcagtgttcccgtaatgctttatttttggacactgaagtttgaatcttatataattttcacatattgtgaaatagtctttttttttttttttaaatgttccaaccatttaacaatgtaaaaaccattcttagctcacaggtcatacaaaaacaggcactgggcagcatttggcccaggggctgtaatttacctactcccacctgctctcctcattgtccccgttttaccaacacagaagctggagtcactgggaagttgtttatagccaacccaggtctggtagattccaaggtccatttctttaactcaaatgcctcacagcattaacaatttgttgggttcccagaatgatttcttaatagtttctggtgtataaattttagtccctaagcagattgcatgtttctcagagtaagaagcatttttttttttttttctatttgtcttgtttccctccacaggaatgatggacttacaggaggcattcggtaacgggttatctgcccttcaaatggtttctctggaagtggctatgaactgtagatttttgggaatacatagcaatcatatttatattgcccacctaatttagctttttaaagcagggccctgaaaactgattagaaagatgattaaaatcctggatgccattttcacatcatatttgtagaattagtgtcatatttccagttttcaaatgcaaatcttgtaaaacaaaaaagttgatttctcttcccttgtggaataaattgccccctagtctcctgaaccatggggaattctttaatttcttgtttttaaattgtgcctgtggggtcaattaaaggtgaatgtaagagctttcaaaatctaaataaaatgagtaaataaatagaaaaagcttgaagaaattcattaataatacaccagtagccagtttgtcttgatgtcttgctgtctctggacctcttcatctcccttcctagttaccttaaaattaaaattcagatgtgacaaaactgtcgttaacatgtagaaagtggctaatatttttaacaatgagaactggccttgtcattttggattctgcttataacagacattttccatagattggaagatccaaaatgtaccttggtttggtaaaaatatatttaaagcatacacgatacgttacatacaaaaatacatatatttttacaaacatttcagcttatgataacatttttagacatcaacttaaaaacatgtaagtgggtagtttttcaaaattcttgtgggaggtatgatagcaacaaattttgaagaccactgctttagggcatttttgttttaaaggtttctctgaaagccagaattcttcaagatccctaatgattatctaccttgaaaggcccacgttttactagaccaccacactccaccccccacgtttacttgaatggtaaatgttaagagaatgctgatgaaatgacacgcatacaagctacagtagttttgaaaagagtctttttcactctgtagtatttgcaggaagaggaagtgttttgatatttaccttgggtagaaacatgaaagggccgttttgaagtttcacatatttcagacatgcagaagtatgtcattgttgacgatggtaaacagctggtaaagataactgcctggaacagctggaggagggagttgacattaccctgtttagaagtctggaaacagagaaagcatatttttttaactacagtgtacatcagcagcatagatgcatagtctatgtgcctataaagcagccattcaagcttaaaaatatgtttctctttgcttgtttgtgggacaaggctgtgaacaaaataaattaagtgaggaggttctgacctccgcagctggcttccacaaaatgatatgaggacttggggggaagagaaatgagttttgtctggcctcggtggaaccttctcaagggagccttggtggcaagttatatttctttggaagtcgacttgactttactctggttcagggaaggaagattctacttaatagaaacctggtgtccctaaagaatcaatgccgcttccaattggcattttcaaatttaaacaaattattgtcttgtgtaggctcagccttttcattagattttcatggggaataaacttcctgaatttgctgcgggctgagtgtgtatttccattaattagcaatgcaggaagcagacaccaaaaggtgagcaaacctaggtaagactcaaaagctcttgaacctgacaaagctaccgaggttcacaaaagtgaagttacagcttctacactaagtggaatctcaaggtcaccctggagaattatttggccctaattttcaatggcaacatcatcataatgttctttggaagcacacttttatctgtcttttaaaaatgacatttggttttctctagtataaagaaggagtgttacttctgccagtataaataaataaataaataaataaacaaatacttgatttcaagaattctggcttatgtcacttcgagcaaccccagtataagaaaatataaaataaagacaacaaatatgcatttaaagaagtcatgtaatgaattttagtgcatttaaaatatcattggatgtagaaataatgatttattttttacttaagaaaaaatgaacttaaagccatgtttaccgtaagttgaaaagttgaaaaatgacaaccatctggaaattatttggtaaaatatattgtaaacatatatatatagtaatttcataatttagtttacatagcgaaaatccttaaacattgtaagtatgaattagtcattggatacataatattgatttaatctgctaggcatttgtttgaaaagtatttgataaaatccagtttttaatgctgcaacttctgacaatttgtgaaagtgtatctgacttctacggaactcaagagtatactgactatattttagttgagcttagttatttgtgtgtgtgagtgtgtgtctgtgtgcgtgtgcatgtgcgcttctggggagggatggttttcttttgaatttttcaagtttctttccgtaatgaaaggaaaattgaacaaacatcatcctttaccatcgcttttagtgattatgtacccatttgaggctcggttttacagcctgttctctactcttaaaaggttattataaggacagataaataataggttaagtgatttttaagttactcagatgaattaatttgtaaatttaacattgtactgacattcggatccctttaaaaaatttagcatgcaagtttgatatgtctatgatgtacatgtcacagaaaacaaatggtatatatattcacttaggcattatatatttttttcctggggattttgcattattcaatttttatacttataaaattagttaaggttgaggactattgaagtcctgtttcttctaaggtgagcagagtggttgaaattggaaagttcatttctgctaagtatgtaagctcatgagctaattctgaattgcctgggaaaattctgttcaggaacagaatgacagcattggtacagaaataaaaccttaaaaaggataagagtgcttcagaattagagtttggaaagtgacagaatagcgtacctggaaggagttaatgaagacatttagttattagggctcttggaagaatgtttcctgctaaatggcccacaaaatctaacatcaaccactgccaaagtgtttttttattggaatgaactttactattatatcttaagtcagcctatgcaggccagttaactgtcatgtctaagagtctaccatgtgtccaatggagattaaagatgggtgtcatttacctttcaatatcataagtaacactcattaaacatttactatgctaaagctttatagaaatcagattttctaataatcctgatagctctctaaggtatatattatcatgatccttattttacagttaagacattaaggcacagagaggttaggtgacttgcccaggtcatgcagttgataaaggctgatgttagtacttgaaatcagggaactctgaagcctgtgttctgaatcactgcttttactttgggagtagtgcttgaagagctcaccttctaataaaggcgaatgggtacatacaattttaatatagtaggataaatataatcaaacaactatatgcaacgtgcaggaatcctatagaaaaggaactattaatattatttgtgggaataatcttggtatgggaagaaaggcagcttacagagtcagtgacaccttggtaaagcactgaggataaagagagcccttccaggtgggcaaagtggggatggtcattcacagctgagggaagagtctagcaaatataagagatttgctactacaacatgaattcatagagctgcagatactagttatgataaatttttaaatggggtgggagtgggtgaagtgttcaagagatgagaatagagactgacaacaacaaagacagttgggtcttttcagccagagtacgatgttttggccattaaagggtaaagtttatttagctagattgcttagttggacatgcatggtggacagacgtggtggctgggagaccacttcgggtccagtgctagaatctaaccaaagataatgggggtgggcaagtgggtggatggtagagcacctgtgttagggaatacaagagtaaaagcaggcttggggaagatagtgagtttgaataaaggttgtacaattacttgatgagtcattcagtgatattttgtactttctttatgtctagaattttctttaatgtacatttgtatggggacagatactcagaggaaccagttttaaaaatcaaacagcctctatttgctcattcagtcatcagagttgtctaaagaattagaagactgagtaaatgcctccagctctgcttatgtagtcaggtccaggatgtaaaaggaggatccgggtggggggcgggggggcagtgtggggagcagtagctatcacctttctacttggcaacatgccttactactctgaagaccagtcattctttagctactgttaatgctgattacacagaaaattgcacaacacttcactttgatttggccaattgaaatgcccttttagcaaacaagtggcactaccaaatcagtcaattcctggatcaatgcaaatctgagagttcttttactgcggagagtggtcctatcatttgagtgtagtcaattagcagaggtgatatgaaaacctccagctctgctatagaaagcaaataggctttgcatgattattaagcagttttctcatgtgttctttccttgatggagttaaaggcattagggtttgaatcctgcccatgctcatatatagagcatatgtcatcctctccatctttattgctattcatattgaggtcaattatgagctgctgtttaatgtcaccatgaaattgttcaattattttctcccagcgtctaagcagctatcctcaaagggatttgggaggagtggtattaatactgaggaattcttaagaagccagtaggcctgcatggctctccttttataattcaccccgtctcaattatgagatccaaaatgcttgataagttgttaatgaatagcttagtatccaatcttctctttggctaatattggggcacatagacctggttcccttccttggtggtggagttgtaactaaagaagggaagctgctatctttgtcacgtttcccctctctcccgcaactagactcttctggagcgccaagggcccttgcttggttattcctaactaaggaacaattaggatgagttttctttttccattttaatgttggaatgggaagcaagggggtaggggaaaagaaaccttttttattgagtgaaccataagtatatttgtacagcgtcagtatttttctgtttgcagtttacagataaaatgtacttgtatctctgttattattgtcatgatctgcagggggatgcaaagagaaatatttctgtaaagaaacaaatatcagtgcttttcttgaaatagatcatgtttcagttactccttttttctctgtatagcctggtaagagttttctgaagccagcctaattgcttctgatcattgtatgcctgctgtaggctctgggatttggttatgtctgtagcaatgcaaaatcagcaaagtgtctctttgagacatttcaatttgttcatttattcatccaaacttttatgcataaggcattgtgctaaatttattgggagaaggggtataattggatgaatcagccagggaccctctttaaaggagtttgtgatataatggaggcagtagacatgcaaacagttaactcaaatacaatgtagaatgaactgtgttataagaggaacaaatagaaggctgtgggagaagagatgaagaagcagttctcaaagagatgacttcctggaagagaaaatatttgagctgagccttaggagtgagaaggatagttataggtggcatgggattggttggacattcaggatgagagaatgccatcagcactcacgaaggtcattacgctctacgatttcatcttcttaacaattccctgccatgacttttgttgtggctttcagaatccttctatttcctaatgctgtgttactcctctgggctcatcatttttgaaaatctcattctcatcctgtcttccccacttagtaagtacaatagtattcaattttcttggcttagtgtatgaggtctgccatgatctggtaggcacctatgtctgccatttcatgtctttctgcattttaatttaggattacctattcatcaggcatggattttcacccgtttgtcttactgccttcaattccttcatttcttacctgcctgtcaaacactaagttcaatcacttcaatttgtactattgttagcactcaagacctggtttattgtactagtactgcaggctagtatgagtggagccagtaaacagcaccattacagagtgctgtttaaccacacttgttcataacttgtgcccatgttacccttagataggaagatttttttttttttttggtgaagggagggattgttggtattagtttagtagcaaatataattttcatctttagtcattatttatgtatctttcagtcatattacgataactatgcagatgctaaaataggttaattttggaggaagagcttaagaaatgaaagatgtgggattgtgggagtgagaattatctgaagacagtattagtagttgaaggagggaaggtggcgttggtggagggtattttccaacattttcaaatttctttctaagaaaatatttatttatatgatgttggtcttcaaatgagaagtttgattcagtaaataaatattcaaaaaatgattattgcagggcattgggtatatactcgttctggggtataagaaagtaggcaaaggcctactttcttactgtgttgactttttaaccgaatccttggaaacccatgccagtgattgagaggaaccatgtaaaaagctaatttggaaacctgaaatcccaatcaggagattttgcaaggttcaatttatttcctacttatgcttttgcccattcagtgcctgacccactggcttctggtggtattggcttccttctctgatctatctgtttagtgtcagttcccaggtatcagattgcataactgaaccatctacttgacgtacctctgtgcaccacatatgtgaaaggcctgtcactgtggtcagatctggtttgcagatcctgctgtgtggacctgcatcaatgtctaggctctgtctaggacagtttgggagagatcagacgtagatgttcagagcagaaatgtggattaagtggtatgacaactagttctaagtcttgaactttaagccacttgccttcattgaaccttctctcttctctattacttatgattgacttttggtttcacaagagtatttaaattttattgcataatataaatgaaccactttgttttcattaggggactccatacaaatgcaaacactttgtttaaaaacagaagtatatacagttgtccctctgtatccctgggttctgcatccctggattcaaccaatcttggatcaaaaagattaaaaaaagttatgtctgtactgaatgtgtagacctttttttttttgttttactattgtctacataatatagcataaaaaccatttacataaaatttattgcattaggtattataagtaacatagagatgatttaaagtatatggaaggatatgcataatttatatgcagatattatgacattttatatcaggaacttgagcatccccaaattttggtatccacaggaggtcctggaaccaatgcccctcagataccgagggatgagtttatatacttttccacatggtgatcacaatttcttccttcctgagccttatgcaattagttactatcatttctcttttctgttttttttttaaatcccattaaaggaagtaaccaaacttcttttattagtatctgaattttaatctactatggtgtttggtcataggagaaccagactaagaggaagtgaaagaaatatcatttttgttgccaaatcacttttcaatgcattaagggaaaaaaatgcaaaaagacaatgctaccaaactggtgtatccagtgactctgaggttacccaagttctcagcgctctctacctgttcttcaggatgaaaagttctcagtcccttcaccattttccttttcttcctcatgtgaagaccaaggtatattattccaggaatgattagtgatgttgacccttgtcctcaccaaagttatgcttgaatcgtctttcattgaaaatagggacaagtcccataagaggtacatctactcatcatggaatagatcatgtcaggacccaattccctaaaatacaggaagtcactgtgaccttgtgcttatttagggcctagctgctctgtgatgagaaactccttcacttcccagatttgtgatccaactggctgttcttcctgtaactcagagccacaatgctattctaggaccagactgcaggatattcggtaaaatgccatcatttgttggctgctggaaatatttggctttaaatcagttacaataaaagtccagaccgaagaccaatggccacattttagcttaatcaatactgaaagttaaatacttttatgactttcaattttcttttgcctccaatctcttatatatatgttatagtaataataattagtatgttcagtattggtggatatagtatatcagaaaagtacacaacttgcttttaagagtacaaacaccagtcatgttcattgtaaaacatttagaaaatgccaataggcaagagtagttaaattctgttactcaaaaattttacttttgttaatattttggtgttatatgcttttttagttatttctctttatatttaaaatagttttgtaagtgatccacgaatgtgttccaaatttttcttccttcattagagatctgaacacattattcctaaactcaaaaatctttacttgctttctgttgtgtctatagaataaactcagtctccctggcctgtttttaagactcctcatggtcttttgactgtttccccttaaattttctgatttatactttggtctctgacatatgaataggtgcagttttgggtactgggttcctttgtctcaaatgccctttccccttcattatccatctggctaaggctgttcaaatcctctttcctttgaatgttctcagaattaatgtcttgctttactctgctattcagctcatttatattaagcataattctcagtctttccttaactccatgtttacatactgttttctctactagatttcaagtctggaaggagaggattgtcattctcacaatttgttgtgaagactcatttactgtcagtgttctccactctgctattatctgtataaaggcagggtccaccttcatagctccaatatcatgttcctgttggctggggagagaatagtacaaactcaacaatagtggacttacccttgtgtctttttttttgatggagtctcactgttgcccaggctggagtgcagtggcacaaatttggctttccgcaacctctgccttcctgccttagcctcccgagtagctgggattacaggcgcccaccaccatgcacagctaatttttgtatttttagtagagacggggttttaccatgtcggtcaggttggtctcgaacttctagcctcaggtgatctgcctgcctggggctcccaaagtgctgggattacagacgtgagccaccgtgctctgtctacccttgtgtcttttgcagctcttagcataatgcctagaatatggtaatgcctaagagatatttgttgaattgaattgttattgactgtaagtaaggagcatacatgggctatgtccaaatttgttggaacatttttgaaggaagtaagcttattactctgaaacctattcagtagtataaagcattttgaatagaaatacagttaagtattattccaggtagcaaggtgtattacagagtgttcttagtgacctcaatagccactatcacctttttaaacgttattgttcttactatttttgtttttgtttttttgctcagctggacacattgtcattaagattgaatcaataattttgtcatcagccaccttccaggtagaggattccacccatttgcttaagacccctcaagtctgccttcatcattttgggtatcatgggtctttactatcatttgtttagcttttccacattttgtgatatcttttcagcttttacctattagaattatttttccaagtctacttttggatagaatataattttactgtttttggttgttctctaagtgacattgaaaggtacacactttttatttttattttttactctctccaggatcttagtaggaaggaatgcattttatctttcaccacactgtgtaatctccttggcatcctctcctttatttgttggatttttcttttaattaaaaagtcattccaggtatgttttattgcttatttattctttccttatttactttctcaaaaactaattgaacataggaaagtaaatctttaattctgctaaaaatatcaagactattattgaaatctattcttacacattctttaaaatgagcaccccaaatcattgttctttcttgggacaaatgcaatgaagatagtgtgttagctatgcgatatcatcagtggtgtgcaaatgaggaaaaaaataaaaaaaaaagtggatggttctatcctttcttctaaagactaagctggtagctgcccttaatgttggtggcattttctaagtcagaatcatgtactacttggtacatttagaatgatataagaagtgattgggattaagttgttataaaacatcatgtattttttaaacttgttgattcaatgttctctgcaacccttttcaatatagcctgatcttttatatttctaattatcttgtacaaaaacatatcttgagcacctacctacaatgtacccaacactgaatgtactctttgagtggtacaaatggaatataaggtgttacaatgagaaaatacactaaaatggtttcgcctgcattttctttttagttgcgctattcctgctttcttactgtatgatttcctttctttgttacatagtagattgcctttctctcaccacatttttggttaaaattgacttatgcaagaggggctttgaagtgaacaatataaaaaatataattttcagtcaaactttgagcttcatggttatatgtttttcattgcaatttagaatctataatattttatcatactatatatgccttatttgtgatttggaatttgtacctgaattattttctaaaacaagatattataggcaggttccaatatggtactagactactagtggcaatagcataaacaaataccagttttgagatttgtgaatacacatttcttacaaatttgtggctggtcaaaatgctgactttctgattaattagaagtctgtagcctcaaataagcccaaatctatttattcatgtcatagaggggatacactgagtacttccaaataatttatattatatggaaatagtaacatgcttgccattttttctccaccattttagattgattcttaaatatcacaacattgtacatcattgctaattgtcagaactgcgtaccatattgccatatttacttctatagcttttcctttgtattttaacatttgaaataacttcaagtgaattcattcagattcattcttaattactagattcctaataggactgtttaaggaatgccttatatttgatgtgtggaaaatgaaaggtgatataaaaatgcagtgttatagggtagcttctgtgtaattttggctcactggaatgccagttggggaatggcaaaggctaatactcaacagatggcaaagtcctaaaacctataataatggttgcagttattttcattactgtcatttgaaggcacatgcaataatgtgaaaaggcttgaactgggtaatcacagtaaatatactcaaagggaccagatgcatttcaaacaatcaaaacggtgatggatattcaggctgagtgccacttctgcacatattctaggtacatttattgctagggattagaagcaacattacttgtcacagagaggagctccatttccccttttagtaataacaagcaacaaaaattgacatctgttataacacagacagaatatttcacatcctttatgattgtgtgtcattatcatgcatataaatttagtttgcagatgttcaacgtcagagatcaaaataccaattttgcctacaaaagagttgcaatggataccgaaaatctaagcacttttgaaaatagataagttaaatcttttagagtggggacaataaaaatcaaataagattaggaagaaaaagcatcaaaaggcatcagaaggggctgtgtggaagtttcagaagatcttaatatttctatttgcagctttgtaaaagcaccattcttgattttaatctccagagactgtagtttggagttgttatacatctttgttattttcttccatacaataaataaaatgaggccaacattttttccttgaaagaatctgtcattccagaaaattaattagttcacatatgaatattcataattcttcctgtgtctaatatgtaaaaatagttcttggtgattttgtgcaagggattgggtagcaatgacctacaatgatgctattaaacatagtacaacagacaagttgaccttttcaggtattcagtactcaatttaacatcactgtttgttctatatataatttcctttattacatttaggaaacagatgaacagattgatagaagatgagaggaaaattgtatattttgtagtacaatataaaacacctaagaataaaaaaaaatatgttttatggaaaactcttctccttttccccaccctacgtaacccctaaccacatacaacttcaaccaaaggaaagaaacctacgttacttgtttgaacaatcttgtgcctgcttcaaaggtactgttaacaatgtgatgtattttgcatttgcctctggggatttaccactcaatattaaagtacttcccactgtgacattttaaaaactgtctctttcctctgctgagctaaaaacataatggggatcaagaaaaccatctgaaacaagcatagtataaaatttctgccaggcattggaagttaaggcatggtttttgaccctccttttgtactgggcaaagatacaggactgctgccctctcactctgccttttcaaaagcttgttaaatgaattgcctctgccatattgtaaacttgacatatttgcccagggtctttggttcaaatctaagtgtatatcctcctagtccagtgaatatgtgcagaatgatatttgtaaatcaagacatgatagtgatgctactttctgaagaatctaaaaaaacagaattggtaggaagctgggattagatgatgagaacatatagtttcttgaaaatatttttatttttttctagatatatatttctaccttgaaaagcaaaccactaattttattgattgcttgatttctgatgttttgtgaatataacctattcttagtaaatttggtaatctgaggacatattttattgaataattttagttggggctttaattctagtttttcctgggacaaatatacggttggactcatatatatcctgggaccaatacagtttaaattatagtaaaattaacaaaattaactcgaagtttgaacttgaacagtgtgaaatcacattggaacattttaaatttagtagcaataattggcctatccataattaatacagtacttatatatattattgcttaaataggtgtttaaattttacatgctctgggtgattttgcttaaatgagttaaaagcacagtttaattaagaccaatgagttgctagaagaatgcatttggcttcatacttttcttggatcgtgtcactcgatacagtactcactaactagtggcaaataaaaaagtcaataaattcctgtttccatcaactagactaatgaacttcattagttgatcatgttatcagtataattactacagaccacattttgcccttggctattaatgcaacagacttctgtacttagaagaactgcctaagaagagaactcaggttaactctggcaaataactttgactcttttctttctaaaatcattattatatcctctggaaatagagtatcccatatactcagctatgatggttttcacattgaactgtgggaatatgttgctagacccctttgctttgttataattgtgttggctatgcctttatgggatactgttgtgggttgaaatatgttccccaaaaagatctgttgaggtcctaacatctggttcctgtgaatatgacccaatttggaaatagagtcataacagatgtaaattaagatgaagtcgtactgaagtaaggtggactcttaatccaatatgactggtgccctcgtgaggtgagaagagacacacacatacctagggaaaatgccatgtggcgatagaagtcaagatcagagtgatgcagctgcaagccaaggaatgccaaggattggtggtgaccaccagaaactgggaggaggtaaggaaggattctatccggagtctcagagagaacactgctttgctgattccctaattttggcttctaccctctggaactgtgggagaatacatttccattgttttcagccacccagtttgtggtactttgttatagcagcctgaggaaactaatacaaatttcttacttgaattattaaccataatagattaactacttagctagttaggaggaagtgatcagctgttctcagggataaatggaagtcttgaaagtccaagaattattcattaggacaaattcttaaaaattcagtgattttttttttttttttgagacagggtcttgctttgtcatccaggctgcagtgcagtggagtggtcacaactcactgcaacttcagcctcctgggctcaagcaagcctcccacctcagtagcctcccactcctgattagctgggactacagtgatgtgtcgccatgcccagcctagtggtatttttaacagataaataagaatggaggtagtggcagaggtggagtgagaagagagacaagtaaaatatagaaatttgagggaagtgaaatggccctttctgtatttttttaaaaatatggaggtttgcatcttcttgatttgcagctttgaaaacattgacttttttgtgcgtcatatgacactaataacagaaactaccccaccaaaataccaccacaaacttcacttaaaataaactccaaagaagaatccatttttcgtgtgatatgaatgacaaatgattataaggaattttaataatttatataaaaatccaaagagtcatattgtaagtactgacaggtatactagggagtttttgatcacacttaaaaattacttgtgtaattaggtacaacattaaaatgagaacagggatatatacagtaagtcctcacctaatgtcattgataggttcttggaaacttgactttaagggaaatgactactctataatgaaacaaattttatcccagcttaaatgatataaatgagagtcattttgcttgacatcactgtttacaagaacctatcagtgattttaggtgtggacttattgtgtgcataattcatatattatttaacaatatattaggtccaaagatatatctctggctttcttattctacagatggttaatgtctgctagctaagctaggtaagttaggaaaagcttagaagctcaatacatgtaagcaaataaaaaacccaaaaacatcattttagacgattctttaaccttctattctaaaattatggcaggcactatacgtaagggctttatagtttacattttgtagacgaagaatataacaatcaagaaacagtctaaaaaactggcaatggaagaaagaatgaagagaaacccaagacttagctaattcatgatgttgcctcaaatatcaagaagctggtattatgcaaatggatcttgtgagaggaaatgaactcagaactgagattatgactgtgacgtactttgagacactttcagaaagattgaaagacgaaaagatatttcttggtacaaagcacattatgattgatgactgtttgagggcagttatctttaaactagtattacagacaaaaatcccatcacttgtgtgatgtcctccattgtgttgtagattttattagcctcatggttttatgtgagcaaagaatgatctcaacatgacacaattttaatatattttctcccaagctctcagagctatttttgtctattaattttaacataacagagactgcagttcccttatattttgctgttctaagggagaattatgtcttttattttaagccaggtagagggaaagcatttttgttgttaaaataagtgaggatgattatttttcccattcagattttcaaatcccttggcgaagaaggtattgcattattaaaatttacttgtttgatttagaggtactgcttttggacatggtaagagttttgaactttaattttgatttatttgcttgctagagtgatagctatgaagaattcataacattttattttaaatggaaattgctaacagaaataactgcactttataatcgttttgagataattttggttgcaatttcacatttgactaacagcattagagatatgattccaattaagggaagtagtaaatattttcctttgaaatttctaagaaaggagagcctttctgtgaattaatgcataggttgatatatgcagaaaaccaagcactctccatagcacaagaatgttgaattagctaggaatttgcactgaattagctaggaattttatacacctgtcaacattctcccctttccttataattttctgtctatttccagatcttcattcctcatgattctatcacaggacgtgttagaggagcacacatcactatggcttatgacatttcagaaaacataacttaaaaattcctttgcagaactttattacagaaaaattgatcacatgtagtaaggaataataggatacacaaaaagtaccacatagaacagtacaattttagaaaggggagagaaagaaggagaatatgtatccttccagatgtagatccccagatgataacagggctatttctgggtggtatgattacaactggtttctattttcttccttttgttgattcattccctctaatttttatatgattaacatgtattaattgtgtaattttttttcaacttagaacaactgaattagggtggatgttttaaatcccatctccatagtacaatcaacacactagatatcaaaggctcttttttggaacaggagggcagactgctattaaatattattccagggatatgcaaatgtttaagaggctcaggtgggcatggaacaagtgtgctgggagggtatcaccaatggaatagccattaagggcctaggcagcacttaacttgagtcacaatagcactgggtctggataatagccattgtggctgaaacgccgcttagagttgtactctgtgccaaattcactttacccacagaaattgcaaatgagttatcattctcattttttccttttatttctagttgccacatcattgtacatatttatgtgatacagagtgatattttgatacatgtatacaaattatgatacatgccatgatcaaatcaaagtacttagattgttgaagggcaggcagaagactacatgatataatttgatgggcttttaaaatgttcccttacccccaagtttctctcaatcggctggccctagggttttcaattacctctgtcttcctttgggttaaatcactgtattttgagaaaatgtctttgaaaatacttgcgttacatggtcaagaccaccattctacagattacttgctaaagaccaaatctctgaagaaatgagcataaagtaagaatattgacagaggaagggagacagagaatcgtttggattgttgatcactatcagtagcaataggtgatgaagtcaaagtggagggttttttcaccaggactcagtgtgaaaatcctaagtatttgatgtgaatttgtgaaggaaggcactgaaatagggaaagaaaaattttaaagcttgctctgtacagttaaaccttgtggcatatttaacaaatatgttttcaataactccaatgatctcttggtatgttggaatgcataattttgccaaatttgcataaagttcatggtaaagtgatgataggagactttggttaggtagtaggtgcatctatccagccactcagcatctctttctcagcagggctcttttgtgtgttcttggtactactaagtctagagtaacatggagaattgtcctacaatattcttagcagtgaaactttaggcaattaatttgtaatgtcagaaagttcccagcgtgcatgtaacactagaaggaaatgtgatttcagaatgagccagatgcatttataaatatttcaagattgtaaatttcttgaagtttccagagtaataaagaatatcaagaactgactctttgggaattcaagttgttataaagctaattgaatatgtgaaggcatgttcagtgtttgagttctttttctcttttttttcccttccccttctttcctttctctttctgtcatttctccctcttttctttactttacctctctccatccctctttctttttctttcttttttttacattctccccttcctttcttcctaccttccttccttccttccatttttttttctttttctgccttttgagtatttatagtgatataatcaagcagctcagggaatttggctgcaataaaggctgttttggtgactccctgcttctcttttcttctctcaaacatagttttgagaagaggagatatagtgctagtagcagcactcaagagacacttgattaaacttgaaattttataagcattccaatgctattacattaaatgtatataaatactgacttggccagttttgccaagagtgaattaataagcattcatatgtgctaagttataagagagtctaatcagttctgcattctaacattgccttttgcttctactcctgttacagtccaaagagaatatttaaaagattccatgtttatattcttatttcttgatattagaccactacttattttgttagcattctgtcttcacagtctgtctcattcattcattatacccttttcctggcctggtatcattaaccttgctttgtaaataaagagagacacagaggtcagccttcttggcgagtgttttgtctacttattgctattgctgatattagataaaaatattgaaaaaatgcagcttcatttccttgtttaccttacctgaagttaggtctcaattatgcaccaggggattctatgctgcagtgaaactgctttgttgggtaggatgtgaccagggaatgcagactaactttcaattttctgtgaaaaaataataataaagatggtcagtgtgttgccaaactatagggatatgtgtgtttttacttatcactctgtacatgtgtatccacatttacataaccatgtttgagttttcatgccactactaccttgagtcttccttaatatataggattcagagggtttttttttcaatcattatctccattactttcacatagccaatttcaataattatagtcatgttttaagttttgcgcacattttcttttagccagaaaagctccattttaaatgctagcaaatccagtaactcaaaagctttcaaatatagtctattgtccagggctttcgtggtgcatttcaacaaagagaatctctatgctcactcaatttgcaaacatctggaggaaaataatgtgataattagaaggcaccatgggttcatcaaaaacaaatcatgccaaactaacttaatttctttctttgattccttaacaagctgagtgggaacacagagggtatttttattatagtaagacacttgatgtagctttctaacaatcttaaaaggcttagggaaaatgcagattagggaaaatgactggttaatgtaggatatctttgtaaaaagggaccagcaaccattatctatctatggttcagaatacagttagtagaggctgttggataaattttattttatttattgtatcattcaatatcttaagcctttgactttgattatctatattttatatctcatagtgttttttaaggtaactggctatagggattttatttttaactaataacattggtaatttttttctagaaaggaacatatatcttggccatcttttttcattaaaaatctatgaaaatcatacacacacatatacatataaatcacatatagactgaacacacgtgtatatataattcataaaattatatcataaatcataatcttagtttcaacgactaatattgttttaataactgttcttatggttttgtgtctgtccataatgtttttataaaagtgagagtatactaagtttactatttctgatttgttttactttaatagtatagtgttaaacacagtcctaagttgataaatgtacttttacagatttatttataattattgcatagtatttccgtggatgtgccataatttattgactcgtctccctttgttagatagattatatctttgttgttgtttttacaactataaaatataatggaatagctatacttgtagttaaaactgttttcttatacggcatatacctagacattgtattattgggtaaaaaatgcaaacattgtaagaattttatgtgtgctctctaaatgccttccaaaaggttgaaccagtttacattcctactggctgtttaagagaggatgctatatatatgtattcatatctatagacatatatgtctgtatgtgtatatatatgtagatatatgtatatgtctatagattttatgcatatgtctatagatatggatacatatatatacatacacgtttagaaatagacatacatgtgcacatataggtgtatatgtcacatacacatacacatttagagatagagacatatccatatacatatatgtaggtatgtatatgtctatagtttccatttggaaaaaggaaagttcctctttgggaaaaatgaaactcactggaaagatttaaatgataaaagttgccataaatattttagaaactctatgtttgattatgcagctgtgatgaaagaatatcaaaatataggcttaaattgacttttctcctacttctctgtaaagatttatcaaaaggagagattcattttgtggcagttattgttcttattgaacatcctgaaataagaattattctatgcctcaaagtaacactaaattatattctttgttaatatattaaacaagcaaaggtcttttaaatggtgtttgagattaaagattctgttttgtattttaattctgcagcaaatacagcttcctagcttctactgttagttggctctgatttctaattctcatctcttctttctttttacttgttgtgcctcattacaatttcaaatgaaactgtatgacgctgattggaattgtttctattgggggaaaatgtacgaattagatgtgcccaggaattcatctgcatttgagccctgctatttgtttgacacaatgggttttcaggaatgggattgcgggagctaaatctttaataaaattgttattgactgtccctgcaggaggcagtgcgcatggtggctaaacatgaggattcaaaccctcagctctgtagcttattggctatgtaattaacctctctgagtacatttactcatctgaaaaatgtaatgatacaaacctcttaaggttgttgagaggattcgatgggataatttaaatgagtacaggggacttagtaagctttcaatagatgttaggtgttactgctatctcttggtgatccacacttccctcagatgggagggcataatctttcctatagctattgcaaaaataatctgactctgcttgtcccatattattgcctcattttggaacaattatatcagaatctgtaaaataactattatgtcaatattttcctgcctgtctcccttccctctttccttctttccctttccttgcatttattgagaaccaaaggtattctatgctttgctaaagattggagaaggaaaactgataagaatcatattttgaagaaggtaacacaccagtggagaagacagatgttaatcaggtaatcacataaataaatgtaaaattgcaaggatgacaagtgctacataaatgacagctgcatgggttataagagcatataggagattggaaagacttctcagaaaatgaaacagggaaataaagtataagaggtaaacaggtgaagcagtagacttctacatagtctccctatttttgccgttatcttcttaaagcttattctccgcatagcagccagagtgaccacattaaaatgaaagatagattatattagatctctgctcaaatccctctcatcatgacttcattacatctcactcagaataaatctcgtagttcttattttgttttatagacccctatgtgattggtctcctgctacctttctgacctcatgatctttcactctcttcttacacagtcacgttcaaccacactggcctccttgctgttcttgctgttccttgaacatataggtaaacttcattttgaagtcttttgatcttgttctctgcccaaacactttccccaggtaccccctcaccatatcagtgagctcttccctgatgaccctatagaaaatagcaactctgtctctatcaggactcctcattgcccttatgctgtatttatcaccatcccacattttataaatttacttgtttattttttgttctccctcgtcatctcgactcaacttgttaaaaacatcatgggatcaggaggttatgtttactgctgaaatcccaactccaagtatagtgccttgaaggtactaggaactcatttaatatttgaggaatgaattaaggaagaagagacatggtggtaagagcatttaggacagagagcgaagcatatgtaagggccccaaggcaggtagaagcatggcagccaggggggactgagggaaagacattgttgcttttgaacacagtgaactaaaaaaaagtgtggaatactagaggcaaaaaaggtaggtaaagactggatcatacagttataaagattttcccctaaaaacaaatacaagctactgaagtattttaagttgagatggggttgaaggaccagatcaagtttatgttaaaaaaaaaaaaaaccactctggctgaagtatggatatcagatttgaggggaggacagtgtgaatgtgagtagatcaattaggagttcgttatagtagttgtgccaagagatggtgccagcttgggccactggcttcagtggataagaaaggagcggattgtttgagagcagtggttctcaactggagcagtatttgacaatgtttggaaatactttttgtcattacaattgttgggggaaaggggatgtctactggcatctattgagtagaggccagggatgctggaaaccatcctacaatgcgcagaacactctccaattatccagtcccaatgtcaatggtgttgagattgagaaactttgttttagaggtaaactcaagaactctcttcatgaggtacaaactcagaacttgctgttggagtagacatgggagttgagaaagtgggtatttcctataaaagaaaggaaatcagtatatcaaagagatatttgcactcctatgtttgttgcatcactgtttacaatagctaagatttggatgcaacctaagtgtccatcaacagatgaatgaataaagaaaatgtgatatatatatacaatggagtactattcagccataaaaaagaaggagatccagtcatatgcaacaacacaggtggaactggagatcgttacattaagtgaaataagccaggcacagaaagacaaaccttgcatgttctcatttatttgtgggatctaaaaatcaaaacaattgaactagtggacatagagagtagaatggatcagaggctgggaaagatagtggggagattgggggaacatagcagaggtacaaaaaatagaaagaacaaataaaacctactatttgatagaacaacagggtgactatagtcaataataacgtaattgtacgttttaaaacaacttaaagagtataatgggattgtttgtaatttaaaggataaatgcttgaggggatgggtaccccattctcaatgatatgcttatttcacattgcatgcttgtgttaaaatatctcatgtactcccataaatatatacacctatgtacccacgacaattaaagtttttaaaaagcaagtgggtacatctcatgtaacccaaaatatatacatctattatgtacccacaaaagttaaaaattttttaaaagtaaattaaaaaaacttccagatttggggcatgggtaactaaactgatgagtgtcactcgccgcagggttcttctgcccataaggaattatgatttctgtccaacctacatcttttctttgatgttaacaacactaaccaaaagggtagaatggatactcatgtttgtactttatgatctgggcattttgggatctattttatggtattagcatggaggttaggaaatacaacatttaatttgatattttcactcaattatctgatgccactgattcatctgactgtattcatacagctgacatctgtggcactaattctcagagctggcttcatcaaaatagccattgaatgcatcttttagggagcatcaacactgtgctaagaaaatcttggatgtttagccaatgagcgtaaaggtaattaaatattttattaactttgtatataagagctcaaagcactttcacatacatttttccttcatactctttatgtgcttgtattggcagaaagaggacaaagtagctgtattgcattatagcacaaactttcaggcaatgagacattcctgaggcttaaatttcacttgcaaactaggagaagaggtggaaaaaaggaatcagaatttacccttttgctaatgcattgtttccttagaaatgtaatcactgcatcattctttcattttgagagccttctgagattatacaagatatttaatccaatatctttatatgttgaatctgcataagaagaactggagaatgtgtgttcttttttattttatttgtttgaatgtatgctaaacacactctacagaattcaaggaatgctaattatgtgtgctgcaattgaagttatctggacccagtttttttctcttttgctgctgcatttttcatggcaagaatctggtagaagatgaaaattataaaattgaaatcttttcagtttgtgtgttactatttttaagcaggaaaagtttagtatgtacaaaagagatggtttcagtgaattcctgtgacattaatgtgctattttctctctctaagaaggaagttgagaacttgagcttgattttaggattatgtctgccctggtacccttggcgaacgtttctgcttttgccatgtgttcctggcatagttttgaggtggcgtgcattttgaaggggcactgatttgtgtttgaaagaaattaggtcctctgtaatagtcagcaatccctgtcttatctccttggttcagattggcctctaatcttctattacctccagttaacttctgcagtctgcttctattctcttgttaacatttgttgctgcatctgggatgaagcttataattatgtgtccattgccaactctttactagagttttggttaatccaggtcttattttgtttatgtttgcttaagcaaatgatgttcaatgctctttcagatatcctttaaagtaatgggatcaataatttaagcctttataagtatgcatatcctggctaacctcattttacccatgtgtctgtactgtcagttatatttacattgagcaacctcactgactcttgtggatttatttaactatgaagcaaaataatagttataaattcagtatgagaaagtattacagatatcatgtcttatcttattctccagcgtattttttaagtgggaaactgagtcccagagaaaaggaataattctctgcatttgtaataacactctgtagtttacaaaatatactaataccattatttcatatgatgttttcagtaattctgtgaggtgtgctaggaaggcattattatctctattttacaacaaggaagaaaagatgtagagaaattgagacttgcttcctcaactacctacaacaagtatgtggtaaatctggatctaaaatccaagacttaaggctgttaaccaagtgtcctttcccaaatatgatcttggctcatgagcagagtttttccatccacgtactgctgtgctgtaatgtgttgagatactgactctctcagcacttagagctgccagagtagccgttgacctctagtcacaaggatccttctcacctcagtgcaacacagaactactattatcttctgtgtacctcgacattgaaaaaacacagaagcacagttctaacatataatggaaaaagacctgattaagtcactcagtgagtttattgaaagattactaggtgcctaacagtcctgggaatgttttcacagtctgcattcatccacctctgatactcatatatatttacctccaaggaacctccccttcctaccgacagtttgtgtggttccaggaagccagctgacaacaattctgacccaggttaaagatgtgggcctcagtaagcctctgtgctgcctcttcttgtcatggtgattagttcaaggggaattatggaattcacccagagccaaccagatctcatgagactgtgacttttgggcaaaagaatattgctactgttctgtaacagactctggaagcatgcaggctgaggctgctgccaccagcctgactcctcatgtagcttaagattgaagccaatgctggaattaaggagatctgagagagaaactgagccccgctgataccatttgatgtcaagctgacaaaaaagctgaagctaattctacgctttagaattatacgaaccaatacatttctcctttccttaaaatgattagatgaagttaccgtcactaaaaatcatctgtattctttcataaatggttaaaaattctaatttgtcactttaaaggcctcatggggacaaggacgatttagaaatggatgttccaatttgatctgatctcttccaggttgtatgtttttcttctccctttgaaaaggtaattcataacctatgaataaaaacgctctctctataaactttcacacaatctaaaggtgtttttgtcatagtcagttgcctatattaattcatcaaataattattgttatgacactgaggtaggctggggaagaagacatcatctttgctgtcaaaaaatttataatttagttggtagaaaaaacatgttataatggaaagaaaattaaatttaattaatgtatataactaaatctgatgtgagtgtcactggagtaggtcaaaagaggacaaggtgccatagattcaaaagtgatagtcaccatgaaagagagaactggagtcaaatctttaggatttgggcaggtgaccaggaagaagtctgtccaggagctgcagcatagcacagacaaagactcagacaggaaagaatggtgtttgaggaaggtagtgactcaacaagatgggttgcagcagaggagttagggtgagcaacaggatagcttggaaatttccatctttgacttttgagaagaactttgggacaaagctctttgcttaagattggtattgagaaacaataacatgctagccactcttttttttttttttgaggtgaagtttcactcttgttgcccaggctggagtgtgatggcacgatcttggctcactgcaacctccacctcctgggttcaagcgattctcttgcctcagcctcccgagtagctgggattacaggcgtctggcaccacgccggctaatttttgtattttagtagagacagggtttcaccatgttgacaaggctagtctcaaactcctgacctcaggtgatccacctgccttggcctcccaaggtgctgggattcaactctttattgagcacttactacatacatgacattaggttaaaacttcacatgcattatctcacttaataataataactttcaggtaggtattattgtacctaccaaccaaccctgtaagtggatgaggcagaatgaaccaaggacagtctgcctctgaagaccgtgcagttgctctggccatgaaattccatctgtctaagatgaacagagcagtcactttgcacatgtcatgtaagtttataatggtcctctgcacatttcggtgagtattggtatttttggcaagtttaatattcggagttactactagcaaattcttagaattactagatttcaggcatttagaaagcctctattttaccatgaaattcattgttatttattctacacttaaagcaagggagtgaaatctcataaattagattgaagtaataattattaagaacatcacaacttctagggattgaattaaagtatttgcattattatttcatttttccccaacagattgtgaatgaggatgttgttattccctttgtatagacaataagactgcgatcaaaagtatttaagtagcttatacaagggcatataattagtgtgagcagagctgtgacttgaattcaggtccttcaattataagtctagttctttcccaactacattagtctataagtggccaaaaagtacatatgaaacttggcattttatatgtattggagttacattagaccttaagtggccatagagtaacaaatgagacttggcatttgtgtttactactagtgagtgtgaaaagcctaagtaattatcaaatacgagggataatttgacaaagttaagtctcattcaaactgaaagtttgaattttccatttgtctggttattctatgatttgtcaacaagtcaggataacaaatatttattgaataccaatttattaggtaaaagtatatgctaatgtaaaaagaactttgtgcaaacgctacactaatggaatagaaaatatggttgaggacaaggcgaaaacctatacagtacaagtgcgagtaatctctgagaaacgattaaatgaatattttgaggtgggacataactaatatatcataggaatattaaggactatgagtgcagaggaagaaaatatttgtagctgctggagtggtcttgggaaatgttaacatgaaatttattgttattaatgaaggaagtatttgaactactccttgaggggaggacttggagaaatcagaaagagcaaaagcagagtggtaaggaagtatgtggtgtgctccagggagcagtttgtccagaaccaatatttaaatacagggtaaaatcacagaagtgggtcagggccagcttgaggaagtcttaaagaaaaactaagaggcctgaatttaatgatgcaggagggattgcagtgcagggctctgcaggtgcagaggagtggagacagggaagactctgggagacgaattaaaacaggagaagagtagagacaaaggttcatttgttatagaaaatactggggaaattggatgaaataactaacacaaactacaaagtgattggaacaggtcaggtccccacaagttaaagggggaagaataaatagataaatggcatttcaagtaaacaatcagacaaatttaatttatctgacattctgtaacacaaagtaaactgtcatgaaaactaaatacttgagagaaaaattaaaaagataaaagaaacagagtaattaactacaaacacaacttgtaaactgtgatcgaatcatagttaacaaacaaaaaaccaaaagctgggggactagcagagagatttgaatatagactggattttaggtaatattaatgaactgtcaatttttagttttgataataattttgtggtatagtaagaaaaagttcttatttttaagagatatatactgagaagtctcatatgtgccttttattgtcaatttttttctgcaaaatatatgtatatgcatatgtgtatttttatttgtattctatctgtatctatatttacatgtaaaccttttctatggctttgtatgtatttatatctacattcatactcagacccatactcatagtcaccccatccctatctctgtatatgtagctagatccagatatggatctagaagaagtatatgtgacataatgttaaaaaatttttgaatctagtttatggatgtacagatgagcaacgtgctattcttataattttttggtgtgttcaagatttttataataataattgagctagagggaagggggataaataggtcaggacttggagcctaaaggagaagcagtgtgagtggaaaggaggagcagatgtgcagtgataattggtagcacagggtgagttttttaacccaaagcatcagaggagcctcttaggtatgagttttggcattaaggccttactgattggctgtggccacattttgaataagggcaggaatgtctttagagaaagtaagtttgagggagagaatgtacttgttttcagatgggttttgtttccagtgaatatgagctttccaattgaaccttgttggaggaaggttgtccagactctgagaagatcagagctagagatgccaattccatagtcagacacagcagatggcagtcgaaatcatgaaattggatgaaaattatgagtaaagaagtgtgcaaaaggaaaactgagaaaaaccctaagaaatgcccatatttaggtggtggaaagaaaaagtgaggagagcaaagcagacaaagcaggccaaaccagaagggaaaagatagtgtcatgtggagaagtggagggagcacacagcccatggtgaacacaccatgcatctttttgaatgaatgaatgaatggagttgtacaaaagagtgagggtcattaaagtaaagataaagagaacagtaaagacaattgcagagtgaatgaaaggcatttgggattaggagttgagaggttattttaaactcagactaaaggtttggtggaggctgttgcaatggttcattgtggaagcaaaagccagcacgagaaagtggggaagctgagtagtagagggctcctcagtgcagtttggggataggaagacctggattcaagtcatgactcttaactctataactgccttccctgggcttcagttgtctatttccctaaaaaagtggggtaggctaagtgatgtccaacatttcttaaagcactcacattccactggcccttcagctgttttaaaatatatatttagagaagactgtcccaatccatattgtagtgtcattttcagcttcctatgtgtcacagttgctttgactatagagtccctatgtagaaatagaattatcctattctttttttggcaacctcactgatttacaatgaaattattggaatggtcaatagatacatccatatagcattttgacataagcaaaatgtaacttgactgaatagtaaaataatactgtaattttttatttccaatttcaaagattattttaaagaactgaggagatgatatattatgttgctatgcattggcaatttctggtaggaagttagggggaagatcaactcaaattctgaaactttactccattataaacttttctacatcctattagttccaaatatgcagaaagggattgtgcagatgataccattctgcttaaatgacaaacctggaatgatgaatgcttttcctggtcaattaacccctgccaaagctctcagtgactaaaagaaatgctgtggaacacagtctcaagtagactataaaatatacaattagaggtcttctgaagaggatagtgttccattagaaatctaccagctccttttaactctatgggtccctatttctcagaacttttaccagaggtttgttcagaaactggctcatcaccagttttcttaacaaagctttcagatctttgttatcacacaaagagataaagagtctgaaatcctccttatgattcaggcatcatctgttatcctagatcaatgtcaagctaaagatttttggaaaggattttggcaaagtgtaattgtagattaaccccacagccttccattagataaatggcataatgggaagtttcaaacaatgagtcagaggactgggctctgatcttgagaaagctgattttctctatgaccttcaattagttatataatctttttgtctgtgaatcttttatctaatctgtgatatatggtaactacttttttgtttgttggttgaggactataggaaatacaagatgttattttttctcatatgttgggaagacccattctttctgcatttcttctaagggacctctttctccttaagcacgtggacttcactggcaaacaaaggatgtatttaacctgatgaggaaagtcaattctgaaaaaaaaaagaacattttaataaggaaagtgctggtagtgacctcatattgagtgtaatgaagcatggttggatatacatcataaattatgcatctttgggccttagtctattccaaactgcaactttgttgaacctcatggactataattctgatgtgtcagtgggatatactcattgtcatgcagtttactttttttttttttttggcaacttcaaatacttaccttactccagatctaactttctgctgagggtagcttgccacccaccttggattccattactttctcactgccatgagggactcctttccaagcacttgaattttcattttttttcttttaaattactccttacaatgactgataagagataggattcattagcacactttgctagtactttgtgctaatattacactgaagtcaggtcatatgaaatcaaagtgttctttaattgtccattttgcacattcaacatgttgcatatggcccttcaggatctggtccttgataatgtcttctactatttttaaggcatatttcactctgattttatgccttaataacagtaaagtagtaatttctcccatgcgatgtggtgtttatcacctgcaagccattatccatgcttctcttattcttgggacactttttctgggcactctgcctacttaccttctattcttcctatacacctctgctcagactccctctttaccagggtctttttcctgacatcctcattcctttaagcataaggacaaagagcctctctgggtgttctttgaatatcctgtgaacgcctctgactttatgcccccaccttgtttatatttctgtttatgtctattatattaattagacaatgatattctgcagatcattccaatacccagcccagtgcttggcacacagtaaatggctaatatacatttaagtgaattggcctacttggaagaagaaaaagattcagattagtggccatttttatgtatatttgatgtccagcaactattatttacatacctgggaactcatgcatgacctcgggcaaggtaacaagggaatgctcattcggtaaatgaggcagaataaaaaactacttgttagtctagaaattaaggccatatatagataggcaagtctatatgggaggagaaaagaactcaggggaaataggtaatgaaataagcctcttaaatatgcaatgttcttcagttaatatctcatataaaacaaagaaaagacttccaagccttcaatattctaagttgccatggcagcagcaccatcactcttggctctttgagtagtaggatcgcagggggagaaaggcctgacactagtaggcagaatgccaaggggctgggagaggttactgaagcattttattactgacactgaagaaatgattatagatcatgaagcaggagaacctaccataccgtggcaatgagattcattggtttccagagagttgcattttgacttttaaaaggagattttaaaaaatgatagtcaaattgcacttcaatggattaaaaaaaataaccattttaaaagcagaagggtagaagctgctagagagtgtattcaaatccatgcttcttagcaaccagaccagatttcatccataaaagaaagccagaggtacaataaaaaaagcctctttggttctctagagaatataaaggcatattagaaaaaaagaagcactttgagatctgtggataaaaggcactatatgggcataaagtatattacaaaaagagaaggacaaggaagaagtgatgtctagactgggcaggttatcttgggtacgtatgagaataattgccaaagtcaaaatgagagatcatgacaactagaatcattagagtgttcagaagttagtattattttaaaacataacagatatatattttttcctgaatcaaagcaaaataaatgtaaagggaaaatagagaatatgtggattacttagtaactacatactatttcctcaaaagattttcacagtgaagagaaatgaaaaagtgcaaagaaaaaacgtcactaacatgttacagagtttgatgttatctatcttcgaagtttcagtgaaattctacacagtaattgattctttctgattcagccaagtaggaaacattagaacattttatgcataggtgtttttttttttttttagataatgtatggttagaagagtcatcacaaacaaaaaagcaaaaaccaaactaaaccaaaaacccaaacccaacaacaatcaaacatttaagaggaaagtcagggacaagaatgtagtttctggtgataggataagaaaaattacaagttaaactagaactctcattttctctaaattaagccagccctttttgtgtatgtataaaaaaaaaagaactggggggtatgaaagaaatgattcttttcatgtactataatcaatgcagagattatcttcaggaagattcaacaatgttcttgagtggtatacaaaaagcctgatgtatttgaaagaaaataaatataaatgaatgttttctggataaatgaagaagcaaagcttggaagtagaatgtgtaaatttagcagagatttgacgcgtatgtttgaacagacggtggtgcagttgttctcgtccgaggttattttatgaaagctgcattttcccttgaagccagaccccgtatggggttgagatgacgaaagcctcatgtatctcactatcattaggctaatgagattggtcaaggccacaggcattctagatcttggcaaaatttaagataaatctagtaaattcttctaatagctttgtgctgtttttggaaagaaggagaaagataagaaatgaataaaaacaaattttcgaatacaaaagattccatttctgaaatactgttccattatgaaaatgattgatattaagatagattatttacccccattgttataaaattttatggtcacagaaataatttaaaccaggtatttgtaaaaaatccaatatgtaaacacaaatattaggaacatttgttttttaagcattccctttgtacccaaaactttccagtttttatagtgaagagttttgaaaattatggtggatggacattgaaaatgggttagtttagctgtgaaaaagtttatttttgagctgagaccaactgttggaaattatagacaatttgtaactactaagaaaagtgaattggtgggagccataatgaatgctttctgataggaggcttataatgacttacatgcagttgggggagatatttcatttaaaatctttgggcaggttttcatagctagttaaaaataatgcaaactgattttaagtttggtgtgttaatattacaagctgttatgtatataagtcatcgagattactaaaattgctctttatattggtaggaaataactccatagtattgtctgtaaagtagaggccactgggtgaaaaatgctttgattgctgtccaaacgctgaagttataatacagtgcagagcaacgcccaataataaatggaagtaccatctgcagtatattacaaatgagtcactttaaagccttgtgtgggactttttaaaacacagttgtagctgcacaaagtaaagtggggagtttagaaattgcctggtgcttttatcagctcaagcagctactatagataatttaggtcctacaaccttttgcctctgtgagaattagatattcttggcctgaatagcttatatatagctttaagttcatatatctcttgatttggttgtactgtgctaaagaggccaagatgggtggattggtgaacattttactcccccacatttcacccttgggtcttaagaaaaaagcatactattaattttgccagaataacttctgttgtaaggcatactgatggttgttcagacgcatcacgttgacataatactatgataatagatgccatcagagggtgacattctagttctgggtcctgtgcttcattaagagacttcacctggaaagtttttcctactaagacatgttctaagatataataattaaattattattgaatttaattcaatccaatactgaaaaactaattgaagaattaaaactgtacagtgttttataatgtctcactattctcaagatatttaatgatacattttatgtccaggattggatattgtttcaggtgcaatgcttcctcatgggagctcccaagttgcaatacattcccaccagtgctccccatgctgaccaaaggaaaacaacagcaaagattttgaggaagtaatgcaaacagaactaaagacagttggcataacatttataaaaatgttctacaagcatatacgtaataaaatccatcattcaacattctaagttgtcattttacgaggaaaagaaacatgcccaatgtaattaaaactactgaacttttatgtcttgagtttttcagttctcttgttgcctttgatactactgagccaaagtcaaactattgaagattatgcataatttgacttcactttattgtttgaaattacaaatgctgggttttttctccttttttaacttttaacctttaagttcaggggtataagttcaggtttgttaaataaataaacttgtgtcatgggagtttgttgtacaggatatttcatcaccaggcattaagcctagtacccatcagttatttttcctgatcctctccctcctttcaccctccaccctctgaaaggcctcagtatgtgttgttcccctctatgtgttcatgtgttctcatcatctagttcccacttataagtgagaacatgtggtatttggttttctgttcctgtgttagtttgctaaggataatggcctctagtgccatgtatgtccctgcaaaggacatgacctcattcttcttttatggctgcatagtattctatggtttatatgtaccacattttctttatccagtctatcattgatgggcatttaggttaattccatagttttgttatcatgaatagtgctgtaataaacatacatgtgcatgcgtctttataatagaatgaaaattaactcaagatggattaaagacttaaatgtaaaatcccaagctgtaaaaacctggaagacatcctaggcaataccattcaggacatagggatcgggaaagatttcatgatgaagatgccaaaagcaatggcaacaaaatcaaaaattgacaaatggaatctaattaaactaaagagctgcacagcaaaataaactatcagcagagtaaacagataaccttcagaatgggggaaattttttgtaaactatgcatccaacaaaggtctaatatccagcatctataaggtttttttttctagtatggtgctaataataggattagcacttttcaacttttatttttgacagctttgttgatttgttttattcttagtatgtccacgaaatgaccacttaaaggattttaacagttttcggtcaccacaatgttgatagcacttgcaggtgctgtggtcaacatccagaaagccatggattattggatattccaggtgtcaatccatttaattctattctattctttaatttctaacattctcttattagaagcaagttataccttagaagtgttgttaggacacagcactaaaaactataattccaatttccatgtgtctttattttatttcaaatgtatttgatcaagatgagtattacatttttgtaataataaatgtcctcagttttctggtctgaaggaggacaccattattcatgtgtaggttatagggtattctttactgtgcctgagatagctaaaatattgataaagatttagagattcctgtaagttcagctttgagaccttatgtctgccattcagggagcgtccatcagatggctgtggtaacttgaaaattgccatatacttccttttctctccaggggctgagtgtttactaataattaaaattttcttcctccaattaatttatttaaaataaatatattgaattaagaaaatcttatgatgactaaccaactaattttagcttgaagcaagattgaagatttaaaacatctcatggcttttccagcagtagttttctatcaatattttatacgttgattgcaatttacttctatattggcattcttgattccattgcttacctgtttacattcaagtagatgtataactttatgtctttggctctttttctctggtagcctcatttctgactacttcgagggttgcttggcagtggtgagtgggaaatcagtcactttaagggttatcctttgatttttctcacttatatgcttagcggctagtcttgtctatttcccaaatgcagcaactggcacagtgactggagcatggaatctgttcttatcgccttatgattcttctgaattagaaagcattctcctcaaagatggcagctgtgtggctagctttctccttgtaagttaatatactgttgccttaacttactctcaaatttcccctcccatgagaatttccgtggtgtagagctgtaattgtaaagtagggcttctaaggcccctagaaatattgtagtttgttagaagattttgaatatatctttctagaattttattgaaccacagtctacttagatgagcattctaataatcaagtacctagtgaaaaggaaacatgacaaatatatttttggggcagattatttactgctctgtgcattattacatcacttcagccacaagagtatggatgattctttttcaaattgtaattaattcatgtgttgagaatgtgggaaactacttcatgaaattttacaaatattatcagtgatgcatccatgtgcttctacatgcaaccaaactcacataaaatcaattaataatgaagttaatacaaccataatgtatcattaaaataaaagtaacaggccgggcatggtggctcacgcctgtaatcccgtcactttgggaggatgaggcaggtggattacgaggtcaggagatggaggccatcctggctaacatggtgaaacactgtgtctactaaaaatacaaaaagccggatgtggtggcatgcgcctgtaatcccagctactcaggaggctgaggcaggggaatcacttgaacccaggaggcggagattgcagtgagccaagatcgtgccactgtagcctagagacagagcgagagtccatctcaaaaaagacatccttgttgatgatctcacaatagagtttccttctttagaattatgcggatgtgaaagcgcacacacattgtactacagtgttgcgtgacaaccgaatttctcagtagaatactgaatttcagcctcagtaagctctaatgatcttctaacattcatttataaaacccaaactttagaaacacttaacaaaccactcaacaggatgtttagtaacgtttaacaatttgcaaaaaataattgccaattacccagaagacctgaaaaaagaattcgtaatttttatacagcccatggttcatcaagctgaaccttgcatgagctgacaacaatgcatgtttgacagtctctcttgagttgaaccctctttttgtggatgacaaaactgaggtctgcggaaggaaggttcttgtcagttgtagtaaagttaaatatttttcaattttttgtgtgaagtatttgcttaagaatttgaagtccaggttatatgctgggccagtttccttatttatgaaaacacctttgcttaagagcatctgtaaatagagatttcttcctattatggggtcatttattccattatagggtaattctgattgtttgaaagttgagtctgatgtgaggctgaaatcgaatctgtctcatgacaatttctatttattttttcatttcctggtgatgtcgtttagctgtgtccccactcaaatctcatcttgaactgtagctcccataatccccacgtatcatgggagagacccggtggtacgtaattgaatcatgggggcgggttttcccatgctgttctcatgatagtgaatatctcatgagaactgatggtttcataaagggcggttcccctgcacatgttctcttgcctgcagccatgtaagaggtgcctatgctcctccttcaccttccaccatgattgtgaggtctccccagccatgtggaactgggagtccatttttacttagtaaatttaatttactttgtaaattaagtcttttactttgtaaattacctagtcttgggtatttcttcaaagcagtgtgaaaatagactaatacacctggataatgataaggtttgttttgttttgctatcatactcatctgagtgtttcaggcctatgatatggccagatttgcattaacttacaaagcaagaggtataaaattctttggagtgagttctttcttctgcagttatctgcatggtagagattgtccagaagagttttttttttttttttttttttttttttttccaaagagcagcctcacttcaccatgtgatttgctttgagatggaaatggcccaggaaatgatagggtttatatctatcttcttacttaataggaaagcatgcagatgtaaagaactcctctctgccccaaatctctgataatttccccaagaataagtattgagaactccagaattcagatgtttcaactccttcacaagacacttttaaagtacttgaataataatttctgtataactttctgctgtgtgtagaaatgactcttttgcttctcaccattgacatattactggaagtgcaaacaacatttgatgatgtagctataatactgggagttttgaacaatagctatctctaatcacatttgtcaaaagcagactagagatcttacctgtctgaagttgtcaacccgtaggccatttttctagaggcaacctaaagtgctgaataagatttgcaagtggaaaaaaatgctatgtcaccgaggtagaggtaagcttggagcccaagtactgtgcataattcttcaaaggttatgagaatgacagctattagcaggctgaaggcacaattctttaagaactaacacacagcagtctttgttgccttttgccctaaaatctcacatcacattctatttggttagacagctattgaactcaaaagaacttcagagtttctttcaagtttcttttcctacctttctctttttagtggtataaatgcattcaatctcttgggcaccctttgaattattttattaaattctgcaagatcttagtgattggtttctggtatttcctccattatcaagaccactgctaaatcttaagggcaatgttatgggtatagaaaaaagaaaataaagatgcatcaagatagatatgttagatagagaaccatcactcaattacctgccagaacgttggagagtgactgtgatgacaccgggtctaaaagcatttgaaatatttaaaaagaaatgtaataacagatcaaccccctatagaaatcgtattttattctactgaattgtttcttggaagcatttacgtctttaaccaatggaaagatgaaacagctttttttctttttttgacaattaaaaaagtttggtccaactgaatttagaatatatacacttggatagtttgcccatttgtttcagctaactggtagggtttttaaatgtgtactaattgtacctcctatttatagaaaaaaagtgctgttctttgagagagagaaagaatccaggaaatatgatgcttaaaggtaatgtctttcactacacccactgaaggtcactttatctatccaagggtaaagtttttctttctctcttttatttttattgaagttggactgcagcctgcatagactttctttttcctttaaagatatcgttttccgcctaattgtgcccagcttcatttataccctgaaaaggattgtgtttgtgcttacatactcaggagactctttcactcaatagccaaactccagcaacagccctctgggatatttgagtaaatgtaagtgaaagttccctgtgtttgtctctgtgttctttttaaacaaaagtttaactcagggcaccgtgggcatatttaaagaaatttatctgtagaactgtcttccagctaagatctgaaaaatacattttggcctgcaaaagtgttcatcagtcagcagaatttccagtaatgcctcttgtattttcaagccactttctccccatattaataggtaaaagaactagcagcacatgcctacagcccataatgatgtgcctttaaaactttctgtgagaacttagcaaaggattaaaaaggaaagggcaaaccaaggatagcaaattgattcaattccagtggaatgccaattccagtcatttagtgagtatggcatcccatgcaagctaaggggaatcatgaggatgcagtcagtaggaaagcatgctgtgattgatttgattttgccatgggcatgggaaggcaaatgatgacatacgttacacacgtattccacgtctggcttaatcttcaacatcaggtttgtatagtcctacaaattacctgtttgggtttctgagctacatcattcatattctgttaatttgggattcttacttccaaatgaatatgaagatttgtattggatttctttaactagtgaaatgttcaaatctgagcaataattgaaggttcagtaacaggccagctttgcttgcttggtcttccagttctagatctagggacattgctttgatatttatgaccataacctactttaagcagcctagcttcatctccttgagagccctgtgcatggtacaaaaatccttttgtgtacattttgtcctttttcttcctgggagcagaatcatggtactgcctatagacatgtggtcagcctttacacttaaatcaagaaaatggcaggacctttgtcttttgtacaactgtaaacatttgaatgtcccttacacttcatatttctcatcttgctcactgctgggactgactctttttttttttttgagagagagggcctggctttttaaaccagactggagttcagtggtgcaatcatggctcactgtagcctcgacctcctgggcacaagtgattctcctacaccagcttcttcagtagctgggaccacaggctcgtgccaccatgcctggctaatttaaaaaagtattttttagagatggggtttcagtatgttgcccaggctggtcttgaattcctgggctcaagcaatccactccgtcagcctcccaaagcgctggggattacaggtgtcagctaccgcacctggccaagagactgactcttatttcctgttctggtcagtgaggctgggctgtccctgattaacctgcttttacatgatctaattggccacactaacagctcctttttatttttagatgctgtgtttagatttttgttttgattcagaaataaattttaggctttgagctactttggcctttattaatttgtgcaatgaactcacaatacaatacatgctcttcagcttcattgaatttgttgtttacacagagattgatatttttcttacataagtggtttaagtcaggaaataaataacttattcaactgggtaaatatattaataagaaggactttggtgatacgatttaaagcaaatcaaagaaatttattttaaatgtgctcctggtttttaaaaacatgcactgaataagctgagcccatacctggaataggaatccaagtctagactatcaaattaaataaaacaaactcctccaaaaataaaaagtcagctaaagaaaattggagaattgaatataaaaatggatgtggtgcaggtggccattactttgaacagaaaaaactccagcttgtagcgacagagatgaagaacctggagaggagaatgctgatctactaaagcagatggtccaaacaaacacgagctaggaaaacaaagcagaaagtctgggagaagagccaacatctacaatggactaataaaagcgaacaaacacctcggcaaccacatccgacagctaggaacctgaattggcactgctcagctcattgttttgggcatatcagaaaaagcagagggaccaccagcccgtagatgctcccattcactgcgggccaacaaccactggggagaattagaatcctcctggtgccaggaaacctcttgaagtttgcatattaccacagctagtgctattctcattcaaatataccagtaaaccaaggaattgtgtaagatattatattaaaaagttgtaatccacagtagaaagctttaaagaaagagaatggtgagaacgaaggaatgccttatttaaggattgattgttgtatttttcataagtagttgtgtttttagttagataacaaacacttagaggggcttttaagagggagagagaagagcaaggaattcaaaaattcttttctttgtccatgcagtgctgtgcatattaatttggtgaatgattattgtgtttaatgtttcaatagtatgattttaacaatggatcctatagttaattctgtataataatttgtaatataacccatcttggctgcattattttttacccactgcactttactgctcgtattttacaatcacaacatagtggttacgatctttggggacagctagaccttggcttgaattacctacttcacttactctttgactattgagaggtttaagttccttgacctctccaaccctcagtttcctcaactccaagctgaagataataacatttaatgaaacatatattgaaactatgaaatgaaatgtataaaaagtgcttagtttttggcatagggcaagcagtcgattactggtagctatcaacttgtttttctgtcagtgccaaataaaattgataacagaattactaaaaaatcatataaactaataaggaaatctttaataaccaactaataatagaattagtattttgagacttctgaccttcctaataccacattatcaaacttcagatctgtctagaactattttaatttggaaaaaaaatagtctgatagctgcctctatatgggcaaatggagatacaaggaattctccagagaatgtgtagtcaaacagattttcacatcttgattccagacactacaaacaaaaggcatgaacatttactttagatagatacagccacattgtcctctaaaagagtacttatttacatagctaccatcggtgtaaaagaaaaaaaaaaggctgtttctctatatactttcaaatttttgccgatttgttggctgaaaagttgtaccttgttattttcattgacattttcttaattattagtgaggctgagcatctttttataagttattggctacttacctagtgatatggtttggctgtgtcccccacccaaatcttaacttgaattgtatctcccagaattcccacgtattgtgggagggacccagggggaggtggttgaatcatgggggtccatctttcccatgctgttctcatgattgtgaataagttctcatgagatctgatgggtttatcaggggtttccactttcacttcttcctcatttttcttttgccccggccatgtaagaagtgcctttcgccttcaccatgattctgaggcctgcctagtcatgtgaaactgtaagaccaattaaacgtctttttgttctcagtttcaggtatgttgttattagcagcatgaaaacgaactaataaacctagcttctgttaattggttgatcttatagtttgacaacttttctactcaattatttgtgtttttcttattgatttataggaactctatacatattttaattcataatgtatattgcaaatccatattcccatccactacctgccttttaatttttggttgttttactccataggaattattactatttatgtcagtgtacatctttttctgtaaggcctttgggcttcatatctaacttacgaagatttcaaattcaaagagaaatctgtattttaaatgcttctaaagttttaaaaaatgtttagtgatttatacaaaattgacttttaaaatattatatggggtggaaatcagaattaataattccattaatgttttctctgtaagaatattcagggtcctcatgtaatttttgagtactccatttttttcaccactgatttgaatattatatttattaagtattaaatatatatatagttttaaattcattttgcttgctttctttgatctagtcatacatttctgtatcctgtacttctttacttgtctttaaataagtaacataatcttaaaatgaattggctttattgtgtgttttaatatatagaaagtgctcactcattattttttatgtgatggtctcataattcttattcttttagataaaatttaaaattagcttatgaagttctatcagaaatcctggttgggcatggtagccacacctgtaatgttagcactttgggaggtcaaggcaggaggactgctatgagtccaggagtttgaaactagcctggacaacatagggagacctcatgactacaaaaagtaaaaatattagccagggtggtggcgagcctgtaatcccaatgactcatggggctggggctgttggatctcttgagtctgggagttcaaggctgcagtgagctgtcatcacaccactgcactccagccagagcaacagagcaagactgtctctaatataaataaataaaattaaataaaaatttaaaaagtgttatttatattaggctgaagtttcaattaactaaaagtttgtgaagctgtagcattttaattgcacagacttccatgtaagaacaaagttttcttgtctttaaaaatatttatttagttaagttttatcatattcttgatattgatctttaacactttcaataacatttattcctaagtattttataatttttaagaatggggacatttttattgttaattttaagctatcatccctaccaagtatttgtttattaattttcaaagtaatacctgtgcacagtttaatattaaataataaaaaagagttctccttggattgaaaaccctggtgtgcgggagcaagcttgtgtggatctcttcccaactctgtgttcagggatgacaaattgttatttttaaattggccatggtgggagtatttctactacagaaattggcatgtgctataaatctgaacttttttttttcctggagagcaaattttaaacatttatcagcctaacactgcaacaacactactccactccaattcccacccccagagacaacaattttcaacatttttagcagtctcttcagctatgtgtatctgtttctaaatatgctttgttggtttcctttttcttttttaaaaatttcattagccattgcttatggtatttacttcccaccttgagggatgagaatttccaccactcctctttctataatagtttctataatagttacatctcattttattcaggcacactattttgattatgtccatatttttcatgagttatatactataatttagttttcattcttatacaacctttttgtccttatttgagttaataattgcctaatttttcttagcttagttttctgtgaatatatcactaattatcctcttcactcaatgaatgtgtgaaacttctacaataaaatcaaatgccagggagtttacctataagcttcatttcttcccctttggagacattcctggagccctgcaccttcctattccattctgctctcgatgttactatggaagtgtcatccttgggctttccttcaccatcattttgggaattccttttacttctgttcactggaatttattttcctgggctatttctatatgttgaaccacccaattagcttccttaaaaagggtgttttgaagatcctttttacgggtactttgcaggactgaaagtatccttattcttgcatcatacttggttgatagttaaactgagtataatgttcaaattggaaatcatttttctctagtgattttaaagacattgctctgttgtcttacagattccaatgttgctgtaaaaaggtctgatgccattatcatttcgaatattttgtaggtggcctcttttgttctctctcaaagcttttaagactttctttttaaatcacaggtattcttaattcaaatgatatcccttagatgggcatgttttccttcatttggcagattttttgaggatgagggtgcttaagcagttccctctgagatttattaatttttaaaattggttaccaaaaatatataaaaaatactttatctttttaatgttgcctttttgaccatctgtctggattttgttattctaacattctaatttttttgttgattttcttggatattttacatgaatatcatcaataaataatgactttttatctattcgtccatattttcatattccttatttttcttgtcttatctaattgtccaagacatctaggtcaatggagaatagtaactgcaaacagcagatattctttcactttcactgactttaatgggaaagttcttaatgttttactatggatgtctgggcatatacttttttttttcctttttcttttcttatttttttgaaatggagtcttgctctgttgcccaggctggagtacagtggcccaatctcggttcaccacaacctccatctcctgggttcaagcgattctcctgcttcagcctcccaagtagctggaactacgggtgcacgccaccatgcctggctaattttcgtatttttagttgagacagggtttcactatgttggcctggctggtctcgaactcctgacttcatgatccacctgcctcagtctcccaaagtgctgggattacaagcatgagccaccatgcccggccaggcatacacttttataagtgaaggacacttgatttcattcccagctttatataattagtatgataaatagctggtacattttcgctattttatcttgacattaatttttaataatatatgtatatgtacatatatattcttatacatgtgtaattttgcattctttggaaaattgatttgaggctatgatgaattattttgttaagaaactgctgaattgttgctaatactttattaggaattttacatgaatattctcaaaataggtgttctaaagttaccttttaagtgcttttcttctgctttgatcaggttatgttagcctttagaaatgttctggctaatcttttgttaatatgacaatttgactgatttatttaaatctcacttgtctgaatatattgagatttttttattagcctaatacatgttcaggttttatagttattgcaaaggacatttgagataatatataatacgaacaagatttctctatatacctacttattgtaagcttactaattattgttatttaactgaacaaaactttttacttttaggttctttattactttattacttttgcatagaggtttattagagtacccttctatgattataatttttgacaatatcttccttcatatataaattttaactttaaattccatgttgcttagtgtataaaatttaaaactatgtggatttggccttctaccaatctaaatattcatattgtttcatttcatacttttgttcttattttagtattacatttttgctaatagtaatactgtagcacgtgctcatagagggctttctttggggttcatggacaacaacaggctgaaaatctttgctcttggattagagaaatgtggtgtgttccacagctgggcgttacacacttacatactacatagttatctccctgtcttttgaggaggtttgctttgcttttctttctggcctggatatctaggctaaaagccctctcatggaagagttttctttctttggaaagtaattcttaagactttaacctgggaagcaaatgtcagtgttcctagatgttttggttttggtctgggagaaggagggccaacactgacacagcagttgctgtttgactgatggtattttaattaattgtacccatgaatgtcctgctgtttgaatttgctgactctgagcttggagtttctctggagttcctttgggaagaaaggttctcaccttggcaatggctttctctcaggcctactttcggttgaagttttttcactgtagtttctctcagtttgatcgtctctttattctcttgtctagaaatccttctgtatttctggtttgttgatggcattttttcttcttgatgactgcagttattgttgaattcttattttagactatttttttttagccatattgggatttcagaaagaacattgtgctctgcctgctgtctcaagttgatagtgtcatgttttttaacagactaggactttttttgtgaatataaaatatctaatatctaaatataaaaaatataaccattaccatccagattaagaattagaatatgataatgaccattggatcccattgtgtattacagcccagcacatcttcctcctctccaagtggtaaccactctcttaaattttgtgcacatcattcctttgcttttagtaataattttactatatatgtttatctccccaaacagtatatggtttagttttgcatattttgtactttatataaacagaatgtcttctttggcagtttacctttttgcttagcatattatttgtgggattcatccctgttgataaatgcagttctaatttattggtcacttttgcagatgtacaatgttccactgaataaaaatagtgctcgttctcttgttggtaaacatctgagtggttctaaatcttttttattagaaacaatactactatgattcttttacttttcttcgaatgcacacaaagaattcttacggtttatacaaatagggttagaatgattgagtcatgaactatatacacatctttaattttattagataacttaaccttttcccaaaagttgtacccagtacatttccacaagttctatgtcaaagttttcaaggctcctctccctcagcaatattttcaaagctttaaaatgtctccaaatatattatatggaaggttgtatttcattgggcttttcatttacagtttgttgattcctatgatcctgaacatcctttcatatgtttatggtattcaaactccctctgtgatattctcctttatattatttgcacattttattggcatctttttcttttaaatttacttttaggagtttattaaaataaattttaggtatcaacccttttttgattatatctaatgaacatcacatatattataaatgtattatctctttttacttcttctaatgttttcatcatggtttgggctttttgtatcttttaatggaaatatttctgtatcttggtcttaaagttattgtaaacattttaatgttttgttccttatattcgagtgatccatatggaattgagttttggagtacattacgatgtagtaacacaattgtatgttcttatttcatttggaattcccaacaccattatttctccactgataagcaattccacttgttatatatcaactttacatatatttataggtccaattctttgtttcatttgtctctgtaatctttttgccaattccatgtgtgttaattgtatttttattataggcactaatgtccatgaagtatttttttcctttgtacacgttttagtaacatcttgtcaagtcctctcatgaccctgtagatattttgattttgctattaattaaattaatgaattttgaaaaattgacatcttttacatattatcatcctatccattaatgtgaccaactcttcaacttttaaatggtcttaaaatatgtctttcagcaaagattttaactttttctatgatgaccctgtgtcacttttcttagatgtattactgggtgtaattagttattttattttttattgtaaatgaacttattagagatacatttttaaactctccgtgagtggtaaatacaagtgcaatggatttttgtacgtttatctcatatccgacaatcttttaaactctattattcttataacttgtatattatttcatgctttatctgtccacaatttgtacgtaatgacaatattatttcttttttgcctatcttgattcactttattttgttttcttgtctgatattcctggctataacctccagtaaactttagaagagaatgctaataaggagtatctttttcttgcttttaaaagaaatatgactataggctttgttgtactatttgtagttatattttatcaagttcaagcattctcttctattcctagtttctgagatttttgtttttaaagtcttgaatgccaattttataatatgtttttcctattctatcaaggtgatcatataatttttctcattggatgtgttaatataatgtaatataaatcttgctggaaatcagtggaccccaaacagtccctctataattttatttttatttatgtttattatttatttttaaataaggtttacttaatcagagagcctctgaaggcatcaggtttctgtcatttttttttttaaaggcaataaactggcaactcgggtgcatgatgggtaggaactgggcatggggagctgggaggggtacatggagagaacacaggggaacaggcactggggaggggaggagagagaagaaggtggaggagtatcagatgggaccatagaacagtcagacccagctcctagccacccctgggacaggcagacaatcggacagacacggatacagacacacacaaagacacgtgtgttctgtgagctcaagagcctctgctgtcctgcacaagcagggatcagtcagagccaagtgtggagaaactcaagcagatgcacaggctgcgcctgatccctcaaccctgaccctcaggcccacagtgtctccactggccacccagaggctctctccccagggactggacatccaggcccagcgcaggtcatggcaaagcagaagtcagctagaagagaaaacctccagaccactcatgcccagccctggcaggaaaataaaggggtgggaggcagagaggcaggcagtccttctgtccatccatggtcacacgattgcatttaacaggaagaagacagcccccagtgccaggccagttcagccataaaatatatatattttatatatatttctttgatttcatttatgaatgtttaggttttaatgtttatattcatgagtgtgttggtttgtaattgtttttcttgaaattcttttgtgtggtttttatatctctaaatgatttggtaagtattccctatcttttaatcgctagttatgtttaaatgatgttggaattatgttcaattccaatatattatatcctactctagtagaaattttctgtaggcctagtgttttatcttgtgtgaaggtttttaatcactgattcaattttcttaaccattcggttttttttttttaactaagtttggttaattttttcaagtaatttggccattttatccctaacccattatcttatcctaatttatccttgacccattatttccctatgactgtgtttaaaaatttgaaatatatgagttgatgtagttcttataatgtgtttctatcttaatttttagtcaaaatattacatggcctatatgaaactatccaaactcactgtatgcctttttaaaataaacttttaatttttgtggatacatactaagtgtatatatttatagggtacatgggatgttttgatacaggcatgcaatgtaaaataagcacatcatggagaatggggtatccatcccctcaagcatttatcctttgagttacaaacaatccaaattatattctttaagttatttaaaaatgtccaattaagttatttttgactatagtcaccctgttgtgctatcaaatagtaggttttattcattctttttttttcttgtagccattaaccactcccacctacacccaatccccccactacctttcccagcctctggaaaccatccttctactctctacgttcattagttcaattgttttgatttttagatcccacagataagtgagaatatgtgatgtttgtttttctgtgtctggcttatttcagtgaacacaaggatctccagttccacccgcgttgttgcaaatgactggatctcattgtattttatggttgaagagtactgcattgtgtatacacaccacattttctttattcattcatctgttgatggacacttaggttgcttccaaatcttagctattataaacagtgttgcaacaaacatgggagtgcctttttattataaacttacataaatccctcatgtgtgcttgagaataatgtttattattttattctttggagcagatctctgtatttgtacattaaaccaaatgtgttttcttgaaaacatctgaaacaaattcatttttatttgtataatttatcaattactaaatgagggcccttccttagaaagccaaaactatatggggaatttatcaattcttattgtagttttttaaaaatttttgttttatataagtatatacaagtttctaattggtatatccttgtcttacattgaaacattattattagtgagatgactctttttccaatgtaatcatttttgccttaaaaatctgctttttttttttaagattgctattttactctccattacttttttagttttttttgtatttacacctttttccttttgatggtacttattcatctattccatatattatattacttttctttcaacctttatatacatctctttaaatcagccctaagctgagtttacaaaaagatgaaagtctgtctacataccattttctttttactggagagtgagtttagtccatttacattcattgtgattgccaacatatttcagtataattttgctatcttattttgtgctgtttttcatatggtatttatctctctcttaaaacgtatttctttcctttttttgtattcaatgtttattttgttttactttttccatttatgttaggatgtacgttcaaactacctactttacaaacatgaaaatcaccatgcctctcaacacctgtgtgtatgtgcacctgcatatacacacacaattatactcttacacacacatccaaaaccaagaccagggcaaaatatttccttagtatttctcttcggtgggtgaatttttaaaataatctatgtttttactgattgtgcagccctttggagacgcgttctttccagctttatgtgcctaggttccaagtctattgcaagtgaccaaggccttgtttcttgtctttgttggctgctagaagagaaatggagtttgaagtttagcagatgcttttataatagccacagccttaaattattgcttataattttcttctttattcctactttattattctcttttgagtttttttcttactttgcagaataaacactagtattacttggtgttgggtagtgggtatgttcaggggttatctaatctaccatcttgacagaaacagaagcccccaatgctattttactcttcattgctttcctgtgatatcctctatataggtaaagaaggcttaaattaaggagggactgaaatactatgaagtacagtcagtgaattggacattggacagttttacctggtgaaacctgtctacttggaggtctgtatcactcaagaactctgttgctgctatttctggacagttgtacaagaaggatgcaatgaacaatttttatcttaatttactttgatttagagaaaaaatagtctgtgtgatataggaaaatctgatccagcgtcttttgttcttaaggttttatcagcatgatttgagattaaaatgaattagaaacttccaagtctgcctttatttttttctaatacaattatttgctaaatatgtaaaaaataaaaagttttcaagattgcttaggtttattactatgtgatattcatctacatagaagaaacaaataccttatagttcaattaaactagcctttaccttatgtgatttttataacatttagaaggatgtcttgtgatctaaagacacagcttcttggaatgagccttaattagcagtctaagttttaatattatgtttgtcactgatgcaagtcaggtagtttatacatttcagttttgtcttctaccaaaggctgcctaatcctaactctgaaaaatgttagaatatgctggtattcttgcagctttctcctttttgtttttatttttcaaaatacttgcatgtctgtacattatacaatgacaatcatgtggcctcttgctcagtctctttagttgccacatggcaactgtctctcagctatcatttcagttttggcagcatcctattgtaattcacttgtgtatatcaatgactggaaaaagtgaaatgacagtgctgttgaaataaaggtagaagccactaatacagacgtaagtagtatttagtcttattcagacactcattgtattgactgagttcaatggtaaagtaaatgaacaaaactaaatggcatgaataaaatgttgaaaatataccattgaaggttgatccaaaagatgggatttcatttgagacataatatttatttatttatttattattcttatactttaagttttagggtacatgtgcacaatgtgcaggttagttacatatgtatacatgtgccatgctggtgcgctgcacccactaactcgtcatctagcattaggtatatctcccaatgctatccctccccactccccccaccccacaacagtccccagagtgtgatgttccccttcctgtgtccatgtgttctcattgttcaatcccacctatgagtgagaatatgcggtgtttggttttttgttcttgcgatagtttactgagaatgatgatttccaatttcatccatgtccctacaaaggacatgaactcatcattttttacggctgcatagtattccatggtgtatatgtgccatattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctataattttaagttgctaaataaaattctctgtacctttcggatttattcagatttaatttaagcctttcggatgaattcagaacatttaattttggttcatcatttcaagtttaccttttgcctttatcctatgttatgatacatgaagaaaaacattaagagaatcatcaactgcctggtggttataaatgtactggaaatatttttcaatacatttttgaaaatgcttgtaatggataattcatggctaaaataattagttcttttttgtgtagtctattaattttcgagaacaagtataatattctttaagatactttttcctactttgtcttattctgtatattttttctgacacacagaacaatataaggccattgatcctcccacctccaccctattttctgcttctttttggtaaatcttagaagcattttaaattccatctgtccctttttaagctttcaccaatttacgaaggacttattcactttctggagcacctagcttcaatctcaacctttacttgacaaaataagtcttccatgtaaacatatatttgatgaaaaaatttcaacaaacaatgaattattattatagaaaatgagaaaaagctgtaacaaaatcacctttaatctgcctgccaagaaataaccaatgctacattttgatataaactccctgaagtatttaaatttatgtgaataaattttacatatgtgttattttatctattttatgtagagaaatgaatcaaataatagttaatgaaaggttttatcatttctttttattcattcaaaatagagccatttatatcatacttatttccatatcgataaatgtgcctctacaacttatattttgtatataacaaaattctattacatgatataacaaattttaactaatcctcaattactagaaattcaggaggtttctaagaacattattacacacaatttttgagcacctactatgtgccagctcatatttgaggcactggagtttagcaataaacaagacaggtaagtttctgctcatatggagcttatttctggagagtagccttgaattaatctctattttctttaaccgaggtatttttcctcattatcacacaggtatcttaggttgttgtccagaggtgatgctttttatccttcttaagggaaaaaacataacttggatgtatctccccatccgtttcttccaccaactatgagtaacaattcatggttaagagatttaattctcttttttgtgtagcttatgaatttttaagaacaagtacaatattctttaagagacttctttctgctttgatttttttaatatattttgttaacacagaaaaatatagggccattgatcctcccacctccaccctattttctgcttccttttgtttatttccagaagtatttaaaattcattttgtctctttttaagttttcacaaatctatgaagaactttttcactttctggagcgtttttcacattctctgctttttttttcaaggctttgatggtacagaaaaatgactgctcttgcaaaactaaaagtgtagctggaatatttgtatttattgattaagaatcatcttttactatcactctttttaaaaataaacgttcctaaataaacacagtttagtatatatgagttacagtacagtttcatctaagcctcatagactacatatattttagcagttttggtggtggagttttgacagccactttttactcttgcgttgtcctgtgtggcattgctccatatccttaaccataaaagctgaggtgatttctatagcgctcgtaagctctggacagagaagcattgcattagctaccgtaaaaatagttcttaagactctggtacaaatgactttaaacccttttgtatatatgtaatcatccaatcttttggcttttagttctggtttcccataaagatgttatactacctttttcaattatggtaatggcaggattttcaaagaaggatagtctataccaacaagctattctatatacataacttcaatttctgtcctctaaatcctggggaatatttgccctcttgaatgcagaaaggcagcccatctgcttctttgggtaatttacttcattattaaattgttctataaggtgataggagaacttttcagaggagttttcatcttatcagaaacatgatataccattggacttcatgcattttcttgttttcatttcttacaatacatagctgactattttctcctctacatacttttgcatggctaggggtcaactcctatcgttagaaaaatgtagattaaaagtggcactattaatgtaagagttaactttgcttggatttcatgtgtggaagttcagagataattaattgggctttcattgtagttttgcctttttcatttcaatgtataaatctattttcagggagggctggctagcaggacagcagaaatctaagacttccataaccttcaccttttgaaaaactcttcattgcttttggatagtctcaatttcttcttctatttctcttaagaaaattcagaattagtgttgaaactttttttttttgtaaaatcaaactctgttagatcctttcaagtaagtcatttaccacagatttcctggagttagattccaactagtatttatgtttttagttgacatttaggaaaggttttcagctagagttaaaaagagagtgaggggcgaatatgtgtagctcagctgttttgaaaatgatctgtttgtagaaggccacaaagcaaatatgattatcttattcttactctgaattttcaccactaaaaccacattctattgaaggaatatataataaaagtgcattatcatatagtgtcacaatgagggattcaggtgcgaagggaagactcattcctgtgaaaacatagcccatccccagcagttggtagaaggatttgctggagttcctcctctttgtgtggcctataaaacattccatgaggcatgtggcaatagtcacaatgatagtggccttatctcctccagtctttgcatcctcactcaagccacctcttttcatagacacatactttatgtttgggaagaggtgctctaggtgggacacccctgcctgctccaaataattcctactgacatccatggcaggttcattctatctgagctggagatttgggaatttaggtgggcacagaagaaagaaggggtttggggcagtgtcgtttggatgattttgacagattcttcctgggggtaaagagagataggtgtgtctaatcatccaagggaaataaaatgcaaaggtgtgtgtatatggaaaatcaagggagaggaaattaaaattatccagattgcttatttaatagtcaggaaactcaactttccatgaaggtaagattccccactgtgtctttttctttttcctagaaattgaccaatttctgagtagatgaaaaaatacaggtggctgggcgaagtagcttatgtctgtaaacctagcactttgggaggccaaggtaggtggattgcttgaagccaggaactcgagaccagcctgggcaaaattacaaaaccttttctctaccaaaaatacaaaaattagctggccgtggtggcatgtgtccatagtcttagctacttgggaggctgaggtgggagaatcgcttgagcctggaaggtggaggttgcagtgagctgagatcgcgctactgcactccagcctgggtgacaaagggagtctgtctctgtctttgtctttgtctttctctctctctctctctctctctctctctctctctctctctctctctctatacacacacacacacacacacacacacacacatcagatatgtccatcacacgcacacacacacacgcacacatgctttcatggtagttttgcctttttcatctcaatgtgtaaatgcatgtgtgtgtgtgtgtgtgtgtgtgtatgtttatgtgtgtgtgatggtcatatctcatatatgattattgttgattattgaaagattttcttcataggatactgcccttgtatggaaatatctatgcagagaagagaataacaagcagttcaagaagagttcacaggcagccaggcaaaataaggatctgttttttcagactcttgcctttgcctagaattctctcctcagcttttgcatttgggaaatgtgacaaagttttcaaggtccctttcatatatcaactcctctgaaaatctttccttgatctctagcagaattaacccttactccactgtgttcccttggcacaaccgtaagcacagttttgttttacaatattatattttgttgtgcatgtgtctttctccctagctacactaaactatatggggctaggaaggcatttaatattgcatctctagtgcatagcagtttggtggcacaaattagatgtaagataaaatgttattgaatgaatgatcttcatctaagtgatttatatcattggcttcagtttatgtttacatcttggttgctgcacaaggaagatatgtataagaaggaaacgtagcaaaggcaaaatattctagttcacttctgataagacaaataataaagctaattaataatgagtaagcgttacttgcttttgcatcacaaaaacacaagtaggttctctgtaatatttgtagaataaatgaataattaataaaagctttttaaaattaaacccttaatatatgctagacactgagtaaatttatttacttgtctcattttacttctattagactgggagcaaggtgttgttatccccattacagagaagaggatatagactcaaagaaatgatgcaactttactaaaatcggataactcacaaactgtagagttaatgttttttttttttttttttcagagggtggtttttctttttttttttattattatactttaagttttagggtacatgtgcacaatgtgcgggttagttacatatgtatacatgtgtcatgctggtgcgctgcacccactaactcgtcatctagcattaggtatatctcccaatgctatccctccccgctccccccaccccacaacagtccccagagtgtgatgttccccttcctgtgtccatgtgatctcattgttcaattcccacctatgagtgagaatatgcggtgtttggttttttgttcttgcgatattttactgacaatgatgatttccaatttcatccatgtccctagagttaatgtttaaactgaggattgtcttactcactttctcatgaaggtcttcaccactctgcgagtttcccatgaatttacaattcttcagcaatggattttttattttggtcctcattccaattgtgtatggcagagtaagattcgagtttccacagctggtggatctttgattcagtgtttattgtacttctatgtacatgatgtcctaactgttataggatatacagttttagctacataagggcagggattgtgtttaatttatttcttagtcttacagtgtctgcctgacacagcacattgctaataaaagcatacaaacatttaatttgaaattctgaattaaaagagcaaaaaaccagcaccataaatgccataaggtagtgcaagtgccaaagaaatgttacaaggaaaatgggctatgagctcagaattgagaggaatcattgtaggtgggaattgtcagggcggttggatttgataattttgtaagatattttgaaacttcctgccttaggttatttttgataattcctgtattcttttgagcagtgatttgcaggacatttcctttcacaacaagggtctggacacttgacttggaaacaaggcgaaagtagagaagccctggcccactcctaggcagtcactggaggaagggtgaggaatttgggaaaagcaaccagcatcaaatcagagatgagggctcatggcagctgaaagggaaggggacagcagcctggagtataagattcaggtatgatttatgatgagaactccagcagcaggagatgtcagggatattcccaatgttataaacttcaaaaattaaaagtttcttggcaccaacaaaatcaattggaatattaagaaagcaatactggaccaggtgcagtggctcactcctgtaatcccagcactttgggaggccaagggaggtgcatcacctgaggtcaggagttcaagaccagcctggccagcatggcgaaacactgtctctattaaaaatgcaaaaattagctgggtgtgttagcacgcacctgtaatcccagctactcggggggctgaagtagcataattgcttgaactcgggaggcggaagttgcagtgagccgagatcgtgccactgcactccagcctgggcaacagagcaagactccatttcaacaaataaataaataaaaataaaagcaacactgttttttgaaggaaggacaaattcagtgaaatgcaataattcaaagttaatttcactctgcatttctgttttcagaccagtatttagtgacttcgaaaatacagtatttctatgtccatgtatactttctacataaagtttgaataaaattaggcttaacacttatatattaatacactctctcagtgcctaaattgtaagttcctactactatgttttattctttttatcttcagtacttgccctggtgtctaatttatgttaagtgctcaacgagtgtttgattagtgaacacatttccatttagtatgtggcaatgtttagtacttaaattttttcttaagtttcccttggttcacaacttacacattgtaactacagctacaataaattgaatacaatatgcagtaccaggctccaaggaaacttgcttcatgttgatttgtgcttatgaagttgactttgggattttaaaaaacatacagaataactgtgaccacattcagacatttaaaaaaggtttcttatctatccttggctttgatttgtaagttatataatcaagatgaaaacagtcatttataatcattcctggttcccatatcacagtgtatttataaaaacaatatgtagcactatgtgtattattttatagtgttacgtatcgtccttcttttggttgcttacactctagtagaaaaaaaggtcaaccaatttaggttacctataagaaaataaaataatattgattaatgtgcatacaaagtcagcgtgaggtagaatagatgattttgggacagggtagtttagttttgaatggtctaaaagaaataatgaattatatgcgcaagatttatatctgataacttaatatttaaatgctgtgatttacagaagaatagtaaagggaaagctggcataagaatatgtatatatatatatatatttttttttttttttgctaaaacagaaaaagtataaggtgaatgccccagcaaatgggtttgtttcatgtatcagggccaagtgacaattggctctgtgtggttatagttttcagtcccacttagagggatgtagaagaatcccagaagttttcaaagctgattaacaacttaaaaaggaagattaccagagtgctattgacaataactaaatggagataataaacggccttaaacaggtttatcagtccagaaaacattgctatttagaaaaacattggatgccttcagtatttagggatattgtttctcagaccctctattaagggtatcagaagacgttttctttaatcaaggcttttagcttctttgcgatgtgttcaaacatcctcctttagctcagagaagtttgatcatctgaagctgtcttctctcaactcgtctggaaaccgtcattctcagcaaactatcgcaaggacagaaaaccaaacactgcatgttctcactcataggtgggaattgaacaatgagaacacttggacacaggaaggggaacatcacacaccggggcctgtcgtggggtgggggcagtggggagggataccattaggagatatacctaatgtaaatgacgagttaatgggtgcagcataccaacatggcacatgtgtacatatgtaacaaacctgcacgttgtgcacatgtaccctagaacttaaagtataataacaaaaaataataatgaaagaaattttctttaaaaagaatgaatataacctagaaatgcattgtgttattttttctgtcaactcaaattattgtgtactgtgcacttagtcacctgagggtgcacagcacagcagatagtctcagctctgatgcaacttatcatccagtgctagggatgtgtgaatgattgtgcagataaacaatttggggacatttcataatacagagagacgtgctgggatggtattggcgtcaagtgtttggggaatacttaagaggagcagaatcctgcttgagaaaaacccagtgtgactttcttcatcttgcaatattactttaaattaatttaaattgctaaaatatggtaatgataatgacagcagatacatggagcatcttattatgtgtcagcactgtgaaaatattttatataaattatttcgttttaattcttaaaattacactgccagataggcattaatttgttttgttgtttctattttgcaaataaggaaagtgaggcctaacattttaagtaacagtctgagtagcacagaattaatcaggggtggtgagaggattcaaactcttggacttaccttacaactcttaacttactgaacctttagctcttaaaactctgttaacttacataaacacgggtgaaagttttgaaaagagacactaagcaaaagcatagtattttttgctaaaacaactactgttcaaaaattaagaacaaactttcccacatttaagtagctatgaattttaaagattgcaatgccaaacttgttgaagttttaaaaatgaataaggctcaaatgtaaaactcattttttggcatctgaggacaggaaatgtaaatttgaaatgaattggacaaaagtaaagctactcactgaaactgaaatcctttgtcataataacaactgcaggcttctttggcgcaataataattgtaaaattttaatgtatgattgaagcagaactatcagacaaggaaaagattcacaatctttccaataatagatatgttaattttttatgacactgtacaagaacaagtttaaggttactctagaaggttaaacatttgatttttagttttactatttgtcttttatttatcaaaaatttccagtctaaaaatggttaatttcacaaatgaagaaaagtatcaattatggaaaaatcagaggacataatttttatatcattcctttttttttttttaaagtaagtggctaacacattgccttatatggaacgatcttttcctcaggaaatctcttttgattaagaagctgcacagtgacatagaaaaatatagcagagtgattgcttcctctacaaatcatatctgaataataagtagtcaaagcaagaataactgggaatattgaggtgtcttcattttctaacctcagaatatttcaccaatttattttatccttaaaatgcatttgaaactttttgttgccttaaggtttgcagcacataaaatgatattgttggagaacaatttgaactgaggatgggttatgaaaagatctttttatcccaagtaataccaataccaaagtgactatttcctgtgcctactgattcttaaatgacaatttggctcaccacactcagacttctcaaaatagttcaacctaagtggatctgacaactgcctagaaagcttgtccgacccaccttattttgttgttgctgtttttctgttttgttttgggcttttagcagcctgaagtcatgttttttgttttctgtctgaagtggtaagcagaaaagaggggagaggaaggggctttactggcccaaccagaaacagaaactaagaacctatgtctgtattctctcccttggatacctgaaaaaggacattaaaaagtcagtgtaaaacaaagaaaaaacaaaaatgtaagcgaaatttatgactttggttcaattatatcccagatatcccaaatctgtagaaataaccaaggggagatcaaaatttttcaagtataaaggtagtactcagtttttaacttcttaaatgaggagtgcccctcagtcttctgttatataaaaatttactgttgcatatgtttccaaataatgaattaccaagtatgactgatacataaaattatactatgaaagaaaacttacaagtatttgaaatatatcaagtatcccccccaaaaaacaaaccaattaacttgaaattgtaaattacacaaaatgtaataagtaaattaacatataaagtcttttgtaaattaaacaaaatatatcaagtaagttaaaatataaagacttcccggatagattccaaccaaaaagttgctcaggagcttgaaaataccttcttaaatgctttggctcacatttctagtttaaatgattattgcatatatttttgagacatggcatatgattttatatatatatatatatatacacacatatatatatacacacacatgtatctcaagaagagatggatagttgtatagcttgatatttgtttctatgtttgatttaacattgtcatataaatttgtaactggcactacatgatattgatgccttgtgattcccataagtaagaaaagtggacagttgttttttatttatttccgttcataaatgtcagaacaggtacccttaaactatggggataagttttggcttaagttactggaactttttgaccaatatatttaactagaatgagaaaatgtactttgacaatttcaagcatagttatgattctatttcctaaataaaaattgtacaaaatttaatattttacttttatgtaggtattttttttaaatttgtgaatgaaggactttcaattttttatcaagtctgggtgagtagtagttgttattgcattacctttatgcaaattagaaaactgagaagtgacgaaagtcagatagcaagtaaataagtatcagtcagggctggctggctgacttcaggttcaatattctgttcattaaactacaagtaatgttttaaatctattcaatgttgcagtgatatcaaaaagccatagtttgtgatatttgtgcagctactagtgttgtttcttaaatatattttaaaatacgtgtcattattcaatgcttggaagatgcaacaataaaaggttatgcattttttaacaagtgaggacatttctgtataagattatcttatccatgtttttatctttatcaaaaatttactgattataacacagtaagtgctaaaggaaggtatgagtgtaatactgtgaactgatatggatagaatattttggcgtgttgggagatgaatgcttgcctacagaggattgatgacaaagtcagagggtatcaggatgtggtcccacagaaagctctgggcttaaaattgagatattggagtcatttagtatacatggagtcaatgtttgtgagtatctaaattcttacttgcaaaaagaaggagattggtagacatcagggtcccccatcgttgaattctggctaattctgccttatcatccctttcgcactcacagtgtgcacaattttcctttttaaatccctttggaagaggatgcacttgacatttaactatgggccccatcatcctttctggtctcacgatccatctgatttacagtttttgttatctgcctagccccattgtagattaattccaagttctctttttgctaagcaaaacaaaacaaaaaaatccttgcggcattttcatctaaaattaactggttgtatgtgtaattgcaaacaaataatagctaaagccggcttctgttccagataatactgttttaaggctacaaaacctactaaaattgttaaaggtttctcaattgccaaaatataaagatatccccttacaaaattattaacattaatctaatagtctgatttatgaaaattcttaagaagtacattaattacttgactaatcagccaggggatccagcattagctttctcaaatttaactgagctgaaaggagtctaatcctgtgatacagagaaataattgggtttccaatgtctgatagtcttaattcatggagatagcttgagtcccttgaagaaagatctggtcatcagggtctgttaccctctaatcgtaatccttatttcttctcaaaggtcttgctaccctttttactggatttagaacgccatgtatgatgctttaactttccatccgtaacagattttctctgtctgttttgggtatttccactcattttcttctctttgtctcccatcttcctagagaaagagaagtcttgttaccctttttactgaatttagaaagccatgtatgatgctttaactttctatccctaacacattttctctgttttgggtatttccactcattttcttctctttttctcccatcttcctaaagaaagcgaagggtaagcttatcccatctcctccctcaagtgctttctctttcatttttaattctctttgcctagctttttcccctttgtgaggaccaagaaaaatatcctgtgcttcctagaacatgtgcactcttctttccctccttgtattgcccaacttgtttaaaagtaatctgcacaaagcacacttcacatgtgcctcaactgctcactacctaacctcttacagttggtaatcttctcccactgcccttctgaaattgcttctgctttgccttgactggcatttattgctttctgtctgattttaaaagtgatatctatttactgtagaaacttacaaagatataaaaaaagaaagaaaaattacctttaataccattctccagagatgctggattataaggcacttctatttttaatcttttgagaaacctctagactgttttccataatgcctgtactaatttatattcccacgaacagtattccagagttcttttttctcacctcgtcacccacacttctcattttttgtctttttgataatagccatttgaacagatgcaaggtgatagctcattgtggttttaatttgcattgctctgatgattagtaatgttcagcattttttcatatacttcttggccatttgtatgtcttcttttaagaaatgtctattcagtttatttgactgttttttaattagattttttttgctattaagttgtttgagttcttgtatattttgtgttttaatctcttatcaggtgtgcagtttgcaaatattttctcccattccataggttatctcttcactctgtcaattctttcctttgctgtcataaagttttatatgttatgtaatccaattgtctgttttcactattgttacctgtgcatctggggtcatataaaaaaaatcactgccaagaccaatgttttggagatttcccctatgtttccttccagtggttttacaggttcagttcttatatttaagtttttaatccattttaagttgatttttgtaaatggtgtaagataaggatctaatttcctaattctacatctgaatatccaaatgtttcagcaccatttattgaaagggctgtcctttccccattgtgtgttcttggcacatttactaaaaatcaattaaccatagatacatggatttatatcttggctttctattctattccattagtctactttccttttatatgctataccatgctgttttaatataattttgtagcatattttaaagacagatagtgtgatgcctttagctttgttctttttgttcaagattgctttggccatttggggtctatttgtggttccatataaattttaggacagttttttttctatttctgggaaaaataccattgggatagttatagaatttgcattgaattggtagataactctgggctgtatgaacattttaacaatattatttcttcacattcatgaacatgggatagcttgctatttaatgtgtttaatttatttcatcaatactttatagttttcagtgcacagatcttttaccttcttagctgaattattttaaagtattttattttttggtagctattataaaagggatttttttttagttctttttttggaaagtttgttgttagtgtatagaaatgctactgataatcgtatattgattttgtatcctgcaactttactgaattgatttattagttctaagaggtttttttttctttttcttttttttttttttttgaaggagtctttgggtttttctatttgttaagaccatgtcatctacaaacagggacaatttagcatttaatttccaatttggagaccttctagttccctttagttctttcttttgtctatttttttctggctaggacttctagtactacactgaaaaatgtgggaagagtgggcctccttgccttgttcttgatcatagataaaagctttcaagttttcaccactgagtatgttagctttgggcttgtcatatatggcctttattgtgttgaggtacattccttctattaccaatttgttgagaggttttatcatgaagggttattatgtttgtcaaaggattattctgcttctattgatatgatcatatggtttttgtctttcattccgataatgtggtgtatcacaattatagacttgtgtatgttgaaacatccctgagataaacaccacttgatcataataagaaatccttttaatatgctgcataagttctttgctagtattttgttgagagttttcatatttatgttccccagggatattgacctgtaatgatcttttcttgtagtggctttgcctggtgttggtatcagggtaatgctggccttgtacaataagtttggaagtattccaatttctttaatttattggaagacttcaaaaacattggtataaattattctttagatgttagaattcagcagtaaagccatcaagtcctggcttatctttgctagaagactttttattgcttatgtaatttccttactcgttattggtatgtttgggttttctatttattcatgattcagttttagtaggtagtgtatgtctagtaatttatcaatttattctagattatccaatttgttggcatatgattgctcataatagtctcttatgatcttttgtatttctgtggtattagttgtaatgtctcctatattatttctaattttgattctttttttaaaaattaatctagctaaaggcttgtcaattttattatcttttaatttttttgttcatctactataggtttttgctctgtaactaacatgaggcttgcttagaacatcttatagttataactatggttattttaagctgatgacaacttttatcacattaaaaactgaacacttttactccacatattctaacattttgtttttaatgccacagtttaattttttaattacatattccttaacacattattgcagctgtttttttaaatacttttgcattttactctttatacaaggatatgtgataattagccattacattattagcatattctgaatttgactttcaccagagagttttactttcagatgattgtgtgttatacattagtgtcccattttttttcagcttgaagaactccctttcacatttcaggtctggtagtaattaatttcccaaatatttgttttgttttgttttgtctgaaaaaggctttatctctcctttgtttctgagagtatctttgtcaggtgcagtattcttggttgacagtttttttttttttctccgcagcattttgaatatgcatttgccatccattatctattggcctttaatgaattttttttctgtgaaatctgattctagcctgattggaactctcatatatgtgatttgcatcctttctcttgctgctttcaggatcttctatttgcctttgatttttggcagattgtttataatatgtctttgtgtagtcttatttagattgaatctaattggagactcttctatacctagatatttatatctctacctagatttgaaaagttttctgtgatcacttatttgcataagctttccacctctttgtctctctcttcttcttcttgaactcctaaatcttgaatatttgatcttttaaagctgtcccataaatcccatgttttatttattccttttcatcctcttttcttttttctcctctgattgtatattttaaaataaactgttttcgagttcacagattctttcttctgctttgataaattctgctgttgatgttctctattgtattttgttgttgttgttgttgttgtttagttcattatattttccagctccgggatttctgatttagaaaaaaattattttaaatttctaatttggttgtttattatagtttttctgatatcattttattgtttctctgtattttcttgaagtgttccagactttcttaaaataattattttgaattatttgttagacagtttgtttctccatttctttgtggtcagcaactgagagattattgtattcttttgatggtgttatgtctctttgtttttttttttttattttgttgttgttgttgtcttatgttgataactgcacatttggagaagttgagacttattttagtctttgcagactgactttgtctgggaatacccttcagcaatcagcccatccagagattctaggcaggccatttgctacagtttacaggtgagcttgctactggagttctcatgcaagcttatttgattcttgggttcagcaggtaggcaagcctgatgcctgggtccatgggattgggcctgaatcctggatccacttgggtagacctgttgattgagtccatgggggtgggcctggagcctgtatctgcaggggctggcttaaaacttgggtccacaaaggctgatgtactggtgggataggctttgagcctgagtctgcaggggctgaccaggtactggcatgggcctaggacctgggtctactagaacaggcctggagcctgagttcatagggtctggcttggtgctgcagcaggcctgaagcttgtgttcatgggggcaagtatggcttctgggtccattgggggctggcctggagcctgggtctgcaggggttcatgagggctaccctagcactgccctggcactcaggggtctactgtagttaggccgaaccctgggtatgctgaagccagattcgactctggatccaactggagcatgggtccatggggactggcatgaagcctgggtcctctggggttggcctggagcatgggtgtgtgagtgctgacctggagactagttctatgagggccatcctggaatttgggtccacagggatggtcctggagcttgagtatgttccagccaataaattgctgtgatttactgtgatgggtctgaagcctgtatctgctggaggaggcctggacctcgggtctgctggtgtgggtgtgtgctggggccagcccaagactgggcagacatggagcatgcgtccatgggtgccagcctaggtcccaagaccaggagtgcttagctagccctgtgtggacctgaagcctggggctgtgtgggtccacccagctctgtgctggtctgaaacctggggtagtcgtggagaccaaagggcctggcctagaggttgagtctgaagatgctggcctgattactagggatgtgggggctggcctggcactggggttgacccgaatctcagacctggcttgggggacagtatgaagcctggggctgtaggaactcaactggttttggcactagcttggaggttcagtctgagggtattagcctgaattctgggagcatgtgggcttgcccagctgtgttttactggggtgaacctggtgttggagtacaaggcaaagtcttggcaccaactctgaggttcagtctgaggtctgggagcatgtgtgcttgcccagctgtgttttactggagtgagcctggtgttggagtccaaggccaagtccactgctttcttccctccctttccctcaagcagagagtatttctccccatgctgtgctgcaggggaaggattgatgtgggtaatgtacaactgtccttcctactctctttaatgaatcttttcttatttttgtgtcacactcaggtgctataatttttcacctgtttccttagctcttgtaaaaatattttcatgcagggatagttgttcaaattgatgtttctgcaggaagccagggaatgaggactggaaagtcctattctgccatattgctgacatcttgctgatcagaaccccagtcttcagttgttaaggatttagaatattttctattataaacaagtattggaattgctctcttgaagattatcagtaacccctaatgacgtaaaccaatgtcattttctgggccttctggcatttggaatggctgctgcatcttttgagatgaacttccctctgcctttgattctctttcttttgttctgactttttattcctctccctctcctaaatgtagatgtcctttgaggtagtgtcctttgctttctagtctaataaactcttctctggaaaatttacttttctgaaatttacatttttagtgttgaaatctctcacaagttctatcccttttttcttcttaaacatttctacttaaaaccaatgttaaaaccaaattggatttaccaaagattatataaaattgaacttcactaaccccaaatttatgactttttgtaacttacagatttaatggtactaactattgtctgaattatccaagcaaagcttctcatgtaaactcgtgcatcttttctgccaacatgtccaagtccttttgtcccctcccttcctttccatttaatctcaatgaaattcatcctctactgttttaacagaagttataacttctattagcatcacctttaggctgcccaatatcgtcatttaccagaaaaaatgtgttctttaaaacataggtcagtggtccaatatgtatcacaatataaaagcaatttgaaaaagtttttgatacttcagttacctgcatcacagaagagttttctttttctatgtagagggttagggacagggtctctttgttcctgctttttcaaggatttgtggtctggaaggtttttcactatgggttcccctctgatactgctttctaatcattgaaatccatacacagtgtattaggtaatatctaagctgatagcacctctgacatggtcttatctacttgggatgtactcatctgcctgagtcatcgtcatgttctttaacaagaaatcattcaaaaattgccctaccgtggtctgtggacagttaagacaggcactccacagatacataccattcaactctaataaaggctacccatttttcagattactttttaaggcaaaaatacttctgtacaaatagttaaataaattacatatgctatttttgtgtgttcgtggtgcttaaatgaacagttttatttctatgtgaaagagaaaaaaatggtaatgttattacaggaaaatactatcatgttaagaagaacatatgtttgactaagattttatcatattaagcacccagctgtctttggccattgaagctttcttggacagataggttcctgagcattctaaaaacactctttttgattgccaatatgatgtttggtttcagagactttctgtctcatgtatttgccataaagaatgaacatactgatgctctccctcagttttagcaagagaaacattttagagcactggaatgaggtactatggaaggctgtataattaccttccattaaggtctttaaaaacagaatggctatttatatttcttgaattgtcttaaagaagctctttctacatgggaggaatggttctgtgatggtttttgaggtcattttaggtcttgagtagtttttatgttttagataagtttggtacagaaaaacacacttgttcagaaaaattgggtctggcactggttctatcataaggttattgcataaatcctaattctgtcaccatttctaaacagtgttttaggatggaatgaaataataagtgtaaacattctgtcgcctctttagaaaacagcttgatttgaatttctctgatggctagtgatgatgagcattttttcatgtgtcttttggctgtataaatgtcttcttttgagaagtgtctgttcatatcctttgcccactttttgatggggttgtttgtttttttcttgtaaatttgtttgagttcattgtagattctggatattagccctttgtcagatgagtatgttgcaaaaattttctcccattttgtaggttgcctgttcgctctgatggtagtttcttttgctgtgtagaagctctttagtttaataagaaaatgtggcacatatacaccatggaatactatgcagccataaaaaatgatgagttcatgtcctttgtagggacatggatgaaattggaaaccatcattctcagcaaactatcgcaaggacaaaaaaccaaacaccgcatattctcactcatagatgggaattgaacaatgagaacacatggacactggaaggggaacatcacactctggggactgttgtggggtgggtggagggatagcattaggagatatacctaatgctaaatgacgagttaatgggtgcagcacaccagtatggcacatgtatacatatgtaactaacctgcacattgtgcacatgtaccctaaaacttaaagtataataataaaaaaagattaaaaaaaccataaaacacaccataataaaatgaaacccctaggggaaaaaaaaaagcaaacagcttgaaagacaaatccaatacagtcttgtctaattgttttttaatctctatacagctgaactgttgtgatggttgaggcaattaataaaagaagtctgcattttgaagaaataataagtgagaatagaagtcagggaagaccattgtttcacagaggcgacctaagtggtttcaacttatacgaacactgtgtgctaacagctgtgggtccgtcctccttttccaactttgagaaattttctcctttcaaacggttctttcttatcccacagtctgctctgccatctctttcctcattacttttcttggcctgagcatctgttctttcccctgtgtgctgctaagggaagaggcaaggtggtagagtgaaaagaacagggattttgaatgaggcagacctggattggaatcttgctttattacttaccatcaagattgctttagtcaagttacatatctccatctaaaacactgacataatttctgttacaaaacgaggtgatatattgaaaacatcttagcagggttgctgacaaataatgaattcttaataattattaggcattattgctctattttcatatggcctgtcaaaataccaccaccacccaatttaaacataattattttaagcctaataaaaggaatataaattggctttagaaaaaaagtataaataggagcaaaagttatttgagtgagatagccaaacataaataaaagcaggcattattaacataaacagtttcaattaagatgcatgcttttaaactgaatactttatgagaaaagtatcaagttctcagatataagttgaggatggatacctctggtaattttcccaaattagaggccactatgaagaaataatatttcagatatatactcaaaaatggaaatgtatttcaaatctgtatgtttgttggtgaaagcatgtgatattttccaagtcaaagaggctgtgtggcattagagttaagtgcagtgctgggtttgtattccaactttattagttactagctgtattatcttgggcaagctatctaactgccccatgcttcatgctttcatgcatacatttggaataataatagttctgtgcttacatagtttgtgtgtgtgtgcatgtatgtatgtatgataattaactgaattatttcatgaaagggattacaacagtcttcggcaaagactaagtgttcaatattaattaggtgctcttattgctatcattattagtagtagtagctacaggaagatagtgctacttgaaaaaaaacacatcttccccaaattattttatggctaacatggattgagcattgaatatcttcacagactagaagaaaacactgtttgagcctaaaacaaggggatcaatattatcagtatttcatttatttattgatgaagaagttaaagatagctacaatgttgaaagctactccacataacaaagtaaagatctattgtctacttggtttgcaaataagatacagtattggagttgtgcctaagtaaaaattattttttctattgtgaaaatatcaattacacatttattttttgtaaggtacatttttaatcaatgtccctagtacttacaaacatatagacacacacacacacacacacacacacacacacacacacacacctatgcaattcaatccttgctgcaattctgcaaggcagatattaatagttctattgtacaaatggaaaaattgaagatgagaaaaattctgtgggttgcctaaagggatgactaaactgagtaaatgggatacttcttgactcttctttgggtcgctttgtttctctcaaagtatattcacttcccgagagtatgactattacacttctctgtggacctctgctatattttatgttcagaaaacgtaccgtatttaagaagaaagttcattctttgcaattaaactctactaagaaatatgggtgcattcgtatggagagctgctgaatgcctgagtgtggcaaggaaatctctggaggcagaatggaaacaaaactcactctaaaggagtttggggttccaggcatttacaaaagtagaaggccagagataagcatggaagatgctgatcaatagacagactggaaaaatgtgaccatagtcacagaggggttcaattgtagctgcattaatgaagcaggttcttgacaattttggtaaaccatgctgatagccagcagcatgcaccaaagagtaaatcatgctctctggaggcctatcacagaagggatgccaactaatgagattccacacatcattgtgatgaggtatgaatgctcatcaggaacaatcgacctagaaaccgaggccagtatttcaaggggtatcttacggtcaagcccttactggtgtagacagctccagatgaaatatataattgttctaagccaacttagtgacagagcaaccctgactatttcctaccagggctgacaggttttttggactgggtatggatgagtaaaccttaaaatagaacaaggggtaggctaaatccttctggtcttgtgtgttgctgagagaataggaactctggaatcagagagaccaagattcaaaactcagctcttctatttattttatataatattgggtaagtatttaccttcctaggctttagtttctttatctctaaaatgggactaagaatacctacctcaaaatgcctaatataatatacataaatttctgtaatgtaacatctgtttaataatttttattttattttatttaaaaattttttaatttcaatattctaatttttaggcataagccaataaatattagttttatcagcctccttctattaatatttgagaccagaattgatatacaatgtacttcatatcttttcctgattataatttcctcacattcttgcttttttcttaaagttgatgatgcgtttattcattcgacaatcagttattgaacaaatataatgtgccaggaacagtgtcaggtactgagactgcagaaacagaagacatggcctttcttccaagttaatcattgcagcattcatagacaacttccgtacaatatggtgagtacaggatgctaggggagcacctcggacagatagagtgatgatggttaacatctgtggtacattttaaagtatgagtataggttatccaggtaaacgtggatgagaataatgatacattcccccaaaaggataacacatggaaagatatggaggccttgcatggacaaatatgggtctctttcttgtgttttaggccatttataatgtgtaaatggattccaataaattagtcaattcaactgctaatcacggacacccatttccatctagccttctcttttgccacttgttggtcattcttggctccagctacctctaattatctagttttctatactgtttggctgtgtaaactaacaaatctctagggataggctttagatttgcaagcagagtctggatgtttttcttaacaatttaaccatagtcagtgccacagatgtgttagcaaaaaataaaagtgtaaagttttattgggaattaacatttcaatgcagttgctgctgtactttacacacagccttgaaaacaagtattataaattgaataaccagaaaagattataactccctacgtctaagatgtgtgttatcctaagtgtctattgtgtgcaataatgtaactagtttaaaaacagtgttcaaattttgtccaaatagtctatcaaagcaaaggatggaattctggtgctctgtactttagttggcttgtgtgtattaagatgagtagctgtaaactgaagtcatttgcataacactccacctgagggccccaaatcaggcctcatctatgcaatcgtgatttttattttattttagttagataatatattttgaacaaaggaattttctgtttgtatattattacctttaaaatgtcactttgtctagcaaagtgtaagctcacagaaatgtgtggatatatagagaaatgttgaataaacacatttacattactagaaaagaaaaagtgatggctggtgacttaggattccaagatgtgcttatttatcagtatagagcttggctgcctctttatagttttctagtacttgtaggaatattagtaagttgcttaactgggtaaagaagtagcaacttaaatatatataatccattatgacacagggcttaaaggccagagagaaaacatactgtttgggacctatagttttatactctgttgtttcaaatctcattatttatcaagaagtgtaaagagccaaccaaggtgattaagggggaaaagacttctgaaccaaatatgtttactcatcactctaaagtatatgggcttatgcagaaatgctaaccctgctacaaatttacactgttcagcaaatactgggtctctatgttttgtttattccaattgtgtcctttagtctctgagtctctgaaagcatggtacaggttgaatgtagccatctgtgatgtcctgtctgatgtatcagagttatcttgacaacagacagcaaagttatagatgtactttgtttcatactaatctggtattgagacctaaggaaactagaataattataaagggcagtttttgaagaaattccccatgctatgtttaaccaggttgataatgacagaatttgcaaattaaactaaattaaaaaatttctaaggttataacatttatactaagatctgtgattccttagaaagttaatgttttagttgggttccatttaagtagaaggttgtcagaatgtgaataaagaaataatgggaaggtatttagaagtgcatttaagaaatgacagaccaaagagaaaatgctagtttgttaataggaagagtagacattaaatgaattatttgctaagatatttacagggaaaggcaggggacagatgccagccacagacatgagtttccccagagaggaaaagaggaactatgatagcacaaaaccagatgatcaaggtattagaatgtgaagtctgagaaaagctcctggccatatggagcccatcccattactgtgaaatgaaaaaagaaagaaagaaaccttcctctctatgcttagtttccaactatacaaggcactatattaaaaggaaatgcaaatgcatttagtttagaagaaaactaaagattaatttagctatgaacaagatgatttttattgataataaaacaatgcattttacaggttataaattgaagtttatttgaaacttataaaatgacttaataaaatatactctcaatctttttgtcaccgaagtaattagattacattaccaaatagttgcccaaagaattagtgtttacatatatataaacatacatacatttatatatattttataactatatatggttataaaataatctttagtatcaaccaatataaacatctcaatgttgtatgtttccagtgaaaatgaagaataattaggattagttaaagcttgatggagttagaggatacttttgagagaaaatgttggataggaggaatacatttatcctatttcaagtactctctaaagtaggtgatttcctaagtgttttaggtcgctagtacactagtactattgtttagtagcccaagggtctacaaaactcaccaagttatgggttcagaagcaggttatgccagccgttagtccagaagttcaataaaccccacctctaggtgcttggtctaattgccattatataaattcacatctttcccttgagtagatatatttttccttttcctttactcctcttagaactacttatgtctctcttatgtaccctttccccttctagaacatctcttggggtctgtgggagtttctcatttacggtccttttgcatctccagtgtttttctccagttgcatcctagcttcctctggttgttgctcactacagccagcattggagctgtttgctggctgtagtggatgggcagctatgccagtgttcaggggcacccatcctctcgtgatcaccaaaaatctcttattaatctcactcccactgctctcagccaagtcacaggctcctacgggtccgcagagcctcctgttaaggaatgggtcacttcctattagttgctgctcgtgtcatttaggctattaccactgcctgcaggtttgtggtctgcacatgaactactcctagggaaaaaaaaaatagtcctcttgttgttattttgtttatgtagagtggtcccacagcagagttgctttggaccttattataaaatctattttatccttgcagacctctcctctcttagttttggttcacttttctagatttatctttgctttatccaatttttttttttttttttttttttttttttttttttgttgagacggagtctcgctctgtcacccaggctgagtgcagtggcacgatttcggctcactgcaagctccgcctcccgggttcacgccattctcctgcctcaacctcccgagtagctgggactataggcgcccaccaccacgcccggctaattttttgtatttttagtagagacggggtttcaccgtgttagccaggatggtctcaatctcctgacctcgtgatccgcccacctcggcctcccaaagtgctgagattacaggtgtgagccaccgcgcccagcctgctttatccaattcttattggcccctaacattttaagaaatagttctgtaaagaacacgttcaagtgtaattcagtacaatttgcaacattatgggctagacaaatataatttcaaggaattggggtgccgcactggagagctctatgaaaagagaaactgtatcccgtttatctgtgtatctcatataatggccaggatgttttttaattaatgtaacatgtttaattgataacgttagagtaagaattaaggaacactctaatcatagcaggtttgaaattgttaattgttaaaatcttattgtcaattttccctcaatgtttctttgtcacaaattaacttttgttattatttttggtgtgagttgaaagtctttggttaagaacaaatatttgtgatcaaatgtgtctgaattgggtgaaggcttgtttcatggtggccttaatcacccaagtctatttgttgcactctcttcattaagatttaagctaggctgggcgcagtggctcacgcctgtaatcccaacactttgggaggccaaggtgggcagatcacgaggtcaggagttcgagaccagcctgaccaacatggtgaaactctgtctctactaaaaatacaaaaattagccaggtgtggtggcgcgtgcctgtaattctaactactaaggaggctgaggcagtagaattgcttgaacccaggaggctgaggttgcagtgagcagagattgtgccattgcactccagactgggcaacagagcgagactacgtctcaaaagctaaatcatctgtttgaaaccctagtatgttttcagacacggagtggtatttgttcatgacctgattactctcatcaacagcataaagcttttattcagtgccatttgtgggttttcctatgctggtaattgtataaaagaaattcaattcatttcaaacatttattgagtacatgtgatgcatcaggtactatgatagatcctggggatatgaaggtgcattaaatgtggtaagagtttgctggtggtgaatcggggagagggatagtttgtttcagatggaaggaacagcatatgcagaaagcacagagtgtggaaaatacatgggctgtgtgaggtcagatgaataatcagtgcaggtaaagttaaaaagatatgcagtctgttcttccaagccatataacctaagattgtagattgcattgagaaaaacaaatctcgtgtcttatagattatttctccaaatgactcaagagaaaatgttaggtagtatatatagatgcttagttaaaacttgttcaatgacaaaaaagcattttaaaatgaaacaaaactaaaaatatgtttctgatggaagtaggaagatggtgcacatttcaaaaagtgaagtacaatgccaagacacttgtgcttagtgactaaggaaaattgtagaattattatgcaatgatcaaaggaatgaattcatgtaataccaaggatcactgtaacagttattgatataaagttaacacctggagctgccagtgctaatgaggtagctcccatcaaggatacctgtgatcagcatcttttatatgcaataaagtgctaaaacagctcctgcataagccatgaggaaaatttctattaacagaatattagtgctggaaaaggatcacatgacctaaaggtatcagcaaccttctgaatacttcacctgggacagggttaagagactattgaactagatgttttacagatgaacaaactgaggctacagaggtaaagagagttgctcaaacacacaactggctagtaacagagccagcgctaatgtccggtacagtgctcctctcctagactttgctgtccctggccagcccctttatgttacatagttagataagtagatatttatgacatcattaagtggcataagtcatttagcttcagagctataataataaaaatccatcccttttacttttagatttgagacctttctaccatatcacaccatctttcatatataagcgtttatcttccgaccaaagtgatatatgatgcaaaaataccaaatataaactggaattgctttatgcttctttctgtgaaagttaagtaatattttgagacaatttacccagtaatgtggatttctttaactttgtagacaccaaagggaccttgtgtttattataatatatatatgacataaattgtaatatatagttcaatgaagctactcagagtggggaaagtccatgagttggaactgtgccactgccctgacgtttgctgcatccactgaccccttgtctccttgactagacagtaagtcacaggatttctaggaagggtgtgtgcatgtaaagggcaattacaatacttcaggcatttcttcagtgttaacagtcatatctaaattttgattccataatatacaatgtatggtgaaatgaaatcttaattattatactgcattacaaagtttatgtttattagtacagtgtggctgtttttcttgacaaacatcaggcctgtgtcaggctgcatctgagatgattgggagacattggcctatctggcctaccacatctatatttttccagtctttctctactattgggaggttgtagaaacttgtccagcccatatgtgcgtcatttactgcagtgaaactgagctttgccccttttctagaaatctgaaagttgagatccagaaccagaagtcctcagggcaattatcaggagcaaaagcaaggaggcaagggaggagaaaaacaggaggaggaagagaagtgaagggtgagcatgccagtggaagggtctgaatgggtgctggggtgaggggtgattgatcaccttcacctttgtgcttgagtatgcctgtttcattgaaagggcaagggaggggccgagcaggcagtgaggatgaatgtggttacttagggtcctgaggagcacaggtgggaaaataattcagacctctataagtctcttctggccttagaaatagtaattctcaaacctagccgtgcctcagaagttctttgggatcagattcccaggaagatgcattctgacttcataggtcttgggacgagatcaggagagtatgtgttttaaaagcacactaaaggattctgatacacagctgatttgggctatatgcctctggaaattctttacagtactcacacaatgattaaatgattatattttaatatttaataaagactctggaatatttacaagataccacttctactttaccaaattcctttgctccatataaaggtcatacaaataagaggcaagactttactctcctattcttatatcatctggggaaaaatcacttgaaataagcatcagtggaatcaacatacagatataaaattgaaatataatctcatgcctctagtgcttaatggaaatgagtacccaccaactagactttgggcatgaataaatagaagtattgaccatcagtcagaagcaatcattataacattttataaagaatgagtgatgcttcttcagaaatgcagtacaagatatgccatttaaaggaatgcacacattattaaccttttaatagttcaagtcattagaatgtgatgttgaatattttcaggtatcaagagaagatgaatttaccacaaggcagcttattccagcacaaagagcccttgatttcaattcaagaaatctgggttctagctctcattcagctactaactagctgggtatatttttctgttttgcattaccataaaggaatatcgtgtagcttgtgaagaagaggtgtttatttggcttggagttctgcaaactgtgcaggaaacatgacaccagcatctgcttggcttctggtgaggcctcaagaagcttttatccaggtcgaaggtgaagtgggagcaggtgtgtcacatggtgagagattaaacaagagagatgtcaggctcttttaaacaactgtcttttgcataaatgcatagagcaagaactcactattgtggggagggcatcaagccattcatcagggatccaactccattaggcctcacttccaacattggagatgacatttcaatacgagatttggaggagagaaacatccaaactgttacactggctgaattgcacaacactccttagtgtcttagaaaaagagtggggctatatctccaaagtttcccaaaatcaaattttctatgatacttgtcattgtgatttagaattcttacacaggaatgggtcagattactgcagtactacagtggttggttggcagaaaatgattcagcccagtgtgctttcttctggtaaaatgctacaactgacaagatcatttctgggtttgccatttatagtctctaaatatctttaatttaaaaataacctatttttttcctggctttttgatctattaggttggcacaaaagtaattgcatttttttggcattaactactattacttttgcaccaacataattttttttgttctagatcatcttgtcacttaacaaatatatattgacacatattatgttcaagacactagcctgcttaatatgaaaaatatacccccaaggaatttagagattaatagagatgacaagaaatagacaatgcccaggaagctagagacattgctataaaatgataattataagaattcagactaggagaccttatttctactatgagtctgctttatagagatggcatctgtgttgcatactaaagttcaggaaggatttggaaatggaaatttggtggggcacagcacttcaggtagagagagatgaaagaactgtatcatgtttggagaacagtgaatgattaagtttgatgtataggacataagaagaaaatccctgggaaacaagctgaaaagatgggttggatgagtgacagtgaggctcatgggtctgccttttcaggaagaaactttctacggtcaggctatttctgggtttgttaatatcatattcctgcccgtgaggcacctttgccattagctgtgatcaccacatagtatgtgtgtgtttcctcacaccagagcttattttcaggagacttttgacatggtatcctggccttgaaacttggcctttgatatgcgatacttgatgtgaaaggttaggttcactgttcctactttgttgactgttttctttcaggccatattctggttttattaattcttagtctccttccttcagtatgttttaagatggtatgtatgaaggagaaactgatgcttgaaataaaagagaaaatgcacgtctcctgatactaagcactaacgatcctggatgttcagagcttcatgatcgtcttgctaacaatctggcacacttacagaacagtaactgcaagaagagactgtttggagaggttttactttcaataataaaccggatatactcattaattatattctaaaaccaacttttgacatggtgagaagaaaatttcaagtcatttccttcagtgtccaatgtcccctgtgctatttattatattcctctggaaaccattttgtttagctattgaaatctattaattttgtcccattggtcatatttaggcccttctataagatgtacttgctgtgttaattatttaactatcttccaacataaataatgtgtgggtttgatttcaagtgtagatgatccaggatgtgttttaaaaggctcaaattcgccatgttgcactgtataactacattaggtgtgtctgggaatggctctgagcggaattagaagtaagggaactttgttcttcatcctagacctacttttcttgtcccttccctctcctgccagtggtcttggcttctgtctctcaggaacagtttctatctgttcctttcaaaacctgcccttatatgatgctcctttaaattaattcacacaatagtttaatcaactgataactgagagttatcctttattacgtgcatttgatttaataggttataataccctaagccaaatgagtttttttttttttttaattaggtatgtttgaagtagagaggcattcctggcttattaaaatgtatccttttgacttttagatcccacagataagtgagaatatgtgatttttatctttctgtgcctggcttatttcacttaacataatgatctctagttccatccatgttgttgcaaataactggatctcatttttttttttatggctgaatagtactcccttgtgtatatgtaccaccttttctttatccattaatctgttgctggactgttaagttgcttccaaatcttagctattgtaaacagcgctacacaaaacatagtgcagatacctctcctttgatatgctgatttcctttcttttgggtatgtacccagcagtaggattgttggatcatatggtagctcaaattttagctttctgagaaacctccaaactgttctccacagcggttgtactaatttacattcccaccaattgaactcatcgatatagagagtacaaggaaggttaccagagcctgggaagggtagtgagggaatggcggggggaagtggggatggttaataggttaaaaaaaaaatagaaagaatgaataagacctattattggatagcacaacaggatgactacagtcaagaataattgtacattttaaaacaaagagtgtaattggattggttgtaacaccaaggataaatgcttgagaagatggatactccaattctccatgatgtgtttattccacgttgcatgcgtgtatcaaaacatctcatgtatttcacaaatatgtacagctactatatacccacaaaaattaatttaaaaatgaaaaatgtattctttatcctctcctatcccaaccgaaaagagccattttaaaaagttaagtatttgataaaatattctaaagctctttgttaggtatgaccttaagtttagcaaacatgcctgatattttatacctacaagattcctctttctagtttgcatttagaatgtgctttattcctcaagtgtttggatgtttctttccttacgtctaatgaaaattctgtattgctgtcaaaattcaaaaagaaccattatcatttctctgtggtagttcaggaaaatttaaattagatttgtactcttcaaaatcaaagcctgtttaggcataaacaaattacatgcaaataatgcagaaaatatcaggtgtatttattacacttggatatgacctttggaaaaataatatagtgcctggttttgttaaagaagcagtggagaactgtggctgaataaaaagtcatctatacacagtaaaagtatagtttctttaagtaattgttcatatcagaattatactcctgttctgatatgtaatgagaaaaaggtgaagaaagttagctccacaaatgtgctaaagacaaagagacaagtggcattatttcatctgcctttggttctaatcttgttaaattaggggagagaggagaataatctttaaaatgccatgtgtggaatgtcatacatgactggaatctaggttccttcaaaccaacttaatattatgataaactggaactgttgtcattgttgtcatttatgccatcactgtatttatggccaaggatgctgcattttatgctgaattacacattaccataaacaaatgacgataattttgatgcctataagaagttttattttttaatgaaaaaaagcaggcaagaagttgtaccgtttggcaagatagaattttcatgaagacaaagtatgtcattgttcatataatgtagtttggcaagtgctaagtaagggtctcagtctcaaaacaagacacccttttgacttcagcagatatgtaaaggctgttcattaccttcctacttactccttttggtagatttcacagtatgtaatgcatcagtgcagaggctctcaggataccatgcatgtaaactgtgatgactggtggagtattgggatcattagactaagtttgggttgtagaggattgggcactgcctgagtgagcttttggaggtgagtgagaaaaaggagcagggggactccaagaaggaggagtgctaacatgagacacagagaatccaaatttcatcaaatcttttaatatttagtaggactaattttaggcccagtattactaattttttcccatttgatatttagcttgtgaaaagtcaacatgtagacatttggttgggaaaaatgttatattaaaacatcattttacctcatttttctaatcatagaaacatggttctttttcctgtaatatttatgtctctggacatttttgtccctgaacatgcatgggtacaaaatcagaaagaaatgagcttaaatactgcctttgcacataggagcaaagtgatttggggcaagataaccacactgatcataattttctcatttgagaaatagagataataaccttgatgagatttttacggagcaatatgatgatatctgtacatcacctcattgagtgctggtacatggtaatgttcaaggttagctagtatcattgtcattgatactactgtctctctgctgagacattctgaaaattatttctttctagaaataagccttttggtcagacttaacaaaaatgttattttatttttaatatatttgaaaatcaggactatcaggctctgttgctttttttccacgtggtacaaatacatgcagagttgatttgattttaaataagtaaggtatgagaatcttagtcaaaccttttttatgccaagaaatgtaaagattccttatttgaatattgttgtggttctttgtataaatgcaatcattatgaaatgtacattatgacttgcttctccatggcatcttggacaagagcttttgcttactttggcagaggtctgtgtgtataagggtgtcttcaaaatgcacagctgactgatcaaagggatgctctaggatctgatgttcttgatgtaggtaagactcattattcagaaacttgataaacagaaatataaactttttaataacactaatgtaagtcatggaactgattcattatacattataaattcgtttacatatcttgtagttaattcaacattgtaaatgttatcttctattatttaatgtcctgtagtatatatctgggtaaatgtggttcttatttttttctgttactgtaatatattagattgctgcttctgtccttattttgcatatcttccttgctttaggccaaaccaatctttagattgtgtctgccaacagaattgggaagtacagttaaagaagcaaaggattacaggtcattgatctgttgcatgacaggcaaagatgcgatagaaagtaagtgatgttttagcttagtgtgttgtattcaaattagacacatgtatgtgtcttcttttcacttataaggctttggcactcatcagacagtcctatgctgggaaggggaattgtaactcctgctctcatttatctcatcatctcctagtcttgttgagaaatctactttgactttgcagatacattttcattgtatgacacagttaataattaggatttcaatttatcagaaagtaattgataaatgttgcagaacaggattacagctttcaggcacatccttctaaaggtgctcttggatactgtattgttacattttgaaactgacatctgttaatgtttctaggtaccttcgttttccatggtctttgtttttgatctcttctggtgctttccttaattattacagcaccaaattcatagtagtctctttttcaaaaaatgtttgctgactgagtatttgctcttatgtctctggaattttttaaagcacgtattgtgccattcattatctaattgatagaatgagagtatataggatggctaacttcatataggaggataacccatagttttcagagtcaagggcactcagctttgaatctcattctatcctgtactagctggaaaaaataaagtagcttcactgagcctagtcttttacacaagtaaagtaggtgtgctttctattacatgctacattctatgcagatgaagtgaaaaaaaaaaaaaccaacttactatcagtcagctcgctggcaggaaacataggacatattcaaatgggaaattgagggaagcaacaccttgtaaaagtatgggcaagtttaaaggggacctacaaggtaatatgaagtatcctggaccagcaacagtgggggatcctcgctatgcataggcctgaaggggagtgataggaatgaagtttctagaacccagaaatagtgttagggtgtaggagagtgccttctggaacggaggcctttggtagaagaatgaagctgaaccatagcctggtagggcatgagaacagggagtaaatacaataacttgacttgattcccactctcccattttctgctagggcttctgattggacaaactcagtcagaaaggaatccactaatgcaatttatagaaattagcctctagggaacagagaagggtggaactgagaggataataaacatatctagctatctatggatctatcatggacttagtgactgctacttagcatatagggtggccatataatttattgtccaaattgcaatacttttgagaacaaaaggagacaccactattaataactgcactaggacaacaggcataaagcagagctgagccaggcaaattaggcttactgttaccttactaagaccataataagcctaggtgaatatgaattgcctttccttttttaaccacttttctcagattctttcttttcttataatagtgtaatgtgagtattttgagaaagaagattggattattttaataaagcaatctagactcatacccctgtggcaggctttccaaagtcgtaattattactgagtcccttgctaacatctgccagaagagtgcaaaggatttaggttattcgttaaacttaaatcctgattatcttgtttagtagtctcccattgcttagaaacctcttttgagcactgaagacagtggaagcagcagaaagtctattaataaatgggatatacatgctttgcatgaagaaatttggtgagctatttatttttctctagccatggtctttctatttctatcttaaacccaagtacttcacatgtaggttgctttgtttttaaagatatctatgattagtatttttagtttgtgttaatattggtgattgaccaggaatggtttttaatgtcttatttcaagcaagaaataagaatactaatgaatacagggaattaatgatatcaacaaacatttcagcatagatacttgtaagttcaaagaccaaaaatattttatttaagtgaagaaatgtcagtaggattaaatggaataaagtgcatttggaacaaaggaaactctatggaaattgtagtttaccttgtatatatgtcttgactgtgattttttgacagcaaacttgagaaataaacaatcctggtgatgtctgcttatcagtgttccattttcatattgacgcatttactgcctcgtttgtgacatccctgccaacatcaataacctgctgcttccctttcctggcccactgactttttgaaagtgcttgctttgcccaactttgatgtatccatttgttcataggatcttgcactgctcctttgccattcattcagatttgaatgaagtctcctcaaggagtgacttactcctttcctctgaagacttccttttagttaacaattggtagattcacttgactgtgagtctaactgattggggtgacatatggctctctcagccctagtgtttttccaacccttttgaaagacagggtataatcctaactttccaatgagttctttttagaacttctttattttattttattttttttgagatggagttttactcttgttgcccaggctggagtgcaatggcgtgatctcagtcaccatgacctccatccacctcctgggttcaagcaattctcctccctcagccttctgagtagctgggattacaggcatgcaccagcacgtccagctaatttttgtattttttgtagagacagggtttcttcaggtttgtcaggctgctctcccattcccgacctcaggtgacccgctctcctcagcctcccaaagtgctgggatcataggcgtgagccattgtatcctgccctttctagaacttcttaatgtcacctctacaaaaacaaattaaggaatttacacaatttggtattggtaaacatgatttttttaaaaagcatatgaattataataaaatattttttgctaccaaatacaattttttaaattgaaaagtagaaatggaaaaattttaaccactgaaactgccgtataaaggtaaagcaaatatttgcaaataagctggttaactaatgtatctattcattcacaaaatactttttaagtcctgttatcaccagatgttccaggcataggggtacaatggtgagtaagataggcatgttctctaatctaatggagtttaaattttaaatagggaagacaagcaatgaacaactacaacacaagtaaacagtttataaaccatcagagactatcaagtgctatgtgaagaatgctgttatggagtcacagagttgctgccttctaggttagggaaagtcttttgaaggaggtgactgttaagctaatgtctgagtgacaaggggcactagtcaagcaatgatctggggagatacttttctagtctgtaggaatctccagcacaagggggctggggctagaaccagcttggcaggttctaggcaccagaagatggtcagggaggttggagtgagcagagaggagagtgctatgagatggcagggagggcttactagattctgttgggctttgtaaaccaggataaagagttcagattttattctttgttctctggaatataattgaagtgtgttatataaggaagtgaaatgatttgatgaacatatttagaagatcactcggacagctgagtgaagaattaaccacacacgtaagccagaaaggaggcttgaagattattgaaaagctattgcaccaccagtgatagatagtggtggctgacaataaggtagtggtgacagcactggagagaaataggcagaatggggtcaagttttgctttgttggatgtttgactttagaaagcagtctataggaatataatagttggtgactagaatcaaaggattgtttgtttctttttaacagaacaagacttcctaggtaagaactcagaagggacttatatgtgctctagctatactacttttttcctgtttagttttcttggcctattatctggaaaagtgctactcaacctttctcataaaatattatgggaaaagtctccatagttgcctctcaacctgtccatattgactgggtgctttgtgttagtctaactcccagtatcctttgtgtacacaattgtaattcatacatttttgtgctatttagaaaagggtgatggtaacttctaaagccgagttgaaagaagcatgatagaaagggatgctgtgtgtaagtaggttgttaggtagatgaaatgacccatgctgaatgaatgtgacaaggaagaaggggatttgaacgaatcacccttagacaaaacaccgcctgtaagtgattctaaggatgcattacagaagcccgttacaagtaagtgaagtcttcctacaagcccacagctgatatcttgattaaatatttagaaggagctcttaggaaaatagaaaaaagaggcaagtgaaggggcaaggaggaaaaatttagagtggaaatggaacttaagcagagtcaaagcaagaagaagggagagtctcattctccatttgcttcaaaaacaaaaaccaagaaacaacccccgccgccaaaacaaaaacaaaaacaaaaaaaacaaacctcagtctgtgaacaaagcccaggtcaatatttggtagtaagaacattgactttagagtcaggcaggcctgagtttgaatccacattccaagttacatgtgtgtccttctgtgcgtaagagagggatgcttatacacagcatcccttcctatcatgcttctttcaacacagaattgcctttgagtctcaattttttcatatagaaaatggagttgtaatgtctaaatcatagtgaccctagaaaacatttaatgagatggctgtatttgactctaactcctgtctgtttatctaagtgtctttggcaaaagacttaatcttttaaaactttgtttcctcatctctaaggcaggactaatatctatgtcacaagattgttgtctaatacattatcattaagtgttattatttttgaaggttcattgtttaaaatctcagaccagaaaaggcaatcaataaatattttttcctttgttattttcttttcttcaagtcttgtatattattactgttcatcttccattacagaaaatcactcccgtacacaatgtttataagttggttttcaagtttgcttaaataagtacatacttgctttgaactatttttctcctgggatctctgcataatttttttcctctcagtttggtgtaattactaatggcttctcttttcactctaaaagtgtcccagtttggacaacaaattatgtcatcaccccacttatggtttctattacttatgtaatcatccaatgtataatttaaaatatatatcttttaattttatgaagaaagagtcatgtcaggatgacatttgtaaaacagttttctgaaacaaagcagtatcttgtttactgaatatgcaatgaacgaatccactggcaagccctgattgattaggacactcatgatgatctgtcactcctggaacatgctggggcagaccagttacattcttgtggatcatttcctcaagctgcatgtcatgaaagtgctcatgatgttagaatgcaatccactctttcctaagtgcaggtgcgtggtggtctctgagattcagatgcccctatgtgcattggttgagttgtcccttgacacccatgtcagggatgcttgtaaaagcaacatgactgtctttagggaaaatgaatttttgaagtctcaacagaaagtatagctcagtgcttttgggggaaccacagggatgacattttttgggaatggtgatttcatttctcaacttggtcatatggtagagaaaaaaaaggctcttttaaaagtatagtctggacattgccctagtaccacatcagattggaaaactatgaaactttgaattcttaatatttcatttctccttaaacgggttataataacacatctatttttttcatatttgattcatcatttgattgatttttatatgttctagcaggaaaggagctaaaaaattcatagtattataattaacaaatgtcaagtacctttacaatttatctcattctactttctatgccaacctctttcctatcacaatataactagaaattcatataaaacagtccacatgaaatagcatctgctttcagctggctttctaacttctcagagttagatacatgaaaaaaagttgaagaaaatgagaagagagtaaaaaataactgttaaattaagtttaaaatgaatacttcagggcaggatttgggattctgtggataattcagtctacctaggaaagaaaatctctaaatacattattattttaaaaccaagtattagagggtttagacttttaaaagcattggatataattttggatgtctggcagaactaggatatcaacttttattaaaacagtccttttaggaaaaaacatgaaatattcattgctgatattattccaaattttcttctatattaaatctggaattagaatagggtacttttaatttttataatggtaggtacattgtgctgtaataatattagctccaatttaaggtcttggcggatgctaggtctttgaagtttactgtctcatgtaatcctccccaccttcttaagagttagggttatcttcatagcacaggtggcgaaactgaggttactaacttggtcaaagccacacaattagtgattgatggagccagttttcaatgctagaacttgctcttttaccatgttacagaatgtagtttgtttacaagagttattatgttttttttcctagatgtcatcataactttagtggaagtcacaatttactgcaatcataatgtttgctaaacacctctttatcccttacttatcagattgccatcattagccttaactacattgctatttatatgacctttaccttctacttttctatggttaagtagatatgaaccatttcagccttctttgttaaggaattttggatatttcttggttctggtcttccaacttaacttctaatatactaagtattttgtgccatagttaaacgtttactaccattgacaagaactgtcagcactcaaaacttttttataaagaaaaaatagcctacaaatgttaagattcagattgttgaattttaatcaataggaagctttgcttaccctctgcagtgaaattttctaactgagattaaacgtggttcctattctcagctgtgccccagtgaatgttcatggagtcattgtattgtttcttaatttcttctttttaaaaatattgatgtactccttaaaactgaaagaaaataacaccatgtgtccagggatttggaagcatagtctgaagtaacttctaatagcataaagtttcaagttttgtttcatattaaaaattcatgtgtgcactgtaacttgtatattcttatctctgatataaatatattgtctaaaatactttcacataaaactggtatttcaggaagacgtgctacattttcctctggtatgaactgttttggaaaactaacttacgttttctggtggcacacatagtctagtttgaaaatcatgaagctaaagaattttctccaggaaatcctattagaaaaaggagccactcatccatttattcattcaacagatattctttcctgaattcactctaatgactatggggacattgggcacaggctaatgactaatttcatcaaggttcttgctttcatgggtcttacattctgaggaggagtattactaaataactaagtaagccagaaaatgccatatgacaatattaggatgaaaataaagcaagatattgtgattggaataaacatggactttttcggatcccataggttgagaaagatctctctggggatataactttttaaacggacacctgaatgataggcaaaagtcagtcatacaaatatatgttgcagtaatttccaggcatatagttccagcatagagcaaaagtcttagggctgaaatgagtgtgactttgtcttttatcagaaagaaggcaagttgtatagagagagtagaataaaagtgaggcctgtagtcccagctactcgggaggctgaggcaggagaatggcgtgaacccgtgagacggagcttgcggtgagccgagatcttgccactgcactccagcctgggtgacagagcaagactccctctcaaaaaaaaaaaaaaaaagtgaggccgggcacagtagctcatgcctattatcccagcactttgggaggctgaggtggatggatcacttgaggccaggagtttgaggccaggaatttgacaccagtctggtcaacatggcaaaaccctgtctctactaaaaatacaaaaattagctgggtgtggtggtgggcgcctgtgatcccagctactaaggaggctaaggcaggagaatcacttgagccagggaggcagagtttgcagtgagctgagattgtgccactgcactccagtctgggtgacagggaaagattctgtttcaaaaaaaaaaaaaaaaaaaaaaagtgaatgatgaagtgaggggaccagattgtcaaataccttgtagactgtggtgccaagagtttgggctccattctcagtgtgaaagatgccagttgggggtttgaaatgggaaagtgacatgatctggcttatccttttaaaaggtcactgtggatgctgcatggataatggattataagggtaagaatagaagtagtgtgaccagttaggtgtcctatgaaatggtacaggtgagagatgatagtggctcagactgcaatagtagccatggctgctattagtggtatattttagaagtagacagaagactcactcattgtttagacagactgaagtgctggggtaaggagaagagtattgtcagagattttaacctgaacaacttggtgtgtctctttttttgtaattgagattttattggttgtgtgataattagtatatacatttcaatttgtacaccattgatgagatggggaggatcatgatttgaggagaatgaacaaagtatctgttatggaaaatgcttactcaatatttaggtgaagaagtcaggtaggatacagaagccagagaaagtctcaggcaaacatgttccagagagcgagaaaactgtaagtacagaggctagaataagcttgatgaattttaggaccggcaagagagccagtgtgtttggagagtggagcaagagagacacactggtagaacagagatcacagagatgactcctataggcaggatcatttatggcctgaaggtcatgcaagataatttggattgcattctaagtgtggcaggaaatcattggtggatttaacccaagtaaaatggcctgatcaacatttgtaaagtgatcactttggttgttatatgaagaaccaacggggaaaggacagtgcagagagcaagagtagaagagggagataaaaagcttactaggaggctttcggagtcagaaatactggacgtcttacaatgtatggctgagttctgtaccatgacaaacatttacaccaatattccatgtgttgtttgaatactcaactgaagattcatggaggtaataaacctattttcaattctataatatatataaatacaaaccatttttgcatagttttattgtacactaagtttttcaggaatacaattattgcacatattgaagaaaatgttgtacttgtttcgttcagaactataacaataactattcaccattttataaaatcaagtcattgatggtaatgccacccctggtatttaaattggtgtggccaatatctcataccagtatatatctgtgtttgtaattgctatcttattgattgctctatgtataggtataagcaactgatttcaacatgtcttgtagcatagtagtatctacgcatttacatattgaaagacatcttatggggtactatactgattttttgtagtgtatataggttacagtatctatgaattttatttcagagtgataaactattgctatatgaaggaggctattagagtgataagttgagaaccacagatctatataattatggataatctggaatcttaagtttatggttatgaccagtttaggctagatgaaattagaattggtagtctcttatatcaatgtaattttcccaggaacacatagctaatcagccacttgtgctagttttgaatttagcccagagtgtctctaaagcccatattcattaccattataccattatatcagggtaaaaatttattttcagaagtttattcattgtagtagagtatgctgcttaaattcttggtgcaaagaaaatgttttaaagctgtgtctctattagcaataaaataaatttgttgattcagccaatttagtgatacaaataattacatttggaggattagaacagatcaaatttttttggtccattatatgatgaacaaaatctgattgtggtttcttttcactcagatccagttgttgagatatcttacagaaaaggctaggttttctcatttttcattttaaacgtgaaaacaggttcctatttgtttctaattatcttctcttatcacaaacttgcctcatacttggttagataaatgcttcaggactatcacaatggaaaacatacatacttttattttaagattttaaaactactaattgtttattagaaaagatcttcagtttttatctctgattttccctttgcaaattcacatagtgaaatgttctttttggtgtcaatgttttatctcatcaagtaccaacaatattattattctgcagaagaatagctaagaaggaattaacttggcagtaattctcataaaaaagtaattttgaacagatatgacagttttgtgagccattgtccaactatcaccaaagcattttaatttgaacgttaaaagaatttgcaacagttaagaaagatagttgctagggaataatatatcaacacattgtgtactatatcaaagagttttttgatagggttttgatgatggggaaaatacaagttaaaataatctgtcttccgtttgggccactttgcattggaaattgatgtggttttaaaagattgatttttaacgtttcctttttattgtggggcaatccacaatatcatggaggatttcttaatcttcatgttgcaccttgctcttcatggtgatttgtgctgtctttgtcttatggatagaaagggaagatccacttactatgtggaagatatagaagaaattaattacactgcctgtggttattatcttcacagaatcaaattacttggtttaggaaatatttcatgtgttaaaaatccagtgtgaaccagagatactgcacctcaaccaaatgaatggtgaaacctgaagataaattttcttttcattactctgcctgtgaaaggcagcagagcacatgtttaaaagctctccagtgaggcacctgagagaaactgtcatcgtttctttaccaaattgaattgtaaactcttcctatttaggatcgtttatgagcagtttgaatgttatttaacaagcataatgttgtggagtagtgttacatattgcctaagaaggaggtttctattacttctatttatcttttgcatcagtgtttgacaggtaacagatgaaattccttttctaaaattaaatcaggcttcatttctgtctttcatccattaaatcaggcttcatttctgtctttcacccataaaggatgaaacatcatttgcttcttagacagttcctgtactctatcatctttcattacttttataagttctgtcataaatgctttacctctttggccttggcttctaacggcctattatagagataagtgtctgggtttgataatataaaaaccttagatgttgctttaccctcaattaaaaagtactttaaaagcagcattagagtacaatgtggtctttcacttttttattatatttgccttcttaaatagttttcgttctttatgaccatgaagagcagtgtttgcagagaatttggggtagctccctttactgaagtccatagctgtacacctgccttctggacatctttacctggttatcccacagcaccttaaatttagcctgatcactgttccttcccatgttttctctattacagaaattggcaaatgatggtctctgggctcaatctagtccactgcttgtttttgcatggccttgtaaagtgagaatatttttatatctttaaatggttgaaataaaataaaaagagtaatatttcatgatatgtgaaatttagatgaagttaaaatttctttgtctataaataatgcttttttggaacacagccacacttggaaagtttcaccactctctcaactcctaatcttaaaaccactgaatcaccttccaacctttccttttattcatattcatattctgttaatgtatataaggcatatctccaaggccaaacttctctttactgtaacctttatctcttgcctggacgattgcaatagttttccataactcctgcttctcttcaataaaatgtaattctataatggtatcagaattatcatctcatgagcattaataaattagatcatttttctcccatgttaaagatgtcattgggatccttctttccatagaacccagtccaaactccttagcactgtaacaaattctttcattcattggccctgattctttttctagtctcatctcctgtggctgcctgttccctcctcttgcacctcttgcatcttaaattcctacaagacagtacttcttattgttctcccccaatatgttgatttctttcaagattctctgccttcgtaatgcggctgtcttatctttattccccttttactactttttacatagcaaacttgatttaagtttttgagattcagcttaaatgtcacatttaagaatccttttcaagggctttcaggtaaaattaagtgttctcccactgaatttctgcacttgtgttttaatcatctatgtagaagttggagctcttccccattttgtatcctcagaacctagcatttgttacaaagatagtcagtaaatatttgttggctgaataagtgctcatttactttagaaagattcttcagtttaattcagcagaaccaaaattctaaaaataataacaatcaagtctattattctatatggtctggaatgaacctctgaatctttgtgggtgattatctaaaagtctctgataagcatctagaacagtcttccttatttaattctgtggtttcctaacttgcaaatttattgaataaaatgtaccaatttatctgttaactatttgcttcccaaataattattcatgatcccaattaaagaaaaaaaaaaaagccctccgtattctaacttttgttgtctgtgttatgttgatttagttttaatcaatgaattaattatttctataggcaatagttaaattttcaaattcagctttttctggtgctttttggtatctcaaagattagaatggcaagaagatcaggtcatgtagaaatagtacatggctctatcacctcaaacttttatgcaaattatcctagctggatcattacatattgcatacatgtattgaaacatcacactgtaccccataaatatgtacaatgattgtgtaaataataaaataaaacttaaaaaaattatgtgttatgtttcacttattcaaacccgatatttatttgaggaattagctaagcttctgatgtcctatcattccccatgctctgtccttggattcacattactgcttgttagcatatccatgggaggctagtcatgggccttactgaactattatatatgtgccttacatagactggttggatgggaaagaatataaaaccatctaaataaagattttaagattatctatgagtttcattcttctattattttcctggctccatttagtgtggacaataatggtgagacaaacttataattatatagttctttatacttatttaaagtgctttcacctacattatgcctcctgctaggaaggcataggtggtactgttacagagatttttcaagtgaaatggatgctcaggaaaatgaaattactttctaaaactcttacagttagagatgtgataagagtaaaacttagttcctgactccatgaaacttttctgattttttcttcatataaaatatgtgctcattatccaactattgcctctgggctctaaaactacccttccatactctgatctgtggtacagggataggatttgcagggtcctgctctccttcattagatggcctcctgttagtttctgccaatagagggcacatgaggaggctagacattgctggaggaagagagggattttacctctccctttttgctgctgtttctgtcagcatatccctagtaattgaagttgaatggaaacttatcttggccttccccaaatcagcctcatcatacttccttagagctaccagcatccacaaagcagtgcctcttctcagaggttcaagtcccagcccctcctgtgaacttctagattctgatcgctaccacacctctcatatttctcaatacttagtcatggtagctgctttctgcaattattacgtctgtgctactttagtgttccattcatgctttctcagtcccctaatttaatacctgtgaaatcacttccctaagttatatgcacgctattgaaatacctggtttggtttttgttttcctgaaaaaatcctgcataatggtatgcttgttatcaggagtagtcacagaaaatatactctgggattaggtgatattctggggttggtttggttatgtatttgtctttgtcttggaagcagtactgatttttttttgcttatagtatgcagtggcgctcaattaaattattatctatggttgattgaaatgaagtgtctgctgaagcaagttgttggagggattaaatgggtgggatagctttttatgacttcactgaggagctttcgaaaaagaaaagggcaaactcctttctttaaacccttgtttcaaatcactgttagataatcagagagctttcatagcatccctgaaagattttattccttattattgcgggccaacccactagaaagagacataaaattacaccaccctccctttgttcaattatttcacctggggaacttgcagtacaaagggatgtttttgtttccaaaccccttcctattacttccagacccagaactagaatcagatatcagaatactccagaggaagaatgaagtctgacccaggataagataacttatattctagaatgaatgaaaaattttgctaatttatatcaaaagtttcaagggttttagactaaggaggagatatgtaatgatatatatatagcataaggttaaacttactgctatggttaaattggcagaaatttgtgatttcatgttttagtttgtttagtattttagttccagctctctgctgaaagtggttgtaaaaatttatctggttagtaactgaaactttgactcagtggtagcctaaattcaatgaggttgaaatcctagaacttctgtggcatactatgaaggaaggaataaaagagcatatggaggtaggtaggtattttggagtagatttattccatgtgtcttgcacaatcgattctctccatgccatcaccaccacacgagacactgtattctcagagagatcccaaaggacattcttttaacttaagcattgagaaatacattgacaaatagaatgccccagaagtcactctcttctataagccagagatgatggtgggagatgctgccaatgagatagcttcctgaattcactggggtttctggaattctacaggggcaaggtaattccaagtggtaatgcctagcctttagaattaaggggagaccattagtagaaggcaggagtagccaattagcatggagcatttttattatctgcatggattttttggttatagataattatggtattcataaaagcaaatatataaacacttttctaaaatatcacttaatctgtaaaaaaaaaaagataaaattgtaggtctggtggccaggaacttgacttgcatcaccacagtgaagggtcctggcctctcactgagttcgtaggttaagtcagctttcagaactggaggcaaaatcctcctaaaggtgaatcctaaagtactttcacaagtatatataaaatcttccttcaagttctgcccaaaaggacctgcaaccactaactagggtgactatgcacttgggagagagaaatgcccaaaatatatagggattagtaaatgttgtgtctaaatttatactaattcatggacccaaaatgctactgcagtccactagtcaaagtggagattgtgcttgtcctgacacagagccaggactagggtaaagcaagccaggcatgtagggcatacaaaattgtagactgcactcacaggtttatgcaagtgctgagtcttcctgaagtctcaatcctgaattaacaaatggagttttgcacacagtttatccccttagtgggtccatggacccatattgaaattacttctctggcatctgtgtgaataattgcaacacactcaaacggcaactgtcaggttccatacatttatccctgattcatgaagtgaaagtttttctggcaggatgggacatgggtaaacttctggaacttttcatccctgccaggacggtgaacctaaagtagtactgcaaccctagagaaactgcagattagtgccaccaccaaaagcttgaaatatgcaggggtggtggtttccattatgtcctcattttatttccttggtcgtattttgaagaagatatatgtatcttaaagaattactgtggattatcttaaatgtaatcaggcattgattccagttgcagctgtggtcccatatgcggtttctttattgaagcaaatcaacgtagccctttggacgtggtgcacagtaattgatctgggcaatagttttgtctctatgactattgcaaagatcaccagcagcagtgtgcttttacctagcaagatcatcagtgtatctttaaagtcttacctcagggctatgtcaacatttctctctgccataattcagtcctcaaagattatggtggcacaaatcttggttagcttatttggctttgggggacaacataaaccacatttctttgttgctccactgtgtctactgagtaactgaaaaggcatctcatagaaggaaaagcctctgcagctagtaacactgcagtgcaaactactcttctacataggcctagtgtcccagtagacataataatatttgatgtatctggaaatggagatacttgtggaacttcttaaaaacccttataggagaattagggttatagtctctatggtttggagaaaagctatgtcaacttctgcagttaactaacctcttttcaaaaaatggttcctgcaaagctatcaggccttggtagcattggaatacccgaacatggatcatcaagtaaccgtgcaattttagctgccatcataaactatttgattgggcatgtgtgcaacaatttatcatgtgtggaagaatatgttagagaccaggcttaagcagattcagaaggcacaagcaggtgtctcaaacttttactacatataatccttctgcattacctctcctccctcaatgcataactaagccctcatgggggaatttcttaggaatagttgagtgccaagagaaaaactcgattgaggtacttgagtgatccgtttgaaatggtcagagtgtgaagatgttgcattctatgtaaatgttcaacaaaggcactgccagagaacaggctcagaacaaccatgtggaatagaagacccatcctctggttgtcagttggcctctctcctcagccattctcattccgactcaatgggttcatggtcatggtggccatggaagcaaaactagacactattcctgggctcaacaacacgaatattcccttaccaagactggtccaattgctgccagtcctgagtgactaatctgacagttgtagaggctaaggctgtgtcctctgtgggtaccccattgaagagggaggaggagtccctcttaggagcagattgactgtattagacagatttgttttcattgtctaaaaaatgtttttgagatgcagaatggtgagagtgagaagggggtgagtgatgagaaattaatgggtacaatatatatttttcacacgatgaatacacgaaaattgcagacttcaccagtacacaatatatccatgtaacaaaattgcacatgtgctccataaatttatagaaattaaaaaacaaaaatattttaatatgttttaatgattattgactatattagtttgacttttactatttaagctagaaacctgtatccttgacttccatctttaatttgctctctagcacttcacactcactccacccaatatttcttataattacaaggaatttatttggcatttgtaaacacattatgctttttaagcttctagcaggcccagcttttctattctacctggccaaaataatattcagtattcaagacccatcttaaatatcacatcctttaattcctgacaacatttcctatgtatttacagcataatatttctcaggctattattaagacatgttataagtgcatgtttaccccatctaaatagtatgttccacaaggagttgccaatgctattattgcatcctgtccttctgcttccaactcaatgactattatattgttggttctcagtatgtattaatgagtgaatggaatatggtgctttccactttgtttctgcttttaccattacattgaatggcaatgagtatatatatatatactcatcatctcatacagatccatcaggatctgtaggtcagtttgaataatgatagtaaagcagtaagacatatgagagatgagcattggtctaatattcaaaggcctaactctaggatttgctagctgtgtgaccttgagaaagtcacttaacctccctgagctttgatttcttctcttctaaaactaggcctcttttaactttgtaattctactgcttaattactcacttcaaaaaaagaaataaattgtattattggaacaattaacttttagaatttccctttcttattctttattttcatatagtttaattacttaaataatgcagataaaagcttttttttcttttgaaaatgatcaatgcttaaaactttgctaggatacaaaacataaatctttaaataatttaatatgcactcatatatatgaatatgcaaattttaaatggaattaatttgaagctgaaaatatttataacatgctgttacaaaggattcatcctacatttggaatcactatagtgacaaagagccaaatcatggtctataaagaattcttaattcttttcttcactcagaaaaatgatcaaacatgaggaacctgatgtctgttagttaattcattcaactgacatgaaggaagatatgtttttccccctttgcttatctaggtgttctaaattttgtcattcggtcaaaatagattaagagatatgtgtacctagaatgcatgtttttcttttcttttttatttttttaaatttttttggttttgagatggagttttgctcttgttgctcaggctacagtacaatggcacgatctcagctcactgcaacctcatcctcctgggttcaagtgattctcttgccttagcctcccgtgtagctgggattacaggcacctgccaccatgcctggctaattttttgtatttttagtagagatggggtttcatcatgttggtcaggctggtctgtaactcctgatctcaggtgatttgcctgcctcggcctcccaaaatgctgggattacaggtgtgagccaccatgcctgcctagaatatgtgtttctctatatccaccccatacaattttttttttacagaattgcatttactgaattggtggtatgctattatcatactatgaagaatgctataaggaaattatgaaattcacttttgatggattgttagcaagaacatccttgatattctctatatcttgctactcaacatgtgttccatgacgagcaatgccgacaatacccaagagcttattaaaaattcagagccacaggccctacctgtagatgaactgagtcagaatctgcattttaaccagaggctgaggtgatccatatgcacactgaagtgagagaagcactggacaccatgaccaaatagtgtcctttttatgagattcctcataaaattggcttatgataaagtttatttatcttaaaatagtaattatatgatatgacagtatacataattaagaaaaaaactgtgcttctccaaataagagtatttgttattgttttcaatcttttgaacactgttgattgttggttgatctcatttccctatctgctttggcagtgtgtgctaccacttttgagtactgtatggtagtcctctttgaaagtacttttcttacccttttatttgttgatttgtatgtcattcacatgctccctttgccttgataccttcagtttttaaaattgttaaatggtgtattaggtgctttgaattcttggtgggatgagtataaagaaataaaaccaaaataaagagcctaaatatttccaggatttgttatataacttgagcattgcaaacctactctttcctctttgccacctacctctctgtaacatcataattaatgttcattatgaagatttttgaggcactctgggggttacagttatcagagaagtattaattatactcagcacactatactgtacttactgagccagaaacatggactaatatgttttataaagaatttaaacaagggtggaaaacccaaaagatttctgactaaatcagaacattcacttcaattaaaacattccattttatgagaacactggtgaatatgagtctgttaagtctttatagataaattatttttctagtccttttttaaaaccaaagtacaatgattttctaagaatctagaaattatttacatcaaatttgtactgttaaaacaagtttcaggtaaattctgagctaatgttaggctatatatctttaccagcaggcagccaagtagttgaacttactgcctcaggaatccattgaaccaatagtggctgaataattttatgaccagtaataaggctcacaagttatacatgctaagagaggggtaatcaaatcttatgcttcagggcataaattaatcactgcaggggtcagaaaagaatctcctttgccctatgaacagaattgaataattaggcagtatctgtattgatactgttttaaagccttgttcttaagcatcagaattggttttaagaacaattttgtgacttcgtgggggtgtttgagctcttgattagaagaggaggggtcctgcaagttgagcagtttattctggcagacagaaaggttgggcagcttcctgattccacactgttcaacctgattttcattaaaagctcaaagtccctgctgttaaaatgtctccaggcagctggggcaaatgggcctccttgcctatctggaaatcttgtggtgggttttcatcttttaatcaattcttccatgagggaggagggatagtttactaatgtgcgaggtttgttctctgtcttctgcaactcatattttacattttaaagaagcatttttctggattgaggaattaagccttgagtactttttcaggaaaacaagatcaaggggaaacatgataatcaaatgacattgaaggccaaaatcaactgccaaactcataaatcttttcaggtttttctacatggttgttgaacaaagcatgtcaactgttacgttttttgttttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccgtgttagccaggatggtctcgatctcctgacctcatgatccacccgcctcggcctcccaaagtgctgggactacaggcgtgagccaccgcgcccggccgttacggttttatgataacacaaggatactgtattccatggaaagtagattttatttcctacatctttctgctatagctctatcctcagcagttttaaatttagatatggcaacataactttcaagttatctccctggagtattcctactaaaaggaaaactaaagggtgaaccatttccaagtaatgactgcctacgagtggcctagattctcaatacacctggagaagaaaacaaagactttacggacatacttattttttgaccccattggccttctagatgtttgtatatttggttctctttgttcttactttgttttctttttgaagtcagtaacatattgttaggctagtccagcatgggttagacatatttatttttgatgtaaaatagtatatttttttcatgaaaggatttactatatcctttctagaggcctaacactgaggcaggcatgtaagttaaaataaaggcagcaagttttctctttggaagctcataatctggtttggaaacataggccatagccggaaaacacagttaagtcatgttacaagcagtcaggttaagtgtcagaataatggtgtcaacatgggctggcacaatttatggaaggagtgaggctgctctgggtactgaagagtatgcatgctttttttggggtatgggaagaaagctatcacttgggagcatgagtgtgtgcatgtaggggtgtgtatgcatacatatgtatgtgaggggatggagatgctgcagaatgaacaaggacttgaattcaagaaggaactgaaggtaaacagggtcatgtaaatggaaggaagcctgacctctgaggaactgaatgccagggtaagcgatattctaaagagattataaagccattgttgaaagcaaattttgggaaggatatggttacaatagggaagctgggatagaacaggaaagggccagggtcaggaattctgactagaatgccatccagttgtgaggcaattatgttcacattatctgccattcacttgggtttcacaactagaaattcttcttgatcagcttggctttttatttcctctgaaagctcaaggttgttctttgccaaaagagagtcgagaagtggagcttgatttcactgacatgtgctaatgtgactacagcactggtatagactcttaggagctagattcaagcatctttatgtttagatcaaaaacgaacacaagtatgtgcccctaaatcagtgttgaactcggtatgtttaatttcaggatcagttttctttatgttatttttttccaaccaggtatccaatattttttacaaggccattctcttgaattaaatatacattagatatctcatctagataataaatctttgtgtcagcacctatcctgatctcaccagatttcattttgcagcatttccctgatgcttagcaaagtaaatcaactgctttgacaaatgagtagcttaaactccttcaaaaagtcagtcaatagtgcccaccgaatgaaaattcttccctctgtgtcttgggaatacaaaaagaactggatgactagtctccactcctcataagatttcaatcgaatgagaaaaagaaaaagcacagactaagcattaaatgaaaacataaaaaatcctagaataataacatctctgcatcaaataattactgtgtaccaaaaactttacaagcattatctcattgacttcttatgtcagccccatgggttgtgttatcagcatgaataattttgcagatgaggaatatgaaactcagagaggttagcctccttgctcatggtcacacatctagtaaattgcagagtcagaattcgaactcttatttatctctttcctcttgctgcttttaggatcctttctttactcctgacctttgacagtttggttataaaatgcattgaggtagtcttctttgggttaaatctgcttggtattcggtaactttcttgtacttgaatattgatatctttctctaggtttggaaagtttattattccttagaataagctttttacccccctctctctctacctcctctttaaagccataactcttatatttgccattttgtggctattttctagataggctttctattttctacaagaagctttcttgtaggcatgcttcattcttttttattcttttttcttttgtctcctctgactgtatattttcaaatagcctatcttcaagctcaccaatcctttattctgtttgatcaattctgctattaagagactctgatgtgttctttagtatatcagttgcactttcaactccagaatttctgctcgattcttcttatttatttctatttctttgctaaatttatctgataggattccgaattccttctctgtgttatcttgaatttctctgcatttcctccaaaaaaactcttttgaattctctttgtgaaaggtcacatatctctgtctttctggattgctccctggtgccttagtttgtttggtgacatcatgttttcctggatggtcttgatgcttgcagatttttttttttttgctacctgggcattgaagactgaaatatatattgtagtctttgcaaccttggcttgtttttacccgtccttcttgggaagcctttccaggtattcaaagagacttgtgtgctgtgatctaagtttttggtcactgcagccatatctgcattagggagtaccccaagtgcaataacactgtagttcttgcagatttacagagttatcaccttggtggtcttggataagatccagaagaattctctggattaccaggcagagattcgtgttctcttcccgtaatttctcccaagctaatggagtctctctttctgttctgagctgcctggagcttgggaaggggtgaacacaagcactcctttggccaccaccactggaactgcacagggtcaaacctgaagccagcacagcactgagtcttgctcaaggccccggcaaccactgtttggctactgccttgaatactaaaagacctagggctctacaatttacaattagcaagtgtcaaagccaaacaaggccctgggtgggttcagaaatgcagtctaggatccagggtctagagtgtgaaatcttttaaacctacctggtgccctaaactactgcagctgagctggtactgaaaccactacacaaagtctttcccactcttcccttccctttctcctgggagaggagcctcttcctgtgtccatcaccaccataggcccatggagagtattgccaggctaccactggtattcacttaaggcccaagggctctttactcggcttgtggtggatgctgacagacctgggactgactcacccttcagggaagtatgcttccctctggcccaggataggtccagagatgccattcaagagccaaggcctggaactgggtacccaggaccctgcttagtgctcttccccactgtggctgagttggtgtctaagcttaagacaaagtcccctttacttttccctctacttttctcaagcagaaggggtgtttccatagccaccacagatgttaatgtgctgggtcacacatgaagccagcatatatctgtgtctcgcccaatgcccacagtatgtactacctggttactgctgctggttattcagggcccaagggccctttattcagcagaggatgaattttgccaggactgggtctttcccttcaaggcagcaggttcctttctggcctaggttgtatctagaaatgtcatcgggtagcaagggcctggaattggggcctcacaactctgcctggtgccaaatcacactgtggctgagctggtatccaagttgcatgacaaagtcctctttactcttccctcccctctcctaaagtaggaaagagggatctcttttggaacttggagctgccctgcctggggttgggggatgggtggcacaagcactcccttagcttccctggttggtgtctcattaggtcacatgcccctaagttcattggctctgagcccagcacagcactaggacttgcctaggagttgcagtccttgtggtttagacagcctttcaagtttatttaggatcccagagcactttagtctgtggtggtgaggcttgctgaaactcaagttctgattgctgcaataggcaattcccctctggctatggctggtccaaatgccccctctgtgggtgctggccaagttctgtctagctttggcagcactgtgttccaatgcaaagttccacaatcactacactctccctcccgcaggtgcccaggttctctctccataccacatggcgaactgctgtgaggggatggggtaagggtggcatcaaaatttgagattgtctttcttattctcttcagtgcctctttcagtgatatgaagttgaaaccagatactggtttttggttcttctgaaggtgcttttattgtgtagatagttgttaaatttggtgttcctgcagggaggacaattgggtgtcaggaggaggcttctattcggccatcttgctctacttccccagaatctgaactcttggctcttgaatttttcagccagatctcctttcaggttgctataatcagttataaaaaggcaaaaatgccaaagttattgtttcttaattaaaaataaaatgatttgggaaggttacacagagtctgacttaggagccactagggttgtggagaaaacacacgggttagataagagtcttcaagagaaaattccaggtgagggaaatggcaggcttgtaattacaatgcaaaagactacgggtgtgggacagcaaacaggaccagtgagttgacgtgagagatgaagggagaggtgtccccaaattaagagcattataagaagttgaaatcctgacttgaaatcttagtgctggacacataaaacattatatgtgtgtgtttgtgtgtgtatatttacatatacatatatatataaatgtattagcagttgtcaatgcatatatatgaatatacatatatgtgtacatatatgtatatttacaatggtgggttgtaggtgctgagcactaatgtgagtttcacatggcaaaaacaaaagagggacagcagataaggtgaaaaagccagcatctttgggtattaagaaacccagaaccacaggacttaaattatccttaaaactccttatggcagtaaaggaatgtgagcgtcagaataaatttcatacctaaaaatttcacatcttactcttttttatattacactcctcaaaacttcagaaagtcctcccatatcatctcccctttaaggtggccctgactatagctttaatctgcaattctttgtataaaaagttctaggaaatggagtttagccaatataattttcccaaaccttggaccatgggattaggattaatcgaggagaaaaacggcaccaatattgtttgcatgagattataaaatgtcagtgtgacaaaattttttgtttagaaaatttataactaaatttattaagtacagatttttatccaatttattgtatcagacagcaataattcaaaagaattccacctctgcattaccaaagggcaaatataaaagataagaaaaatttaaacttgtgaaaaatatgtttctgtacttttcattgcctttcaaccattttgaattctttggattttggtgttaaaagggtattactgggatatgtctgtgtttctaggctgatgaacaatgaagagtacatgatttaaaaaaacctgcagggaatatttaactagtatgtaccagcaataaaatatttaaaaacttatgtactagttggtaaacagtcattgccctgagccattggagtgtcttcccctacaatcctttcctcccactgctgcatggggcactctagtctctggcccttcccccaggattatttcttcacctccctaatgcacagtatctaaagggttgattagtacagcagtgaggctccaagacactgctctggtgccccagtacccaccttcatgttgtatagttgttaaccattttgaattgcaccccaagaaataacatgcaagttactgggtgaatgtgattggaaatgtaaccatgtcttctcttactcaagtacttctgtttgtacctctttctttccctacttttcttcccttagtaggtttgctaagaaacatacacatataactttggagatgatgcatcctttctcttgagttaagtgtgtctctagctgtattcatgtcctatattcttgttctgattttaagaaaaaaaatgttgaaaataataagagtggtattttggtcactgtatttgcctatgggctcaaaacaagaaggatttattatgtatgtttccccaaagcagaacagttctgagattgatgaaaaaactccaacaaattgactgactgatctttagtgagtcaacctctgcaaaatgttcctaggattcggctgaaagagataatgtgtggattaaaaaaaaccccttagatgtatctaagattcctgaagctccatcactgaattaatcataactttgaaacattagttaaagactaccctctaagtcccttttctgacttttgatttttcactgagaagtccagaataaaggtgccttcactttctgggccacaaggcactggaatgaaatcttttgtaataccaatgagacttgtgctcccatctaagagatgctagctccctcctgctacatatgtggtaagcttatttttctaccacctgtgaatatagtttaataatgacaaacttcttgatctttacatcattcatgtctattttaaagtgcatttgagaataaaggattctaggttttcctaataaatattaaactttaaaataaaaactggatcatgtgggtgtattcttctctctgtgtgtatatatatatatatatacacaacatgtagatatgcatgtgtatacatatacacatagacacagagcccctatatacatttattttggcttgatgactcaggatgtaaaatgttgtttctcttaatgtttaataatacattaatgtatttctggtacaatacttctttagttgcttataatattccttatgatgtggaactgttctttacatttctacttgaaatgcatttgctctctctcaacatagagtatttatgcagttttacttacagtgacaaagagatatttctttgaacatattatatgtaaagcaggcttgaactcagcttttgattaaaacatagttatgtggccttctagctcagctgtaattgcatttaaaattcctttctgcactctactgaagaccgcaaaccaatattaataaagtaggcttagagcagtgtagcacctgagcaattggttcttgacaaacgttatttacctagctagagtttcatttcagagctaacatgtctctgtgctacttgaataaagcactcatctgaaaactctgttagacattttaacccaatttaatttattccctgaaagtttaatcccctgttgaaaagagtagttgcaaattttctggagttacaattcactgaagtgaaaaatagttaatgacatcaagagtttagttaaaaatctttctcaaaatgtaaaacagggggcaagagttaataggatattttatatagttatatttcaatccttttccgaatcttcctaaagtcacttgcttctctaccattaaagaggtatgaaatgagttacttagacatctccaggaagtagggggaaaaaccacttatatttgaaaccagaaaagcaaatctcttctgagctttgtcatttaagtggcacattcagtccttttatattttataacaccctttttgtatcacatccaccaaacgaagcaaatattaggtgccggccatctacagctttctacctaactgtatgaggaagcagggtacagtctgcaacacagaatgctttggcactcatatgccatcaacccagacttgattttatgcagtaaattgtccaacagaagtctatttatctgttattgaaatatttttggtttcactgccaaagaggataaaaatatgggtggagagaaaataaaatctgaattgactttgtttttggcatagtagaaagcattttggtcccctttatagtctcttaaaaatttaattattcatttggcagatatacctctatagcacaactggatagttgttttaaaatatgcaaagcgcagatttcagacttaataggagataatgactgctttatagcctgtcaggtcatggcctacttggcctagttacagagatattgcttcatggttcagtgctccaagagctgatgatggctccaggccagcaaaggtgtcattgacataatagaaagtaaaggtttctctggaactctaatgggatgctccataaagcatagatcaaaaatattatggcttggatagtacaaccctagtggggacattgggtggtatttttcctccatatgtcattaagaaaacaaccaaaaatttatgtgcaaagtcataatttcacattctaaaagtaggattattaatgaaaattatattatatttggtggataaccatttgaaaaagataacagtgttctggttgcctaaatgacttggaaagtcaccatttaggcagttcccataaaaaaggcatctgccttaagagctgtcagcctgcagcctggctccagaatctaggctcttaccactatgccatactacttaaaatgtgcaatgttttccgacgtgaatttaaattatggaaatgaaatacttttatacaaaactaacgacatagatcaatataattgtattgattattaatgagtaaaaataaaataaaaaatacaatattattaaccactgagaagaacagcttatgtacattctaattctcaaaataacactgggacagggggattctatctctaaattagaataagaaaatttagattcaagagattatggcttcataatcaattgtcatttggctatgaagtccttgctgaatatccttgagtgtctgtataagcacctggtgtattatgaacagtatgatctgcttgtcagctccttttggagaatgatgattgaggttacactttaacttgaagttcaaggattggggaatgcctctacttggttaagtgtccattcttggttcatatctgttcaatgaactgaatcaccaaaatgtacactcttaaatagcaataggtagtacaaccacctttcatttggtaataccagtaatagtaatcttgtggttttgggtcagaacagcaggataagaattcgaatgctgtttcttgtatgtgtgattctaaggccatctcttggggcagtgggtcttgcatttctctactctatcattaggttactggtatctacatcacaggcagatctgtggggatcaacccactcacataatgtattaacatatgatggaaatgataaacactatgcaaatatttgtttaaaaatctttatgattaaaataaaataatgtcagcctcagactgaaagataagtttagtaaatccagcaaatggattttaaaaaacattagcttcgcttaaacaaaatgtgaaatgaaacagaccacaaaatgacaagatttaatgagcttattatcagtaaaacaattgaatataatgcaaattaattacctgtaaaattatattaaacaggctaaatgacttactaggcgatgattttgcatagtacaataatattttactctctgcaactactaaaaacattgcttcctatatgctcaaaccaaggaattccgtttctctaatatcaatttgtcaatctaaagttctagaactttcctataaaatgatttgcagtgcacatcagtacaacccaaactgagggacattttaccgattaatagcctatgctgttcaaaaatgtaaagaaccagaaatagaagggaaataagctgtagagtcatgacaactgaatgcaatgcaattgcatgtattggatatagattctggactagaaaaattggtaggcataatggggtaacagatgccattagaataatggcaataggttaaattatggtaatatatcaaggttaaatttcctgattttgatagttctactgtggttacataagataatataattttcttagggtctactccaggacctgcttaagggtaaatgggcatggtgtctcaaagttactctcaaaatggctcagaaaatttatacacacatacatacatatatgcataaatatgagagagagtaagacagcaataaagttaatgtgatcaaatgaaactaattggtgaatctcggtaaatggcatatggaagtttcttgtaactttttgtaaattggaaattataccaaaataaaaaaataaaaatctaaatacgtttttgtgcagatttaaattaagatggatagtctttgcagtctatttaagaaccaagattacttaaagaaagacagtttcacttaaaaatgcatttcttgtggctcacgcctgtaatcccagcactttgggaggccgaggtgggtggatcacgaggtcaggagatcgagaccatcctggctaacacggtgaaaccctgtctccacttaaaaaaatacaaaaaattagctgggcgtggtggcgggcacctgtagtcccagctactcgggaggctgaggcaggagatggctgtgagcccaggaggcggagcttgcagtgagctgagattgtgccacgcactccagcctgggcaacatagcgagactctgtctcaaaaaaggcatttcttgattgtttaaacgatcatccagttcgaaaaaaccataaatctcataccttcctttaacattatgtgagactatgaaataaacattttaattaaaaggaaattaatgatacacttagaatatgctatttaatttcaccacccccatggcaaattccatgatccttcgtaaatattacagatcaagttaccttgggtttactttagtacttcctgttgagagttactgactttcaaggcttgtagcaggagagaacctccaaaataccaggacctttattcattagagggtgaaaagtaccaatgatgtgggttatatggaatgagttgacttagagatggatttgaagtatgcgaaaaaaaaagacttccatggaataattttttaaaaattttaatattatagttatttaacaaaagcttgctgatggatttatttatttttgcctgggatagaatagaaaatctgacattttacttttactttccccttttaaaagcaagacttctgaaaataggaatgaatgagattttgggaaacacatataaaacattttcccttcagagcctgaagaataattgcctctgtgttatcatttgcttgactgaaattctgttacaatggttctctcatttcaattctctccttcctcacagtcctcactgttcagataaaagcctgggaagatctgtgcacaagtttgtgtccaaagtcaacccaagagaccccgaggtgtaattgcaatagactaggttaatgcctcttttttaggggtttgcaaatggtgccaattttctagtatctcttcctttcacaaaattaaaacttgccagcaaagttaagcaagttccttgttttgaagtgatttggtgatttccagagctttgaagctttaaaagctctgaagaagacgttaaataccagctctcaataaaggaaaaccttggaatgcaagaggagtgggctggatggtaacgaaccttcatcacaattttggctctgctcctaaccatcttgatagccttttgtgagtcactttagctctatgaggctcagctttctaagttataaaatatgttcaatggccccttccagcctcagatgtttagtgattgtaactctcaacagtcatggattttcatgacacaaccacagagcaaaaatgtcacagtcaaactgtgtttatttacactttatcaactgtagagtcaagccaaaaatgccttcaatactcacattttaatatcgttttaatttgtgctgttaatgaacacttttacagctctattttaaaccgttgcaaacatacccataaaattgtgtttgcttcgcattttaaaaaccccactgcatttcccaagcaaataggcatttatgcaaacaaatagcctaacacgtgtctaactgcctgtttcaaagcaattattatttgtcaatacaaatgtccacttgagtagtgcaaagaaaatgctcccagaaagtttggcaggctctgttctctgcttcaattctatcagtattcttttcattaccacattaggatcaaatttctagaaattcaaggaagaaaatgtagaatatgatgctaactttcttgccactaagagaccatactcactattttattaagttttgctaatgtttgtcaagccccccaaaatatagttttatgctcatctaggtattttgctcttattcagttttgtcttaagtaaaaatacatttatttggggatttttggtataacatttttggttataatggcctgtagcagtcacttgtattttccaagaagaatgccaccttttcttcttgtgccactgtgcatgattacagaattacacaaaacctccacaaaggattacaatacaaacacctttatatctgccagatatataatatttaggaaggatttgtatagggtgctatgagtggatcaatgattgctgtagaaatgaagtttatggggagctagataatgcggagttagcttagctaatgggaatgtgtagataggattccaggaaggggaagcagcttatacacaggttctaaagttggaataaagagagcacatgaaaaagtctgatgtgcaaaaatcctgagactaaagggaaaagtagccaacatgaagctagagacatagacacatgttgcattgacttagactactttccaataagtaagcaagtagataagttaataaataatcaaataaataaataggtaagtgtatctgagctttgaacatcctttctctcaggaatagggcccacaataacttctttagtggatgacggcttttagtagtagttccttcaacaacagctgctccttccaggtcactaaagctcacagaataggtggttcccacagagtgcctcagccagcagttaccacaaaagttcctgtccatcttttttcaaagagacctgggacccttagtgacacaatcctgtctttcagcaccatgaatagaggcagctgtcatatgtcctagctgtgccctctagcggcagctggaatgttacccggctctttgaaaagggtaattaaaatacctctcagtatttgaagtcagtgagtttagggacatactaggagaggaaagtcttccccaacgacctgttctctcagtttgcctatgatgccttctatccacagtgctcaaggtaaaacaaactgctaataatgagtaagccattttaagctacattaaaagagggttgagggaatttctgaaaatatatacaaattttcatccaacctctctattgtgacttatcttacagcatctctagtcattttgaggttatgtctgcctcattctctctatgacctatttcatcttatgatgtttgtatgaatacccttctttgatttaatggaactgtttacttaagacttggctctttttgttaccaaggatattttttcttttaactccaggagcaccactcagttttgtgtctgattaacttttcttaacagaatctaaatccagaggccatctttttgcttatttatgagatctctctggctaaacatcttttttcattagcacatgtctcttcagtatgagatttcacacaccatgctttaagaacctgggaattgaggaaaatggtgatgcaagaccaaagcaaaatctagcccaggcttgtggacagcagcagcatctgattccaaatctggcagtaactggttaagagatctgcagagggcagagtatagtaacccagtgctaggaatcttgcaagggagaaacagaaggtcaaggaatggatgttaccttcttagggaagagctttttaaaagaattctcaagggaatagttttcttatagaaatagtggtgtttgatattctcagtgcatgagttgtatcttccctgagctatgccgaagaacccattgtaggacaggcgctgtgactcacgcctgtaatctcagcactttgagatgccaaggcaggcagatcacttgaggccaggagttcgagaccaacctgggcaacatggcgaaaccctgtcttgactaaaaatacaaaaattaactgggcatggtggtgggcgcctgtagtcccagctacgcagtaggctgaggcatgaggatggctagaacctgggaggcagaggttgcagtgagctgagatccagccactgcactccaacctgggcaacagagtgagattctgtctcaaaaaaaaaaaaaaaaaatccatcgtagggcctggtactctaagttggatgtgtttttaccacttcttgctctggccaaggcatgattcaccaaaaatatttatttacttaatgtaaaaaattcttgaaggaattcaaactccagcatcatccacctttgttgaaagggtgagaggtctattctatctactagactttattttttcttagacaatgccacactagaacattggatttgctctgcttcagagagttggagattcccaggacttttataggagtgtggagaggctctatttccaggatctttacctatttttttttatttctgggttgaccgacattgtccactcagcacctggaaagttctgagcactgtccatgcacaatactctgatcagaaaaagacactagaagggtttttgaatcaatctaaggtctaaatgacacaggaatgttattccttggcaactaatctccattatttaatttatataacgcttccttctaacaaaaggcttccaggtgaaactctggataatcagagtgtgttaatttaggcatattgtatcaaaaatatcaaagtcattatttccttaggaatttggacttctattggataagctgtgttattattgctacaaagtgtgtttttatataaagttgtatataagaacatctgtatgtatattattaataccagtggctaataggtacaaatgtcttacatatactattctgaaaatatggttggaaggtaagtcaatccttcctcgtttgcttctttttctttttttttttttacactttactgcaataattttcatttttttgtttgttttttttaaatgtattattattatactttaagttttagggtacgtgtgcacaatgtgcaggttagttacatatgtatacatgtgccatgctggtgcgctgcacccactaactcgtcatctagcattaggtatatctcccaatgccgtccctcccccctccccccaccccacaacagtccccagagtgtgatgttccccttcctgtgtccatgtgttctcattgttcaattcccacctatgagtgagaatatgcagtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacgtgtgcatgtgtctttatagcagcatgatttatagtcctttgggtatatacccagtaatgggatggctgggtcaaatggcgtttctagttctagatccctgaggaatcgccacactgacttccacaatggttgaactagtttacagtcccaccaacagtgtaaaagtgttcctatttctccacatcctctccagcacctgttgtttcctgactttttaatgattgtcattctaactggtgtgagatggtatctcatagtggttttgatttgcatttctctgatggccagtgatggtgagcattttttcatgtgttttttcggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctattcactctgatggtagtttcttttgctgtacagaagctctttagtttaattagatcccatttgtcaattttggcttttgttgccattgcttttggtgttttagacatgaagtccttgcccatgcctatgtcctgaatggtaatgcctaggttttcttttagggtttttatggttttaggtctaacgtttaagtctttaatccatcttgaattgatttttgtataaggtgtaaggaagggatccagtttcagctttctacatattgctagccaggtttcccagcaccatttattaaatagggaatcctttccccattgcttgtgtttctcaggtttgtcaaagatcagatagttgtagatatgcggcattatttctgagggctctgttctgttccgttgatctatatctctgttttggtaccagtaccatgctgttttggttactgtagccttgtagtatagtttgaagtcaagtagcgtgatgcctccagctttgttcttttggcttaggattgacttggtgatgcgggctcttttttggttccatatgaactttaaagtagttttttccaattctgtgaagaaagtcattggtggcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttttactttgattttgtatcctgagactttgctgaagttgcttatcagcttaaggagattttgggctgagacaatggggtttcctagatctacagtcatgttgtctgcaaacagggacaatttgacttcctcttttcctaattgaatactctttatttccttctcctgcctaattgccctggccagaacttccaacactatgttgaatgggagtggtgagagagggcatccctgtcttgtgccagttttcaaagggagtgcttccagtttttgcccattcagtatgatattggctgtgggtttgtcatagatagcttttattattttgaaatatgtcccatccatacttaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattctgtttgccagtattttattgaggatttttgcatcaatattcatcaaggatattggtctacaattctcttttttggttgtgtctctgcctgagtttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagggtgtatgtctcgaggaatttatccatttcttctagattttctagtttatttgcatagaggtgtttatagtattctctgatggtagtttgtatttctgtgggatcggtggtgatatcccctttatcattttttattgcgtctatttgattcttctctctttttttctttcttagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatctccctctacacactgctttgaatgcgtcccagagattctggtatgttgtgtctttgttctccttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtatggtgctgaaataaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctatattgggtgcatatatatttaagacaattagctcttcttgttgaattgatccctttaccattatgtaatggccttctttgtctcttttgatctttgttggtttaaagtctgttttatcagagactaggattgcaacccctgcctttttttgttttccatttgcttggtagatctgcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattttggcatgattttgcagcagctggtaccggttgttcctttccatgtttagcacttccttcaggagctcttttagggcaggcctggtggtgacaaaatctctcagcatttgcttgtctgtaaagtactttatttctccttcacttatgaagcttagtttggctggatatgaaattctgggttgacaattcttttctttaagaatgttgaatattggcccccactctcttctggcttgcggagtttctgccgagagatccgctgttagtctgatgggcttccctttgagggtaacccgacctttctctctggctgcccttaacattttttcctgcatttcaactttggtgaatctgacaattatgtgtcttggagttgctcttctcgaggagtatctttgtggtgttctctgtatttcctgaatctgaacgttggcctgccttgctagattggggatgttctcctggataatatcctgcagagtgttttccaacttggttccattctccccatcactttcaggtacaccaatcagacgtagatttggtcttttcacatagttccatatttcttggaggctttgctcttttctttttattgttttttctctaaacttcccttctcgcttcatttcattcatttcatcttctatcactgataccctttcttccagttgatcgcatcggctcctgaggcttctgcattcttcatgtagttctcgagccttggttttcagctccatcagctcctttaagcacttctctgtattgattattctagttatacattcttctaaatttttttcgaagttttcaacttctttgcctttggtttgaatgtcctcccgtagctcagagtaatttgatcgtctgaagccttcttctctcagctcatcaaagtcattctcaatccagctttgttcccttgctggggaggaactgtgttcctttggaggaggagaggcgctctgctttttagagtttccagtttttctgctctgttttttccccatctttgtgattttatctacttttggtctttgatgatggtgacgtacagatgggtttttggtgtggatgtcctttctgtttgttagttttccttctaacagacaggaccctcagctgcaggtctgttggagtactcggctgtgtgaggtgtcagtctgcccctgttggagggtgcctcccagataggctgctcgggggtcaggggtcagggaaccagttgaagaggaagtctgcccgttctcagatctccagctgcatgctgggagaaccactgctctcttcaaagctgtcagacagggacatttaattctgcagaggttactgctgtctttttgtttgtctgtgccctgccccaagaagtggagcctacagaggcaggcaggcctccttgagctgtggtgggctccacccagttcgagcttcccggctgctttgtttacctaagcaagcctgggcaatggcgggcgcccctcccccggccttgctgctgccttgcagtttgatctcagactgctgtgctagcaatcagcaagactccgcgggcataggaccctccgagccaggtgcgggatataatctcctggtgcgccattttttaagcccgtcggaaaagcgcaatattcgggtgggagtgacccaattttccaggtgccatctgtcacccctttctttgactaggaaagggaactccctgaccccttgcgcttcctgagtgaggcaatgcctcgccatgcttcggctcgtgcatggtgcgcgcacccactgacttgcgcccagtgtctggcactccctagtgagatgaacccggtacctcagatggaaatgcagaaatcacctgtcttctgtgtcgctcacagtgggagctgtagactggagctgttcccattcggccatcttggctccttcgccttcgtttgtttcattctagacagagttgcactttgactttaagaagctaaaaatttgtctattaccattcatataatagccttgttatggaaaaatcatttgtattgaccactaattcaggtagaaagaagcaattcctacatatagaacacttctctcttcctgaaaggcatctgtatttactgacaaaatgaaatcgttttatgggtaatacaaaagtgattctgaagtgtctgttttagcaaagaaatagtcttttaatgtgttattttaaatgttttattcattattataaccatgtactcaggggtccttagatgagatacgccttataacttttaaaaaaatgtaatataaaatataagctatttttttctgggttattgtctccttgttagtggtgaatcagtgagtggtgaggaaatgtgaaggcctaggatacaactatttactattgtagactttataaggactatacccttgggcttcatgaaatttataattttttaaatttttaaaaaaattttactttaagttctgggatacatgtgcagagcatgcagatttgttacataggtatacatgtgccatggtggtttgctgtacccatcaacccatcatctacattaagtatttctcctaatgctatccctcccctagccccctactacctgacaggccccctgtgtgtaatgtttccctccctgtgtccatgtgttctcattgttcgactcccacttatgagtgagaacacgtggtgttttgttttctgttcctgtgttagtttgcttagaatgatggtttccagcttcatccatgtccctgcaaaggacatgaactcatccttttttatagctgcatagtattccatggtgtatatgtgtcacattttctttatccagtctatcattgatgggcatttctgttggttccaagtctttgctattgtgaatagtgctgcaataaacatatgcatgtatgtgtctttatagtaggatgatttatacttctttggatatatatacccagtaatgggatggctgggtcaaattgtatttctggttctagatccttgaggaatcgccacactgtcttcctcaatggttgagctaatttacactcccaccaacactgtaaaagcgtttctatttctccacatcttctccagcatttgttgtttcctgactttttaatgatcaccattctaactggcgtgagatagtatctcattgtggtttttaatttgcatttctctaatgaccagtgatgagctttttttttaatatgttttttggccacataaatgtcttctttcgagaagtgtctgttcatatcctttgcccactttttgatgggattatttttttcttgtaaatttgtttaagttatttgtagattctggatattagccctttgtcagatggatagattgcaaaaattttctcccattctgtaggttgtctgttcactctgatgatagtttcttttgctgtgcagaaactctttagtttaattaggtcccatttggcaattttggcttttgttgccattgcttttagtgctttagtcatgaaggctttgccatgcctatgtcctgaatggtattgcctaagtattccagggtttttatggttttagatcttatgtttaagtctttaatccatactgagttaatttttgtataaggtgtaaggaaggggtccagtttctgttttctgcatatggctagccagttttcccagcaccatttattaaatagaaaatcctttccccgttgcttgtttttgtcaggtttgtcaaagatcagatggttgtagatgtgtggcattatttctcaggcctctgttatgttccattggtttatataactgttttggtaccactaccatgctgttttggatactgcatccttgtagtatagcttgaagtcaggtagcgtgatgcctccagctttgttctttttgcttaggattgtcttggctatacgggctcttttttggttctatatgaaatttaatgtagttttttctaattctgcaaagaacgtcaatggtagcttgatggggatagcattgaatctataaattactttgggcaatatggccagtttcacaatattgactcttcctatccatgagcatggaatgtttttcccatttattttgtcctctcttatttccttgagcagtgatttgttatgatttccgttcttttgtatttgctgaggaatgttttactttcaagtatgtggtcaattttagaataagtgtgatgtggtgctaagaagaatgtatattctgttgatttggggtggagagttctgtaaatgcctcttaggtcctctcggtccagagctgagttcaagtcctgaatagccttgttaattttctgtctcattgatctgtctaatattgaccgtggggtattaaagactcccacttttgtgtggaagtctaagtctctttgtagttctccttgaagaggtccttcatatcccttgtaagttgtattcctaggtattttattctctttatagcaattgtgaatgggggttcactcatgatttggctctctgtctgttattggagtataaaaatgcttgtgatttttgcacattgattttgtatcctgatactttgctgaagttgcttatcagcttaaggacattttgggctgagaccatggggttttctaaatataaaatcatgtcatctgcaaacagggacaatttgacttcctctcttcctatttgaatttcctttctttctttctcttgcctgattgccctggccagaacttccaatactatgttgaataggagtggtgagtgagggcatccttgtcttgtgccagttttccaagggagtgcttctagcttgtgcccattcagtatgacattggctgtgggtttgtcataaatagctcttagtattttaagatatgttccatcaatacctagtttattgagagtttctagcatgaagggttgagttttattgaaggccttgagcaggtattgagataatcatgtggtttttgtcattggttatgtttatgtactgtattatgtttactgatttgtgtatgttgaaccagccttgcatcccagggatgaagccgacttgatcatggtggataagcttttggatgtgctgctgcatttggtttgccagtattttattgaggattttcacattgatgttcatcagggatattggcctgaaattttcattttttgttgtgtctctgccaggttttggtaccaggatgatgctggcctcataaaatgagttagggaggactccctctttttctgttgtttggaatcatttcagaaggaatggtaccagcttctctttgtacctcggtagaatgctactgtgaattcatctggttctgggctttttttggttggtaggctgttaattacgccttaatttcagaactcattattggtctattcagggattcaatttcttctttgtttagtcttgggagggtgtatgtgtccaggaatttatccattttttctagatcttctagtttatttgcatagagttgtttatagtattctctaatagtagtttgtatttctatgggatcagtggtgatatcccctttatcatttttattgtgcctattcgattcttctcttttattctttatttgtcttcctagccatgtattttgttaatcttttcaaaaaaccaactcctggattcattgattttttgaaggattttttgtgtctctatctccttcagttctgctctgatcttagttatttcttgtcttctgctagcttttgaatttgtttgctcttgcttctctagtttgtttaattgtgatgtcagggtgttgattttagatctttcctcctttctcctgtgggcatttagtgctataaatttccctctaaacactgctttagctgtatcccagagattctagtatgttgtgtctttgttctcactggtttcaaagaacttatttatttcggccttcattttgttatgtacccagtagtcattcaggagcaggttgctcagtttccaggtagttgtgcagttttgaatgagtttcttaatcttgagttctaatttgatggcactgtggcctgagagactgtttgttatgatttctgttattttgcatttgctcaggagagttttactttcaattatgtagtcaattttaggataagtgtgatgtggtgctgacaagaatgtatattctgttgatttgggatggagagttccgtaaatgcctattaggtcctcttggtccatagctgagttcaagtcctgaatatccttgttagttttctgtctcattgatctgtctaatattgacagtggggtgttaaagtctcccacatttgtgtgacagtctaagtctctttttaggtgtctaaaaatttgctttatgaatatgggtgctcctatattgggtgcatatatatttaggatatttagctctgcttgttacattgatccctttaccattatgtcatgcccttctttgtcttttttggtctttgttggtttaaagtctgttttctcagagactaggattgcaacccctacctttttttttttatgctttccatttgcttggtaaatattcctctatccctttattttgagcgtgcgtgtgtgtttgcatgtcagatgggtctcctgaatacagcagatcgatgagtcttaactctatccaatttgccagtgtgtgtcttttaattggagcttttagcccatttacatttaaagttaatattgttgtgtgtgaatttgatcatgtcagtatgatgctagctggttattttgcctgttacttgatgcagtttcttcatagtgttgatggtctttacagtatggtatgtttttgcaatggctggtactggtttttcctttgtatatttagtgcttccttcaggagctctcgtaaggcaggcctggtggtgacaagatatctcagcatttgcttgtctgtaaaggatttttatttcttcttcacttatgaagcttagtttggctggatatgaaatcctgggttgaaaattcttttgtttaagaatgttaaatattggcccccagtctcttgtggcttgtagggtttctgcagagagatccactcttagtctgatgggcttccctttgtgggtaacctgacctttctctctggctgcccttaacattttttccttcatttcaaccttggtgaatctgacaattatgtgtcttgggatggctcttcttgaggaatatctttgtggcattctctgtatttcgtggatttgaatgttgacctgtcttgctagattggggaagttctcctggataatatcctgaagagtgttttccaacttgtttccattctctctgtcactttcaggtacaccagtcaaaggtaggtttgttttattcacacgttcacatatttcttggaggctttgttcattccttttcattcttttttctctaatcttgtcttcacactttatttcattaagttgatcttcaatctctgatatcctttcttccactcggtagattcagctactgatactcgtgtatgtttcatgaagttctcgtgctgtgtttttcagctccatcaggtcatttatgttcttctctaaattggttaatctagttagcaattcatccaaccttttttcaaggttcttagcttccttgcattgggttagaacatgctcctttagcttgggggagtttactattaccaaccttctgaagcctacttctgtccattcgtcaaactcattctccgtccagttttgttcccttgctggtgaggagttgtcatcatttggaggagaagaggcattctggatttggaatttcagtcttttgcactggtttttcctcatctttatctacctttggtctttgatgttggtgacctttggatggggtttctgtgtggatgtcctttttgttgaggttgatgctattcctttctattagttttccttctaacagttaggaccctctgctgcaggtctgttggagtttgctggaggtccactccagaccctgtttggctgggtatcaccagaggaggctgcagaacagcaaagattgctgcctgttccttcctctggaagctttgtcccagagggacacctgccagataccagctggagctctcctatatgaggtgtctgtcgacccctgcttgggggtatctcccagtcaggaggcacgggagtgagggacccacttgaggaggcagtctgtcccttagcagagctcaagtgctatgctgggagatctgctgctctattcagagccagcaggcaggaacatttaagtctgccaaagctgtgcccacagctaccacttcccccaggtgctctgtctcaggaagatgggagttttatctataagcccctgactggggctgctgcctttctttcagagatgccctgaccagggagaaggaatctagagaggcacattggctacagtaggtttgctgagctgtggtgggcttcacccaatccgaacttcccccagcagctttgtttacactgtgaggggaaaatcgcctactcaagcctcaataattgtggatgttcctctccccaccaagctcaagcatcccaggtcgacttcagactgctgtgctggcagcaagaatttcaagccagtggatcttagcttgctgggctccttgggggtgggatccactgagcaagaccacttggctccctggtttcatccccctttccaagggagtgaacggtttcgtctcactggagttccaggcaccagtggggtaaaaaaaaaaaaaaaaaaaaaaaaaaaaaaaaaccctgcagctagctctttgtctgcccaaatggccacccagttctttgcttgaaactcagggccctggtggtataggcacccgagggaatctcctggtctgtgggttgtgaagactatgggaaaagtgtagtatctgggccagaatgcaccgtccttcaaggcacattctctcacagcttcctttggctagaggagggagttccctgaccccttgtgcttcctgggtgaggcaacaccccaccctgcttctgattgccttccatgggctgcacgcactgtctaaccattccctgtgagatgagctgcgtacctcagctggaaatgcagaagtcacccgccttttgcattgatcttgctgggagctgcagactggagctgttcctatttggtcatcttgccagtcacctattttcctcttttttctttctttaaaataaccttagcatactgtaccttttttctttataaacttttaattttttaaaacttttgattattgtgtaataacacttaggttaaaacacaaacacactataaagctgtacaaaatattttctttctttccatccttattctataaactttttctattttttaaatttttatatcttttgctttttaaacatttttaaaaatgaagacacaagcacacatattagcctaggcctacacagggtcagcatcatcaagacattattaggtgataggaatttttcagctccattataatctcctgggaccaccattgtatatgcagtccatctttgtctgaacatcagtaggcagtgtgtgactgtacctctaaagatgaccacagagttgtcagaattatgctaattcccacttcagtttgtttggattatttgagctgatgtaatgtttccagtcaggagacaagtatagaatagcagtgcacattctgaaagccttattttcctttctccttcagggtttcataacctaacttggcataataggtctcatgtgttgtgctcaaactgcatgtaacgctatatttatgccttatatttgtagcccctatatttataccttagtataaaagaaatgaaggaaataagtgcatatcctcttatctgatttttacccagaattacatagatagcttgccattgtttggatggcaagaagaataaatacaggcatgtatttatccccatgacatgcactacatacaaatttttcagttttgtcttcacaaaaacccaatgagttaggtattatctaaattttttaaatggataaaatgtggctctaagagatagacaatgatgaagtagcaggatttgcatttagacctatgatctctgactgcaaagcccattctcttagttcctatgtaatacaggctcctggagcctactgggttaagagagagccatgaagctccttttctgcttttccattgttaatgcagctctgtggtacctgaagcactgctttgcatgaaggaaatgatgtaccttttttgttgcttgttttttgcttttgttttttttttcctttaaatttatttatttattcccagctttactgatatgtaattgaccaataaaaatggtatatactcaaggcttataatgtgatgttttgatttatgtatacactgtgaaatgattaccacaaccaagctaattaaaatatccattacctcacatagttaccattttgtgtgtgtgtatgtagtgagaactctcctactctcttagcaaatttcaagtatagaatacattgttaataactgtagtcaccatgttgtacattagaactccagaacttattcatcacataatcaaatgtttgtatcctttaacaaacatctttcaatttcctccattccccagcctctggcaaataccagtctacttcctgtttctgagttccacttatttggattccacatacaagtgagatcatgcagtatttgtttctgtctagcttattttacttagcacaatgtcctgtaggttcatccatgctgctacaaatgacaggatttccttctttcttaataattttctcatccattatgcatatttctcattaattatatagctcatatcttctttttccattcatcccttgatggacacttaggtctatatcttggcaattgtgaataatgctgcaatgaatataaaatgcagattttttttgagaccctgatttcattttctttggatataaacccagaagtgggattgctggatcaaatggtagttctatttgtagttgtagttttttgaggaatctccagattgttttccataatctctctaccaagttataatcccatccacagtgtacagctgttccctttctccacatcgtgttcagcactgattattgtttgaccttctcataatagttatgctgacaggtgtgaggtgatatatcactgttgttttgatttacaggaaggaatgtatttttgaggtattaaaacactactttcctctggcttatgtaaaatgcaggtactttgggtattatcaataaaatacaggctctaaatttgtaagaaaggaatctctgagtgccatgtgtccccctaaaatattgattgtgaatcaaataacattcactattaaaatagatgtagctaagaatatgaaccatacaggtaatttattaagtgcttactctatgctaggcactccttctgccaagatacacatggcataaaatagaaagaacatctttcaaatattcttaagactgtagtcttgggaaactaaactcttgagataattgtatgaaaaagagtctaacacatctttaaatagctgcctacctttctctaaactagttaagaaagggtctagtgaaaacatgggcaccacgtaatctaccttgtaagattcagagtgcctgagatagaattctaaatttctttgcagagagaaaaagcaaaacaaattaaaagatgaaggaatactatatccatgtaagtctatggccagtaaagacacttttgggtatggatgactcattttatcctatatgaacttcttttaaagtaatcatacaaatatatacacccagaaaaaatgaaaattcaatgagagaggggagtgggatatctgaaaaagcaatgagcaaagaaaacattggaattgaggctaaaatagtaactatgtaacctggctataaaacaatgtaataattaaggatctatcacacaaaacgtatataaaatgtaaaaatacggtatattcataatatagaattctaactatacttaagtttaaaataaaggtgatgtgcattgtagaatgtttagttaataaaatacaggtgatatatctgaatatactagctgagatgtgtctctgagatattttgttaattggaaaatatataatgtaatttataaaatagacaccatgtatgtaagatatttatatatgaaaaagaaaatacttaggaacaatatataccaaaatttgaacaggttttatctttggtgggggtgggattgcaaggaagcaggggttgatgatgaagaacatcttttacattttattttattaatttcctataatgtttaatgttttaataagcataaattaatgtaaaatttcattattgaaatggcttttaaaaataaaggatatatcctgtggaatagtgagaagtagcttaccagcagtgattttggacaagtgctatttgagtttccatatctcttcagtaagctgaagactttgctattgacctcaaagttagtgagtgtgtgcgtgtgtgcgtgtgtgtggtttaaatgtaatacaatgccatatgtaaagtgctaattacaatgtcagtgatatagtgtgcccttaaccaatagtagtcaatattatgcaacatatattgaacataggtaaccataaaccactaaaatgaagttgtaatcatagagcaatgtttgtttgttggttacttattcaccagtgagcaatgttgcttgagcaatagttttttttttaaacatttttgtttgtgttcatacatttggtgaaataaatataaatttttcaaagcaatcttgagattatttatgctgaacagtaatagatcaacagtaaaatatgcaggttggtaaaagttaaaagacatctcatttctcatttataaaaagagatatacaaatgtttggagacacttctagttgaagattgtatatataaaagagatatacaaatgtttggagacacttctagttgaagattttatatataaagaagtaaacattttgtcacgtacagccagaatagttgaagtgggagtgaagtcgagaagtggtttattcccccaaaatggtgtctttcaacaatattttaaaagataatgtattggcattatggcattattactataaacctattatgagatgatattagaacaagcagtgtgtaattatgctcctaagacatgtataggaggagctagagcaaagtgtggcaactctttttttttcttttcttttttttttttgagattgagtctcgctctgtggcccaggctggagtgcagtggcgtgatcttggttcactgcaagctccgcctcccgagttcatgctgttctcccgcctcagcctcccgagtagctgggaccacaggcacccaccaccgtgcccggccaatttttttgtattttcagtagagacggggtttcagtgtgttagccaggatggtctctacctcccgaccttgtgatccgcccgcctcggcctcccaaagtgctgggattgcaggcatgagccaccgcgccctgccaaagcatggcaactcttcatgtgctcacacttccaccatccaatggtggttttttctctctagccccaaactcagtttctgtcctaggtatgctcctttgatgttagatctaagcttggtctttgtttaatgttgaagaaaatgacccttgtctatgcccctatttgtatatagtctcaaaagaatcatatatttaaaaatgcatacacttatgttaataatctttatgtctgaatgtttctgaaacaatgagacacatcaaatttgtggaaatggtatcattgaactagagagccagctcctttggtaatgggcattggccacttttgacatggaaaattatcctcaggaagtatatttggtgttttcattataatattatagaaaatatttatagaaaaaggtccatatgctttggttttttgtttgtttgtttgttttttggtaatcatctttatgctatagtccttaccacttctgatgatcaactggctcctcttctgcctgtcctcaaagtgctaacatttttaaagatattcttagcatacttctttattaccacacgtttcttgcacaataccatctactcatactacaaaatcaacatcaccatccctctcatgtctccagaccttcagatccttgttcccagtttcctagtggatggcatcaccagaatgacttcccacaggcgcttaatctcccaatatttctatgagttttaattttattttccagccaacttgttaccactgttttccttgcagatgcaagcaagctttctcaaccttttttatgtttctatttagccaagaatcatcaagcttagttaatcctacgtctgaattatcccttagatccatcatttcttcctctttttctctgctactgttttggttcaggttcacttctttttcaaatgaaatattgcaattagttatttaattagtctcccttccttcaaggtctctattaaaccaccctttaatatctactcagcgattcttctagagccaggatgacctacttaaaaagaaaacaaaatgaaatgtagtgactccctatttcctgtaagattaagtttaaatgccttagcagcacctttacgatttggccgtagcctgccttctacaagtttttggcaagctcttctatttctcctctaaagtaatgctccctggcgttcagcagtaagaagctattttctttttttcccctttctttattgacaagtgaaaattgtgtataattatggtgtacagtataaggctatgagatatgtatacattgtggaatggctaaatcaagctatttaccatatgcattatctcacatacttgttttttgtgtatggtgagaatgcttaaaatctactctcttagcatggtctcacttaaatgtggagtgtaaaaaagttgaactcataaaaacagagtaaaatggtggatacctggggggtgggggtgggtggagtagagagatgtttgtctatgaatgtaaaattttagttagagaataataagtttttttttcattcttacatttgacacgtcctttctctgctctgtgctttggcactgtctgccccgaaacagagtcttgctctgtcgccaggctggagtgcagtggtgcaatcttggctcactgcaacctctgtttccctgattcaagcaattctcctgcctctgcctccctagttgctgggactacaggcatgtgccaccacgcccagctaattttttttttttttttttttttgtatttttagtagagacagggtgtcaccatgttggccaggatgatctgatctcttgacctctttatcctcctgccttggcctcccaaagtgctaggatttcaggcgagagctactgtccccggccctgttctttattcttggaagaactcctctggcccatgcactagctgttaaagtaccaagcctcttttatctaccacatctaaggatcatctcttctgttataccttctctacctttcaactttgactatgattgctggaatgttacacatagtgctggttgcatcacactgtgatggcttaattgatgcctccagtagactgtgaacttctcgagagccaggaccatgtgccattgatgtttgcatttctttattccactcaatattcttgtagtctcactatacagctattttgttaataagacaaaagaaattggagttgttagtcttgaacagctctggggactttgctaaggaaccttcctgtttttttccagatttatattctcttttagacattgccctactcccttcctaagtaaaaagcaaggactgagggaataagaatatttaagacagtgttaatgatgattacagctgaaacctgctttgattctttacccacactgagatgttccagagaggcttcctgactgtcagcaccacttgaagcctttcccattatatcactgaaggcaaataattcattgcatttggaagctaagctgtttaataacaaaggatgagcataattttagctaacttgagttcaatcacttactttatttgccatatatttaggcagtcacagcagcactttcaaaaatatatgcttgctttctttccttttcaacatttcaattcatgttacattgtttggagttcaatatatattgatgctatccttaatataaatttaaaaaattattttattgtggtatgagcacttaatgtgagttctaccctcttaacaaatttttaaactgtaaaatacaatattgactataagtacaaatgttgcaaagcagatctctagaatttatttcaacctgattaactaaaactttatgctcattttctccccattttcttctcccccgctttcccccacagcatgcttttttttttaattgtttgctttatgtttgtggttatattgaagggagattttctttcaagaatgctttatgctcttaaatccgattataaattaataatttacataaaatattatgtagtgagattcagaggtaaaaatatctggtgatgacaacagctaagacgactattgaacagtgttccaggtactgtccttagtaatttgaatggagtgccctatttaatcctcacaacagccctgtgaagaagattgatattattcttctattccctagaagagagaaacagtgaagcttaaacaagttaagtaacttgcccacatcacacagctgttaaagatcagaacctggactgggattcaggcagtctgactccagagtgcactcccataattactacagctgtggataacataatttagaactaaacaatttttattctacctgaaaatcagaggtttgtctgtcagaggagtcttagcaactttttgaatagattgattcttccttcttgaaaccatattcactacttccacaagttttactttcatttccccctatgctactggtaaattgagctgtaaatccctcttttcctccttctttgggataatttcgttactgcttcattagccagtgcatcatgaaagcatctcaatacagccctttgctgatgctgagatataagcactaagccactactaaatgcattcctgtatttattctttttgccacacaaacaatgggaaactgtctagataattccaggcaaaagccagagaagaggatacacatgtatttgttttatactgaggcataaatgtaggaactgtgataagggcaatgcttatgtaactaggcaagtgcagattcagatgtttaatcaattagattttattcacgcacacacacacacacagtctcccaaatccaaaggtatgtactatttttactgattaatgttagttttaaattttacattatagctactctgtgttacagaaaaatagtatcttttgaaatgcagtaccttcagaaaatgagtgggaaagctgtagttgtttttattagttttataactataatgaaaaatactaactctggagctgctaaggataatccttttgatgtgagagtaaatatttttccataatggaatggctttattgtcaggatagattggaaatgtattgcttttttcttaagaaaagttatatattcctatgcataatcctcctctcccaaggaatatttttcctttcaactttatcctattagaaattaatatttagtccttattaaaaattacttgtgctaaagcaacgattttgctgttattagtcatttctactgtttgaatgtggtccatttctgcgatactattttggtatgaagaaaatctgtaaacaggaaagagtttgggtacataggggaaaggagagataccaaagcaagggttgagcaaaagtgaaagggaagtacttacaactaaaaaaaagttggcagcgaagataaccttctgtcaatttcctatattttccccaagaccactaatggccgtctgatagccccatttgactccacagcagggtgtttgcttattgtggggagcagacactttaaaaggactgactgcatacacgaggctggtccgtgtttctcttagatgtgaccttgccctgacaatagtccagagactgattctccattggtcagtgttatctattcttccttcatctctgcacacaatggccctctgcatctttccatgagggcattgctattgccttggggatcacagcagatgcaactgtactcgagctagcagcctcaaagagttcacagttttttttgttagcctacccagagtttcagttttggcttttcagggtgctgtcatgggatacaaacgcatgatgaagttgcgttttatctctgatgcaatgaattttcatggagacaaacttgcagggtttttaagctcagcattattaggaagatgacagcttcagctggtattctttctgtggtgagaatagtccagccacactcatgttacctcaatttgaacaggcaaataggagactgcttcttggcttgaaaagaaggtttacaagatctaagagcttttgttctagttgagatgacgaaggttctctgcatctatgtccctgggggagcccatttttttccacattccaagcacttggctgtgtaatcctgtgcaaaacttctcccaggcaagatctccatatgtattatttggttgctttctctaattctcctcaaacatcagcttagtattcacaataatagctacatttattgagccctttccaaatgccagccactgttctaaaggttttacctgtttagctcactcaatcctcacaaacttatgaagtagatatcatattgcctacattttacagattcaggaaacagaggcagagggaagttaactaacttgaccaggggcacacagcttggcagtgtcagagctgggagggaattccagggagtctggctctagaatttatggtcttgctctccagggattgagagcgcatcctttcagtaacaagtggttgagtaaaatgctattttcaggtcacatttgtatcctaacaagagtcccacacagctaagtctagggaagtgtccctggaacacagctataattcctaatgggcctgaattttaaaaagctttccaggaatgaccattcattttaagaacagtgtggaaggagactggagggtccaatgaagctgctgagtagtaatcaggctggtatctgagacaagactcagaactggttctccaggggcatggcaatataagtctattgtgaaatgtggctttttaatgggtagctggggactccattcaacagccttaccttaaaacagcaagtccgcatattgaatggtttactggtcttggctattttagttcccgtgggtccttagttctgttagctcctgtccttgattcttccatgtcaggataagaagttactgctttaactacaggccagtgtggtcattgtggccactggttcttctgtatctctgtgcagttcgaaatacaattctttcctaagaaataattttgcggtcctaggagaacagtgtctgcatgtgactctcacaatccaccctgaagtgacctctcagtcattgaccacatgttgttggtttctctagaactgacaattacttaaagtcacgttcctagatcacatgttaagccctgcaaggtaaaaaattatgtcttattcaatatattcattgcttattataggtgatagtaaacatgttattttgttttgaccggttaaaatataccagagtctctttgcaagactaacttttctaatatgactgtaatatggataacgaaatagtctaaagggtgtcagttgacatatgtctgagaatcacagtttatttcatatttatatatttcttctaacaaaatgggatacatgtgcagaatatgcaggtttgttacacaagcatacatgtgccatggtgttttgccgcacctattgacccgttctctaagttccctcccctcacctctccacccctcaacaggctctggtgtgtgctgtttgcctctctgtgtccagagaatcatacagttttaaagcttagggtaattttgaaatagaaaaagaacataatgatttataaaatttgatttcaaaaatgtttgaatttttgtgctaagaagtaattactttggtttatatttgaatttactttgctttattcatgctgggtggccttttcttccattaaccagtggttttatataattttcaggtcatatttagtagtttttccacccacatctcccttcttccattgttatacaaaaatataagtggtgttttatcacatattaaaaaatattggccagatgctgatggtgcttttaaaacgtaattatttaattctgagactctgggagagggggcttagatctctgctttgggtgttcttctcagatgcggtgcttttaaaaaaaagtgtaattatttaatcctgagactcagagaaggcttagatctatgcattgggtgttattctcagatgcagagatgtaaatgccatttttctcttctgttttcaggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactgggaaaattgtagatcatggcaatgggacatttagtgtttatttcaggcataattcaactggtcaagggaatgtatctgtcagcttggtaccccctacaaaaatcgtggaatttgacttggcacaacaaaccgtgattgatgccaaagattccaagtcttttaattgtcgcattgaatatgaaaaggttgacaaggctaccaagaacacactctgcaactatgacccttcaaaaacctgttaccaggagcaaacccaaagtcatgtatcctggctctgctccaagccctttaaggtgatctgtatttacatttccttttatagtacagattataaactggtacagaaagtgtgccctgactacaactaccacagtgacacaccttactttccctcgggatgaaggtgaacatgggggtgagactgaagcctgaggaattaaaggtcatatgacagggctgttacctcaaagaagaaggtcacatctgttgcctggaatgtgtctacactgctgctcttgtcaactggctgcaaaatacactagtggaaaacactctgatgtaatttctgcccagtcagcttcatccctcagtataattgtaaatcatcacagattttgaattcacacctgaagacatgctctcacatatagaggtacacaaacacaccgtcatgcacatttcagcttgcgtctatcatgattcctgttgagagggctttcattgtctgactcataatggttcaggatcaactatcatcaaacggaaggattaactagacagagaatgtttctaacagttgctgttatggaaatctcttttaaagtcttgagtacatgctaatcaataatctccactcatgcattcctactgcttggagtagctgtactggtaaatactactgtaggagtatctgcttgttaaaatggaaaaatgtgtctttagagctcagtattctttattttacaaacacaacaaaatgtagtaacttttttccagcatacagtaggcacattcaaagtggtccaagatggctcttttttctttgaaaggggcctgttctcagtaaagatgagcaaacatttggaatttacatgtgggcagacattgggataacaactttcatcaccaatcattggacttttgtgaagttgacaccagctaaggctgcttaaaataagttctgatcattatataagaagggaaatgcctggcagacaccatgtaagttataagtgtctgtcttatctttactacacatattgtaacaaattcaatatcctagtcttcatttgtatgaatggtttgtattgtacatagtttaaccaagtgttatttgagctgcttattaatattaacttgtacttgtctctctgcttgttattggttaagaaaaaaggatatgaggaattcattttatcaatgtagctgtgaaggccattaaaaagacaaacttaatgtacagagcatttattcagatcaagtattgttgaaagctatacatatacaacattacagtctgtctgtatttagatattttatttctggaaaaaatgaaatgtacataaaaataaaacacttaaagttgagtttcaatatgtacttgtgtaagatggtgatttaaatggttctgacaagaagaatgtgctggaatacagtcctggctttgcatctcatatctctaaatttgtacagaactatctaaactgctgttagttgcccagtcaaaacaacttaagagtttcaatctgaagcctggggaatttgtggcatatagcattgcatacatttttggtttggtgtcatgctagttattcaagaataccaaaaatcaatgaacatcaggagataattgaggtctcctaaattaattatatatagttgaattatttcctgaccagtctttatttagcagaagaacggaagtgaaagcattctttttgctttagcagagtcaagatgcctgaagattgtggctgaattttcctgattatactgtaatgactcaactcaactgaagaaattgtgataacattggagggcttcaatgctcaatttacctatagcagattggatcaactttatatatatatagagagagagagagagcgagagagagagaaagagagagcattgtttgtttatggacattaactttattttaaaaaataattgctgtacacaatctcagcaaaataaccagatgaatagttgctgtacacaatctcagcaaaataaccagatgaagaaatatgggaggtgaccaatttttaaagccacgagttgggaatcggaatttgaattgtttcaaaggttaacaaactatgtcaaattaagaacacaaattcattatcatcttccccttatggtacttagaaataagtctgttttcatacagaaaataatgaaagtactgcaagagaaacaaaaccagagttctaaagtgagaactcaatgaccgatttgattaacgacagtcaactgcaaattgagcactcattactctgttaaatgtccatttcttgaaatgctccaaaatatctagaccatttatatcaatatagttattaattaattaatttaccatggaatttagaagctaatgttagaacggcgtctctttggcacaacaggcagtaagaccttaatgagtcctggctgctgaacatacttgccgtagataaatcttgtcattctggagtttacttatcaaaagtgatcacttaggaattagttggctcttagcaaacatgagagtaagtaagaaaggaaaaaatatatctttaaaggatccttcgattagcggactatgagtctcattgtatggtctgatctgtcattttgtaatacaaaattcaaagtaagataaaaatgtacttcagtctccaaccctctatcttgcattctaacctcccaatgaaatgtagcttatacagttttataaacacacagaacacagctaactaacattcatagactgaaatgttttactgagattttctttagaagaaaaacaaaataagaagaaaagatgtagcaaacttccaacaagcattttaattttaaaaaatccaaaccttcaggacccttattctgggccggtacacattcatcccaaacttctatatcaacaacacctctatctgtaatagagaaaaattattatgatatagaactttgattcaaagaaatgtatttgcacccattaaattcttcctttctttgacaaggaaatgggtgaaggaagatgatcaatgtcaaagaaagatcaaaggctcagaggaaaactattagaccaacttgttgcttaaacaaactggttaagttttaactgtgttagaaaatgcttttgttatttggaaaataaactttaagcaacactaagaaaataacattctctagaatcttaaatgttattttacatctttgctgaagtatagaaaaaaaaatcttccaggtggaagtggttagtatctgatgcaaacatgggtttgtcatctcctattgttcgtttcaaaaacattttagtaaaatcaacattattataaagtaatgattgttgtagcttcttgcctcatggaagaaaaatgatacaaattactggtttatttctttataaaacaaaaaaaatgaattgtcatgttctcagttgggcatttttgggtccatggctcttgagagaatttctctgaatgagtggaaggggcatacctggtaatgtcacacagtaaagttctggaagtgattaccttgcaagtaattgagatacttgttaaatttaaaagtgtggactgggaatcttcaagttcctacatttcagcaataaattgtaagccatatttttgcacagaatagattaaaaaatcatgagaagcctgagaaagtgttttcttttcacttttttcccactgctttatatgtaagaagcagcctaacgaataaacagctctttggaaaagcaatgtccatcttcaccatcagctttgaatgcccagttttagcctgaaagaaattctaatggccgtatttacaaaccattggaagacgtggttgatataccagttttagaactttatttacctgttcaactatcaatctatttattttacatttatttctttcatgtttttcaaataaaatgcaagttagtatatcgattcaaatatttaaaaataaacaatttgcataaaaattatgaccacttatcgaatctctagacgataaaaattgagtacaggctgaatacaaaaattgactataggctgaatcaaatcctgaaaaacttattgcaaggtcagagttttctcaggagtcccatgcatatgaaagaataattgcgggggttgggtacataagacaaaaagtctaaaattgcagtgtatcattaagttttatatacaataatatcagaaatattttacttaacaaatttctaatttctgtttactaggatgggaaagacagaaacctcctaataaaagttttagttaggatttgctccatgagcaaggtctagagaaacagccttaaggtaggggagtactagcgccaagcagctagccaggtgtcccatgcctgaccaaaagtactttcataattctgcatcagtgataacatgccttttatcactgatggtttgcaggataactgtaaagctcccagatgtgatggctgtggaaggcctagagactttctgttggtggctggagtagctgttgccatcagaggccaggtgttgttgcccaaaattctagctactgaattagacatacaactctgttcacatcctcacccaaaagtctctggctttttatttcctgatcttaggagttcaaagggacagatagaatgcaattcttctactcaaacacaagagtaaacttggcccttgtgattgtgataatttaaagaaacaatgcaagaaagttgttagaatgcagctattgttgaatttttttttttttttttttttttttttttttttttgagatggagtcttgctctttcacccaggctagagtgcagtggtgtgatctcggctcgctgcaacctccgcctcccaggttcaagcgattcttctgcctcagcctcccaagtagctgggattacaggcatgcaccaccacatctggctaatttatgtatttttagcagacatggggtttcaccatcttggctaggctggtcttgaactcctgacctcctgatccatcgcggcctcccaaagtgataagcatttttttttaaagaaaaagtctaccattgtttccattactgccaaaa

SEQ ID NO: 41 - DNA, 12991 bp, Homo sapiens
tttctttgcagagagaaaaagcaaaacaaattaaaagatgaaggaatactatatccatgtaagtctatggccagtaaagacacttttgggtatggatgactcattttatcctatatgaacttcttttaaagtaatcatacaaatatatacacccagaaaaaatgaaaattcaatgagagaggggagtgggatatctgaaaaagcaatgagcaaagaaaacattggaattgaggctaaaatagtaactatgtaacctggctataaaacaatgtaataattaaggatctatcacacaaaacgtatataaaatgtaaaaatacggtatattcataatatagaattctaactatacttaagtttaaaataaaggtgatgtgcattgtagaatgtttagttaataaaatacaggtgatatatctgaatatactagctgagatgtgtctctgagatattttgttaattggaaaatatataatgtaatttataaaatagacaccatgtatgtaagatatttatatatgaaaaagaaaatacttaggaacaatatataccaaaatttgaacaggttttatctttggtgggggtgggattgcaaggaagcaggggttgatgatgaagaacatcttttacattttattttattaatttcctataatgtttaatgttttaataagcataaattaatgtaaaatttcattattgaaatggcttttaaaaataaaggatatatcctgtggaatagtgagaagtagcttaccagcagtgattttggacaagtgctatttgagtttccatatctcttcagtaagctgaagactttgctattgacctcaaagttagtgagtgtgtgcgtgtgtgcgtgtgtgtggtttaaatgtaatacaatgccatatgtaaagtgctaattacaatgtcagtgatatagtgtgcccttaaccaatagtagtcaatattatgcaacatatattgaacataggtaaccataaaccactaaaatgaagttgtaatcatagagcaatgtttgtttgttggttacttattcaccagtgagcaatgttgcttgagcaatagttttttttttaaacatttttgtttgtgttcatacatttggtgaaataaatataaatttttcaaagcaatcttgagattatttatgctgaacagtaatagatcaacagtaaaatatgcaggttggtaaaagttaaaagacatctcatttctcatttataaaaagagatatacaaatgtttggagacacttctagttgaagattgtatatataaaagagatatacaaatgtttggagacacttctagttgaagattttatatataaagaagtaaacattttgtcacgtacagccagaatagttgaagtgggagtgaagtcgagaagtggtttattcccccaaaatggtgtctttcaacaatattttaaaagataatgtattggcattatggcattattactataaacctattatgagatgatattagaacaagcagtgtgtaattatgctcctaagacatgtataggaggagctagagcaaagtgtggcaactctttttttttcttttcttttttttttttgagattgagtctcgctctgtggcccaggctggagtgcagtggcgtgatcttggttcactgcaagctccgcctcccgagttcatgctgttctcccgcctcagcctcccgagtagctgggaccacaggcacccaccaccgtgcccggccaatttttttgtattttcagtagagacggggtttcagtgtgttagccaggatggtctctacctcccgaccttgtgatccgcccgcctcggcctcccaaagtgctgggattgcaggcatgagccaccgcgccctgccaaagcatggcaactcttcatgtgctcacacttccaccatccaatggtggttttttctctctagccccaaactcagtttctgtcctaggtatgctcctttgatgttagatctaagcttggtctttgtttaatgttgaagaaaatgacccttgtctatgcccctatttgtatatagtctcaaaagaatcatatatttaaaaatgcatacacttatgttaataatctttatgtctgaatgtttctgaaacaatgagacacatcaaatttgtggaaatggtatcattgaactagagagccagctcctttggtaatgggcattggccacttttgacatggaaaattatcctcaggaagtatatttggtgttttcattataatattatagaaaatatttatagaaaaaggtccatatgctttggttttttgtttgtttgtttgttttttggtaatcatctttatgctatagtccttaccacttctgatgatcaactggctcctcttctgcctgtcctcaaagtgctaacatttttaaagatattcttagcatacttctttattaccacacgtttcttgcacaataccatctactcatactacaaaatcaacatcaccatccctctcatgtctccagaccttcagatccttgttcccagtttcctagtggatggcatcaccagaatgacttcccacaggcgcttaatctcccaatatttctatgagttttaattttattttccagccaacttgttaccactgttttccttgcagatgcaagcaagctttctcaaccttttttatgtttctatttagccaagaatcatcaagcttagttaatcctacgtctgaattatcccttagatccatcatttcttcctctttttctctgctactgttttggttcaggttcacttctttttcaaatgaaatattgcaattagttatttaattagtctcccttccttcaaggtctctattaaaccaccctttaatatctactcagcgattcttctagagccaggatgacctacttaaaaagaaaacaaaatgaaatgtagtgactccctatttcctgtaagattaagtttaaatgccttagcagcacctttacgatttggccgtagcctgccttctacaagtttttggcaagctcttctatttctcctctaaagtaatgctccctggcgttcagcagtaagaagctattttctttttttcccctttctttattgacaagtgaaaattgtgtataattatggtgtacagtataaggctatgagatatgtatacattgtggaatggctaaatcaagctatttaccatatgcattatctcacatacttgttttttgtgtatggtgagaatgcttaaaatctactctcttagcatggtctcacttaaatgtggagtgtaaaaaagttgaactcataaaaacagagtaaaatggtggatacctggggggtgggggtgggtggagtagagagatgtttgtctatgaatgtaaaattttagttagagaataataagtttttttttcattcttacatttgacacgtcctttctctgctctgtgctttggcactgtctgccccgaaacagagtcttgctctgtcgccaggctggagtgcagtggtgcaatcttggctcactgcaacctctgtttccctgattcaagcaattctcctgcctctgcctccctagttgctgggactacaggcatgtgccaccacgcccagctaattttttttttttttttttttttgtatttttagtagagacagggtgtcaccatgttggccaggatgatctgatctcttgacctctttatcctcctgccttggcctcccaaagtgctaggatttcaggcgagagctactgtccccggccctgttctttattcttggaagaactcctctggcccatgcactagctgttaaagtaccaagcctcttttatctaccacatctaaggatcatctcttctgttataccttctctacctttcaactttgactatgattgctggaatgttacacatagtgctggttgcatcacactgtgatggcttaattgatgcctccagtagactgtgaacttctcgagagccaggaccatgtgccattgatgtttgcatttctttattccactcaatattcttgtagtctcactatacagctattttgttaataagacaaaagaaattggagttgttagtcttgaacagctctggggactttgctaaggaaccttcctgtttttttccagatttatattctcttttagacattgccctactcccttcctaagtaaaaagcaaggactgagggaataagaatatttaagacagtgttaatgatgattacagctgaaacctgctttgattctttacccacactgagatgttccagagaggcttcctgactgtcagcaccacttgaagcctttcccattatatcactgaaggcaaataattcattgcatttggaagctaagctgtttaataacaaaggatgagcataattttagctaacttgagttcaatcacttactttatttgccatatatttaggcagtcacagcagcactttcaaaaatatatgcttgctttctttccttttcaacatttcaattcatgttacattgtttggagttcaatatatattgatgctatccttaatataaatttaaaaaattattttattgtggtatgagcacttaatgtgagttctaccctcttaacaaatttttaaactgtaaaatacaatattgactataagtacaaatgttgcaaagcagatctctagaatttatttcaacctgattaactaaaactttatgctcattttctccccattttcttctcccccgctttcccccacagcatgcttttttttttaattgtttgctttatgtttgtggttatattgaagggagattttctttcaagaatgctttatgctcttaaatccgattataaattaataatttacataaaatattatgtagtgagattcagaggtaaaaatatctggtgatgacaacagctaagacgactattgaacagtgttccaggtactgtccttagtaatttgaatggagtgccctatttaatcctcacaacagccctgtgaagaagattgatattattcttctattccctagaagagagaaacagtgaagcttaaacaagttaagtaacttgcccacatcacacagctgttaaagatcagaacctggactgggattcaggcagtctgactccagagtgcactcccataattactacagctgtggataacataatttagaactaaacaatttttattctacctgaaaatcagaggtttgtctgtcagaggagtcttagcaactttttgaatagattgattcttccttcttgaaaccatattcactacttccacaagttttactttcatttccccctatgctactggtaaattgagctgtaaatccctcttttcctccttctttgggataatttcgttactgcttcattagccagtgcatcatgaaagcatctcaatacagccctttgctgatgctgagatataagcactaagccactactaaatgcattcctgtatttattctttttgccacacaaacaatgggaaactgtctagataattccaggcaaaagccagagaagaggatacacatgtatttgttttatactgaggcataaatgtaggaactgtgataagggcaatgcttatgtaactaggcaagtgcagattcagatgtttaatcaattagattttattcacgcacacacacacacacagtctcccaaatccaaaggtatgtactatttttactgattaatgttagttttaaattttacattatagctactctgtgttacagaaaaatagtatcttttgaaatgcagtaccttcagaaaatgagtgggaaagctgtagttgtttttattagttttataactataatgaaaaatactaactctggagctgctaaggataatccttttgatgtgagagtaaatatttttccataatggaatggctttattgtcaggatagattggaaatgtattgcttttttcttaagaaaagttatatattcctatgcataatcctcctctcccaaggaatatttttcctttcaactttatcctattagaaattaatatttagtccttattaaaaattacttgtgctaaagcaacgattttgctgttattagtcatttctactgtttgaatgtggtccatttctgcgatactattttggtatgaagaaaatctgtaaacaggaaagagtttgggtacataggggaaaggagagataccaaagcaagggttgagcaaaagtgaaagggaagtacttacaactaaaaaaaagttggcagcgaagataaccttctgtcaatttcctatattttccccaagaccactaatggccgtctgatagccccatttgactccacagcagggtgtttgcttattgtggggagcagacactttaaaaggactgactgcatacacgaggctggtccgtgtttctcttagatgtgaccttgccctgacaatagtccagagactgattctccattggtcagtgttatctattcttccttcatctctgcacacaatggccctctgcatctttccatgagggcattgctattgccttggggatcacagcagatgcaactgtactcgagctagcagcctcaaagagttcacagttttttttgttagcctacccagagtttcagttttggcttttcagggtgctgtcatgggatacaaacgcatgatgaagttgcgttttatctctgatgcaatgaattttcatggagacaaacttgcagggtttttaagctcagcattattaggaagatgacagcttcagctggtattctttctgtggtgagaatagtccagccacactcatgttacctcaatttgaacaggcaaataggagactgcttcttggcttgaaaagaaggtttacaagatctaagagcttttgttctagttgagatgacgaaggttctctgcatctatgtccctgggggagcccatttttttccacattccaagcacttggctgtgtaatcctgtgcaaaacttctcccaggcaagatctccatatgtattatttggttgctttctctaattctcctcaaacatcagcttagtattcacaataatagctacatttattgagccctttccaaatgccagccactgttctaaaggttttacctgtttagctcactcaatcctcacaaacttatgaagtagatatcatattgcctacattttacagattcaggaaacagaggcagagggaagttaactaacttgaccaggggcacacagcttggcagtgtcagagctgggagggaattccagggagtctggctctagaatttatggtcttgctctccagggattgagagcgcatcctttcagtaacaagtggttgagtaaaatgctattttcaggtcacatttgtatcctaacaagagtcccacacagctaagtctagggaagtgtccctggaacacagctataattcctaatgggcctgaattttaaaaagctttccaggaatgaccattcattttaagaacagtgtggaaggagactggagggtccaatgaagctgctgagtagtaatcaggctggtatctgagacaagactcagaactggttctccaggggcatggcaatataagtctattgtgaaatgtggctttttaatgggtagctggggactccattcaacagccttaccttaaaacagcaagtccgcatattgaatggtttactggtcttggctattttagttcccgtgggtccttagttctgttagctcctgtccttgattcttccatgtcaggataagaagttactgctttaactacaggccagtgtggtcattgtggccactggttcttctgtatctctgtgcagttcgaaatacaattctttcctaagaaataattttgcggtcctaggagaacagtgtctgcatgtgactctcacaatccaccctgaagtgacctctcagtcattgaccacatgttgttggtttctctagaactgacaattacttaaagtcacgttcctagatcacatgttaagccctgcaaggtaaaaaattatgtcttattcaatatattcattgcttattataggtgatagtaaacatgttattttgttttgaccggttaaaatataccagagtctctttgcaagactaacttttctaatatgactgtaatatggataacgaaatagtctaaagggtgtcagttgacatatgtctgagaatcacagtttatttcatatttatatatttcttctaacaaaatgggatacatgtgcagaatatgcaggtttgttacacaagcatacatgtgccatggtgttttgccgcacctattgacccgttctctaagttccctcccctcacctctccacccctcaacaggctctggtgtgtgctgtttgcctctctgtgtccagagaatcatacagttttaaagcttagggtaattttgaaatagaaaaagaacataatgatttataaaatttgatttcaaaaatgtttgaatttttgtgctaagaagtaattactttggtttatatttgaatttactttgctttattcatgctgggtggccttttcttccattaaccagtggttttatataattttcaggtcatatttagtagtttttccacccacatctcccttcttccattgttatacaaaaatataagtggtgttttatcacatattaaaaaatattggccagatgctgatggtgcttttaaaacgtaattatttaattctgagactctgggagagggggcttagatctctgctttgggtgttcttctcagatgcggtgcttttaaaaaaaagtgtaattatttaatcctgagactcagagaaggcttagatctatgcattgggtgttattctcagatgcagagatgtaaatgccatttttctcttctgttttcaggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactgggaaaattgtagatcatggcaatgggacatttagtgtttatttcaggcataattcaactggtcaagggaatgtatctgtcagcttggtaccccctacaaaaatcgtggaatttgacttggcacaacaaaccgtgattgatgccaaagattccaagtcttttaattgtcgcattgaatatgaaaaggttgacaaggctaccaagaacacactctgcaactatgacccttcaaaaacctgttaccaggagcaaacccaaagtcatgtatcctggctctgctccaagccctttaaggtgatctgtatttacatttccttttatagtacagattataaactggtacagaaagtgtgccctgactacaactaccacagtgacacaccttactttccctcgggatgaaggtgaacatgggggtgagactgaagcctgaggaattaaaggtcatatgacagggctgttacctcaaagaagaaggtcacatctgttgcctggaatgtgtctacactgctgctcttgtcaactggctgcaaaatacactagtggaaaacactctgatgtaatttctgcccagtcagcttcatccctcagtataattgtaaatcatcacagattttgaattcacacctgaagacatgctctcacatatagaggtacacaaacacaccgtcatgcacatttcagcttgcgtctatcatgattcctgttgagagggctttcattgtctgactcataatggttcaggatcaactatcatcaaacggaaggattaactagacagagaatgtttctaacagttgctgttatggaaatctcttttaaagtcttgagtacatgctaatcaataatctccactcatgcattcctactgcttggagtagctgtactggtaaatactactgtaggagtatctgcttgttaaaatggaaaaatgtgtctttagagctcagtattctttattttacaaacacaacaaaatgtagtaacttttttccagcatacagtaggcacattcaaagtggtccaagatggctcttttttctttgaaaggggcctgttctcagtaaagatgagcaaacatttggaatttacatgtgggcagacattgggataacaactttcatcaccaatcattggacttttgtgaagttgacaccagctaaggctgcttaaaataagttctgatcattatataagaagggaaatgcctggcagacaccatgtaagttataagtgtctgtcttatctttactacacatattgtaacaaattcaatatcctagtcttcatttgtatgaatggtttgtattgtacatagtttaaccaagtgttatttgagctgcttattaatattaacttgtacttgtctctctgcttgttattggttaagaaaaaaggatatgaggaattcattttatcaatgtagctgtgaaggccattaaaaagacaaacttaatgtacagagcatttattcagatcaagtattgttgaaagctatacatatacaacattacagtctgtctgtatttagatattttatttctggaaaaaatgaaatgtacataaaaataaaacacttaaagttgagtttcaatatgtacttgtgtaagatggtgatttaaatggttctgacaagaagaatgtgctggaatacagtcctggctttgcatctcatatctctaaatttgtacagaactatctaaactgctgttagttgcccagtcaaaacaacttaagagtttcaatctgaagcctggggaatttgtggcatatagcattgcatacatttttggtttggtgtcatgctagttattcaagaataccaaaaatcaatgaacatcaggagataattgaggtctcctaaattaattatatatagttgaattatttcctgaccagtctttatttagcagaagaacggaagtgaaagcattctttttgctttagcagagtcaagatgcctgaagattgtggctgaattttcctgattatactgtaatgactcaactcaactgaagaaattgtgataacattggagggcttcaatgctcaatttacctatagcagattggatcaactttatatatatatagagagagagagagagcgagagagagagaaagagagagcattgtttgtttatggacattaactttattttaaaaaataattgctgtacacaatctcagcaaaataaccagatgaatagttgctgtacacaatctcagcaaaataaccagatgaagaaatatgggaggtgaccaatttttaaagccacgagttgggaatcggaatttgaattgtttcaaaggttaacaaactatgtcaaattaagaacacaaattcattatcatcttccccttatggtacttagaaataagtctgttttcatacagaaaataatgaaagtactgcaagagaaacaaaaccagagttctaaagtgagaactcaatgaccgatttgattaacgacagtcaactgcaaattgagcactcattactctgttaaatgtccatttcttgaaatgctccaaaatatctagaccatttatatcaatatagttattaattaattaatttaccatggaatttagaagctaatgttagaacggcgtctctttggcacaacaggcagtaagaccttaatgagtcctggctgctgaacatacttgccgtagataaatcttgtcattctggagtttacttatcaaaagtgatcacttaggaattagttggctcttagcaaacatgagagtaagtaagaaaggaaaaaatatatctttaaaggatccttcgattagcggactatgagtctcattgtatggtctgatctgtcattttgtaatacaaaattcaaagtaagataaaaatgtacttcagtctccaaccctctatcttgcattctaacctcccaatgaaatgtagcttatacagttttataaacacacagaacacagctaactaacattcatagactgaaatgttttactgagattttctttagaagaaaaacaaaataagaagaaaagatgtagcaaacttccaacaagcattttaattttaaaaaatccaaaccttcaggacccttattctgggccggtacacattcatcccaaacttctatatcaacaacacctctatctgtaatagagaaaaattattatgatatagaactttgattcaaagaaatgtatttgcacccattaaattcttcctttctttgacaaggaaatgggtgaaggaagatgatcaatgtcaaagaaagatcaaaggctcagaggaaaactattagaccaacttgttgcttaaacaaactggttaagttttaactgtgttagaaaatgcttttgttatttggaaaataaactttaagcaacactaagaaaataacattctctagaatcttaaatgttattttacatctttgctgaagtatagaaaaaaaaatcttccaggtggaagtggttagtatctgatgcaaacatgggtttgtcatctcctattgttcgtttcaaaaacattttagtaaaatcaacattattataaagtaatgattgttgtagcttcttgcctcatggaagaaaaatgatacaaattactggtttatttctttataaaacaaaaaaaatgaattgtcatgttctcagttgggcatttttgggtccatggctcttgagagaatttctctgaatgagtggaaggggcatacctggtaatgtcacacagtaaagttct

SEQ ID NO: 42 - DNA, 12936 bp, Homo sapiens
tatacttaggagtgaaatttctgggtaatatggtagttctacctttaatctttagagaaactgccaaagtgttttccacagtggctgtaccattttatattcctaacagcaatgccaacacttgtttcccattttgttttgttttacttctaaccatcctggtaggtagggcttagctattattattatcacaagttttgatatgggcttttaccaatacttgtagcactgtaaagatagcatgacaacatgagaggttctgactattttccagcttcaaatggtttagcagttccattcaaaagacaagttttcacgattgcttctaattttcttgaaaaatcacctccaaggctagcatttacctagcttcaggttgactaagaaagaaaatgggctgggcgcggtggcacacacctgtaatcctagcactttgggaggccaaggtgggtggatcaccagaggtcaggagttcaagaccagcctggccaacatgccaaaacctcatctgtactaaaaatacaaaaattgaccaggcgcagtcgctcacacctgtaatcccagcactttggcaggccaaggcaggcggatcacgaggtcgagaaatcaagaccatcctggccaacatggtaaaacactgtctctactaaaaatacaaaaattagctgggcgtggttgcttgcacctgtagtgccagctactcaggagcctgaggcaggagaactgcttgaacccaggaggcggaggctgcagtgagccgagattgcgccactgcactccagcctggcaacagagtgagactccatctcaaaaaaaaaagaaaaaatagaaatacaaaaattagctgggcgtggtggcacacgcctgtaatcccagctactcggaaggctgaggcacgagaactgcttgaacctgggaggcggaggttgcagtgagccaagactgcaccactgcactccagcctgggtgacaagagtgagactctccctctccctctccccctccccctctccccacggtctcccgatccctctcttgccacggtctccctctgacgccgagccgaagctggactgtactgctgccatctctgctcactgcaacctccctgcctgattctcctgcctcagcctgccgagtgcctgcgactgcaggcgcgcgccgccacacctgactggtttttgtatttttttggtggagacggggtttcgctgtgttggccgggctggtctccagctcctaaccgcgagtgatctgccagcctcggcctcccaaggtgccgggattgcagacggagtctcgttcactcagtgctcaatgttgcccaggctggagtgcagtggcgtgatctcggctcgctacaacctccacctcccagccgcctgccttggcctcccaaagtgccgagattgcagcctctgcccggctgccaccccgtctgggaagtgaggagcgtctctgcctggccacccatcgtctgggatgtgaggatcccctctgcccggctgccaggtctgggaagtgaggagcacctcttcccggccgccatcccgtctaggaagtgaggagcgtctctgcccagccgcccatcgtctgagatgtggggagcgcctctgccccgccgccccgtctgggatgtgaggagcgcctctgcccggccgccccgtctaagtgaggagcccctccgcccggcagccgccccgtctaagaagtgaggatcccctctgcccggccaccaccccgtctgggaggtgtacccaacagctcattgagaacgggccatgacgacgatggcggttttgtcgagtagaaaagggggaaatgtggggaaaagatagagaaatcagactgttgctgtgtctgtgtagaaagaagtagacatgggagactccattttgttctgtgctgggaggaattcttctgccttgggatgctgttgatctgtgaccttgcccccagcccgatgctctctgaaacatgtgctgtgtccactcagcgttagatggattaagggcggtgcaagatgtgctttgttgaacagatgcttgagggcagcatgcttgttaagagtcatcaaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatggtcaacaaaaaaaaaaaaaaaaagaagaaagaaaatatttggggtggctgaagaaaagaaaaaaatgaatatttttttctttttaaaaactttctcactgggcacgatggctcatgcttgtaatcccggcactttgggaggccaaggtgggcagatcatttgaggtcaggagttcaagaccagcctggccaacatggtgaaaccccatctctactaaaaatacagaaattagctgggcatggtggcatgtgcctgtaatcccagctactcaggaggctgaggcaggagaattgcttgaatctgggaggcggaggttgcagtgagctgagatagtgccactgcactccagcctgggcaacagagcaagactccatctcaaaaaaaaaaaaaaaaatttatctgataacttaattccataataacgttgttttacccataaacaaaatggcacacactggcattcagtttccggaaatgtctaatggtttctctagagcatttagaaattaatctagaaaggttatttttgaaaacaaaagtatgtggaaaatcttgtatattttaatcttgctggctacaccacttctaagtccctaacctagccagaaataccattttttcttcatttttggggttttcaaggcatggaagagctagagcctccttagtgaggcaaatggtcattcccaaataaaactgtttaattgtcctcatatattacatttaagtcttcaggcctttctctcagtaactcttttccttcatgattccaagaaaaaaatcaggaaaatatagaaagtataaaagagcagtaaaaataacttcctggctgggtgcagaggctcacacctgtaatcctagcactctgggaggccaaaagaggaggattgcttgagcccaggagcacgagaccagcctgggcaacacagtgagacacccatctatattttgttgctgttgttgttaattactttaaagccaggcgcggtggctcacacctgtaatcccagcactttgggaggccaaggcaggtggatcacaaggtcaggagttcaagaccagcctgaccaacatggtgaaacgccgtctctactaaaaatacaaaaagtagccaggcatggtggctcgtgcctgtaatcccagctactcaggaggctgagacaggagaatcgcttgaactcaggagtctgaggttgcagtgagctgagatcacaccactgcactccagcctgggtgacagagtgagagtaaaaaaaaaaaattactttaaaaagccaggcatggcggcccatgcctgtaatctcagcactttggaggccgaggcaagtggatcacttgaggtcaggagttcaagaccagcctgaccaacatggtgaaaccttatctatattaaaaatacaaaattagcccggcacggtggcgcatgcctgtaatcccagctacttgggaggctgaggcaggagaatcgcttaaacccaggcgatggaggttgcagtaagctgagatcacaccactgtgctccagcctgggcaacaagaacaaaactccatctcaaaaaaaaaaaattacttaaaaaagaattccgttttttggaaaattttcttcctcaactttcttacatttgacccaagttgaaaaaaaatctagcttaaaaacagaaaaggaaaaaaaaaaatgggcaaaacgaaagtatcatggaaaaacaatttcaaaagctgttgtcccagatattgataggcaagtatatgaaatatactttcccattatactcactgtggtacttgagagattaaactgtatatatataagactgtggctccagctggagtgcagtggcatgaccatggttcattgcaaccttaaactcctgggctcaagtgatcttcccacatcagccaacaacagatatgtgccaccatgcccggctaatttattttttattttattttttattacttttatttgagaaagagtttcgcttttgttgtccaggctggagtgcaatgacacgatctcggctcaccacaatctctgcctcctggattcaagagattctcctgcctcagcctcccaagtagctgggattacaggcatgtgccaccatgccaggctaattttgtatgtttagtgagatggggtttctccatgttggtcaggctggtctcgaactcccaacctcaggtaatccacccacctcagcagcccaaagtgctggcattacaggtgtgagccaccgcacccagctaatttattattattattattacttgtgtagacatggggtcttgctgtgttgcccaggttggtctcaaactcctggcctcagatgatcctctcgccttggcttcccacagtactgggattacaggcatgacccactgcgcctggccaagatggattttcataaaggcaaagagcagaccttctattctgagagctacagccagaggcttatatgaactccccaacttcattaacctcattaaatcatataatttctgtcatacgtaaatgtacattaaacagtgacatcttggaacaataaataactgggaacaatgtagccacacctctacagggaaacttgtgagtggctgaaaccaggaatgttgaacccacaaatgtccagggagagctatctctggggtgtgtgtgtcatacacgaacatacatggttaaaggcagaggaagtgcactggagacagcagttaaccagaagagtgagtctcagcgcttctactgaaagcctctgaatatcatccctatatcttaaagacaatcatcctaggccgggcgcggtggctcacgcctgtaatcccaacgctttgggaggccgaggcgggtggatcacgaggtcaggagatcgagaccatcctggctaacacggtgaaaccccatctctactaaaaaatacaaaaaattagccgggtgtggtggcgggcgcccgtagtcccagctactcgggaggctgaggcaggagaatggcgtgaactgcactccagcctggatgacagagcgagactcgtttcaaaaaaaaaaaaaaaaaaaaaaaaagacaatcatcctaagcaaaacaatacctgcttcgtaggctatgtgaagaataaacaatttcaaaaaagtttcactcattctttagcaaacatattttagtttgttttctgtttttctttccatcttttattttaggttcagggggtacatgtgcaggtttattacataggtaaattgtgtgtcacagggtttggtgtacagattattttgttacccaggtaataagcatagtacacaatagacagctttttgatcctcgccctcctcccactctccacactcaagtaggcccaggtgtctattgttcccttctttgtgttcatgtgtacttaatgtttagattccacttataagtgataatgtatggcattttttttctcttttctttttgagatggagtctcactctgctgcccagtctagagtgcagtggtgtaatctcggctcactgcaacctctgcctcccgggttcaagcaattctcctgcctcagcctcccaagtagctgggattacaggcacctgccaccatgcccagctaactttggtatttttagtagagaaagggttttgcatcttagccaggttagtctcaaactcttgacctcaagggatccatctgcctcagcctcccaaagtgctgggattacaggcgtgagcccacacccctggctggtatttggttttctgttcttgcattagtttgcttagcataatggtctccaactctatccttgctgagaaagatatgatcttttttatggctcggtagtattccatggttggtgtatatgtaccacattttctttatgcagtcaactgctgatgggcactaaggttgattctatgtgtcagcaaacatattttgaaccctccaaaatatactaagaattcagaagttcgagtccctgtcctcattgcacgtaacaagtcctcctccttgacaggtactctatagtttaataactgccttcaaagaactagaaagcaattcctcaaggatagagagctccaaccttgctatacaaggacctggcacataccaacagataattcaaatatagtttgaatgaacaaactatatttctgcttatgatctaaaaaaaatcctcagttgacattaacacgataaagaattgataaaaaataacactgtgtggtgattatcaggggaacagagacacttcagggcaacactcagaaacatttggaggtatacatgtactgaaacatcacaatatgtataattattatgtacattatgtctttttttttttttaatagagataaggtctcactttgtcacccaggctggagtgcagcagcaaaatcatagctttgtaaactttgtaacctcaaattcctgggctcaatcgatcctcctgcctcagcctcccaaagtgttggaattacaggcttaagctaccatgcctggccaaaaacaataattttaaaaaagagaaacacttgaaggggaaaaataaaaatgacaccacattggccaggtgcggtggctcacgcctgtaatcccagcacttctggaggctgaggcgggtagatcaggaggtcagaagattgagaccatcctggctaacacagtgaaaccccgtctctactaaaaatacaaaaaaaattagccaggcgtggtagcgggcgcctgtagtcccagctactcgggaggctgaggcaggagaatggcgtgaacccgggaggcggagcttgcagtgagccagaatcgcgccactgactccagcctggccgacagagtgagactacgtctcaaaaaaaaaaaaaaaaatatgacaccacattatcatgccatggcaaagctcagtagtgttctctcatgtaaaatccctccatctggagtgcagtggctcatgcctgtattctaacactttgggagggcaaggtaggaggatcccttgaggcaaggaatttgagaacagcctgggcaacacaacaagaccctctctctattaaaaataaatacataaaaataaattttggctgggcacggtggctcacgactgtaatcccggcactttgggagcctgaggcgggcagatcacgaggtcaggagttcgagaccagcctgaccaacatggtgaaaccccgtctctactaaaaatacaaaaattagctggcgtggtggcacgtgcctgtaatcccagctactcaggagactaaggcaggagaactgcttgaacccgggaggcagaggttgcagtgagccgagattctaccactgcactccagcctgggcgacagaaaaagactccgtctcaaaaaatatataataataataataataataataataataataataataattttttaaaagctaaataaaatccctccacctctgaaaacccctgcaaagggtgtggaaatggctcattttacccctatgatggttatgctataaaacaattggttttagactagagcttttcagtatgagaagtcaattgctgaaatcagtatttggtgacacatattttcataaacactaaatgtgttgagcaaagacctatctttaactttaaagtgaaaacttcaaactgttcctaactacaaaatttttcagagataaaccatggtttctcaactctggcactactgacattttgaccagataattctctgctgtagggagctgtcctatgcattagaggatgtttagcagcattcctgacctctatccactagatgccagtaccacctcccacagtcatgacaactaaagaaatttctagatattgacaaatgttctggggggaggatcatactgatagggaaccagagataaacaatggaatgataattttcttcataaaggctgtttaaataagatatggaagataatacaaactatcattctttgcactcatttgcgaatcatttttaggtcatcagatgaccttttaatattttatctgaaaagcagcagcagaagcagaccaccaccaccagtgcacctaaaggtaatgtgtaacctagaaagaagaaatgaaccaatgaaccaatggatgatgcaaaaagtcttaacagtaaaaaatgagctaaggtagcctcagtactctgctatgtatattactcatgcatggtaactgttagaattcttaggctatcttgaaatcttttatttcaatgctacaaagtcagactcttcatttttcttcctattcttatctgaaaaagaaaagtttcctgtatcacagagatcaagaatacttaccactatttattgagcattttgtaaatacaagggattttacttaattaagcagatctccaaaaaacttaaggaaataagacaaaacagattcaggaacgttaaataaaacaccgagagccacaaaggaagctgagggattcctgagatctaccaaagggtcatcaccatcacatcccaaaaggcctaggttttacttataaatcttctagtttataaaaaggccagatttgcaataatattaaaaactgagatctcagcatttaatagcataatcttaaacgtgtaaagaacacatagtacttttcagaaagtgttatttttcattataaaagaaacgtaagtggcgggacacagtggctcatgcctgtaatcctagcactttgggaggccgaggtgggcagatgacctgaggtcaggagtttgagaccagcttggccaaaatggcaaaaccccatctctactaaaaatttaaaaattagctgggcatggtggcaggcacctgtagtcccagctacttgggaggctgagacagaattgcttgaagccaggaggcggaggttgcagtgagctgagatcgcaccactgcactccagcctgggcgacagagtctcactctgtctcaaaaaaaaaaaaagaaagaaacatatgggctgggcacagtggttcatgcctataatcttagcattttgggaggctgaagcggaaggatagcttgagctcaggaatttcagaccagcctgggcaacatagtgaggtcctatctctattaatgagaaaaaaaaattagctggatgtgatgacacgggcctgtggtcccagctactcaggaggctgaagtgggagcatcgcttgagcctgggaggtcaaggctgcagtcagccataactgtgccaccacattccagcctcggcaacagaaacatatgatcattgtagatcatctaaatagcccattttttttctttttttttttttttcagatgcaatctcactctgtcgcccaggctggagtgcagtggcgtgatctcggctcactgcaacctccacctctcatgttcaagtgattctcctgcctcaacctctggagtagctgcaattacaggcgtacaccaccatgcctggctaatttctttgtatttttagtagagacggggttttgccatgttggccaggctggtcttgaactcctgacctcaggtgatccgactgccttggcctcccaaagtgctgggattacaggcgtgagtcaccgcgcccagccttaaatagcccattttttaaaagattggttgtaataatgatgtatataatgaatatcatcatattatcataatgacgtgtatctgtaataatgattcacatcaaaacaaatgcaaaggtaaagattagctaggtgttcaagcaatgaacaagtaactaatggatgaacatccccaaacacttcagtcctaaagtcacagatgacttttttagaacctgcccagaaattactgtagaaataaattctggcttcagaataattcaataaacttacctgtgctacctacactgaaaaaagtgacaagtactgtgccggtatgttgtggatggatttggtatttcagaggaaactggtacatactacagaaacggcctttcccaaaggaaaaatgaaatgctgccaggcgcggtggctcacgcctgtaatcccagcactttgggaggccgaggtgggtggatcacaaggtcaggagatcaataccgtcctgactaacacggtgaaaccctgtctctattaaaaatacaaaaaattagccgggcgtggtggcaggcgcctgtagtcccagctactcaggagactgaggcaagagaatggcattaacccgggaggtggagcttgcagtgagccgagattgtgccactgcactccagcctgggcgacacagcgagactccgtctcaaaaaaaaaaaaaaagaaaacaaaaactgaaatgcttatctcagaagcataaattaaagagaaaaatcatctctaatctactgtttcggtcttaccattttatagtttggacctaagagatcagcaatccttaataaataaggtttcccatgagttctggagcttctctgcctcctgttcgcaccctccatgtccatgtttaacaacctaatgccagccaggtgcagtggctcatggctgtaatcccagcactttgggaggccgaggctggaggatcacttgagcctaggagtttaagaccagcctgggcaacagaacgagaccctgtctctacaacaaataaaaaataaaaaatctaactgggcatggtggtgtggtggtgcacgcttttagtcccagcttcttgggaggctgaggtaggaggattccttgggccagggaggtcaaggcttcagcaagccatgatcatgccactgcactccagtctgggtgacagagtgagaccttgtctcaaaaaaaaaaaaaaaaacaaaacaaaaaaaaaacaacctaatgctggatggacacagtggctcatgtctgtaatcctagcactttgggaggccgaggctggaagactgcttgaacacaagagttcgggaccagcctaggcaagaaagcaatacccccatctctttagaaaaaaaaaaaaatgtgccaggcatggtggtacatgcttgtagttccagccactatagaggctgaggaaggaggaccacttgggaccaggagtttcaggctgcagcgagctaggatcaagccactgcacttcagcctgggcaacagaacaagaccctgtctcttactaaaaaaattttaaaaagtgaaccaaacgcttaagaagctaactcggttaggttcctaaggggccttttcaaaatcagatataaaagggctgatgccaggccctccagcactgagaagtgtaggctaaactaccttttctaggaacatcttcccttattctagaagaataggaatagaaaacagtggttattttagtggtcaggaagagcaaccaagatctcgcatggaggtgtgcttagggggaaaatgttaaaataattgattaggaaaaagaaagtacgagaattgtctgatataccaaggcaggatggtagacagaagcagtgaaatggctgatattacactagaggttgtatctgaacaaataatcagggttaggttctatgacttctaatcttggcactgcaatggaccagccacactgccgtaaaatggggcttaatatttagaaaataaagtttaagtactccaaaattactatgtcttttccaagacaataaaggcataaaagtcagaaaatgaaactaaaatatactcacaatgagtcttaacttttacctctttaaaacagtttagctcctggccaggcatggtggctcacgcctgtaatcccagcactttgagaggccgaggcgggctgatcacctgaggtcaggagttcaagagcagcctggccaataagctgaaaccccatctctacaaaaaatacaaaaattagctgggcgtggtggcgggcacctgtaatcccagctacttgggaggctgaggctggaaaatcgcttgaacccaggaggcggaggttgcagtgagcggagatagtgacaagagtgaaactccatctcaaaaaaaaaaaaaaaaaaacagttcagctcctttctaaaggagggtcttttcaattcattcataagtactaggttgggttccttagagaaaacctccaggccacttaatattcacaaaactaaagtccaagacccttgtgctcagaattttttttttgagatggattctcgctttgtcaccaggctggagggcagtggcgcgatctcagctcacagcaacccctgcctcccggttcaagcaattctcctgcctcagcctcccgagtagctgggactacaggtgagcgccaccactcccagctaatttttgtatctttactagagacgggatttcatcatgttggccaggatggtcttgatctcttgaccttgtgatccacccgcctcggcctcccaaagtgctgggattacaggcatgagccacaccacacccaaccagaaatttttaatacagcaaaattctcacatccaaatgaggttttacctaattgttacttacagtatcataaactatcagcaataatgaaaataataagagttcttcacctttccttccttctttgtctctgtagaagacctcaatttaacatcataaatcatttggtccttgacgtatggtaacttccagggagacagatgacatttagcacaggacatgtaagactgtgggaaaagggaagttcttggccgcaagaaatgggacaaaacccttgcctttgggaaaaatgccaaagatctctgaagtccacgctaaagcagttaaattttta

SEQ ID NO: 43 - DNA, 8602 bp, Homo sapiens
tttttccaagaagaatggagaagtaaatcatattttaaaatgggattgattacttggactctcagtgcagaaaacactgttttatatctattcatctcagaggaataaagggtgtgatacttcttaaggtacttcttaagatactttaaaggaaagtttacatatatatacacatatacatatacatatacccaaacttaaactcttgaaataaaagcacatgtcggagattatatgctgtatgctggatatccatgaggaaaattttcccacaaacaacctggcatggttcagtaactaaataactacatcccccgtactggtaactagccctatctcaggactactgtgttcctgggtgcaagatgggtgtctaggcctccaccatcttcaaagcctcaatttctatgtccctggttctcttaacaatggaacagtcgtaaagcagggtagcctcttggtcctacaaagagacaagaggaggactcaactatttccaaaaagacatcttgtcttgcatgctatgttttgtcaactgtcttaaatacctttaatatctaataacaccacttccacttggttctccctctctggacatgtgtctttgaaataaatcctagtttcagcacacacaaaaaagacctgtttcccaggctagtcccagaagattctatggtaattacaacaggatcccaaatccaagccctctgagtaacagtccattcatttcttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccattcatttctaaaagaagtcctctctagggtcaaatatggcagctgtttagctgacacagaggagtaataccaaagagttctcttttctgtttcctttcttttcctctttttcctaatcttccaaaggccaaagagaatgagaaggagcacttgggaaggtagatctaatataatcctgcctggctgttctaccctcctcagttcatgagtatcatgataatggacagctcctggtttaaatcattgttttattccatcaccccaccactagcaacccccagttaagattagctatagaaacataacacaaagggtgactgaagcgccaggtctttcagtgtgtgaggccagcaagagtccaacagcccctcaatgtcccagctgactcttctgatgatatgctcagaaatgtctacagaagctgagcagctgccagctcaacacaccctgccacacctgcgctatcggtggaatcagagaatgagaaagctagaaagaagctttagagaactacgctggttgaaaccctcatattactgatgaggaccataaatcatttaactgaaattaaaccaacaaatcaaaccacacatacccacaaaatctttacatttgtgacaaactatattttctagaggtggccactccaatacagattccatcccacatgctctaacaatgtgataatgacactccttcattgacaggtgggtctctctgttctctcctcctgagcctgggtagacctttgtaactgtcttgaccaacagaatgtgacagaatgataccaggtgacttctaagactacatcatacaaagcaacacagcttctgctgggctctccctctctggacacgtgtctttgaagccctgagctgccagattaaacagtccggcttgcctaaagtcaccacgctggagagaccatcagggatggagaggtgctacagaaaccctagctattctagtccccagccatttgagtcttcctagcccagactcataagtgaagaaaccttcaagatgattccaatacctcctatcacttgactgcaacctcgtgaaagcctaagccagacctgcacggtggagccattcctaaattctggtcccacagaaactgtgaaagataataaatgatcatcattgctttacattgggctaatttttattatcaggggtaacgtgttacatagcgataggcaactaatacaagattcattactaaaaccactaaaaactttaacctgttagtcactattaatttaagcaaacaaataagcaatcttccaatgatgcttccccaatttgcatgcctctctataaccttactctgccttcattttaaggcctagctcttatcaccatatgtgatatgattagataacacgatataggctacgttactgaatatatgaggaaagggcctttgttttgttcactattatatccccagcacctagaacagcacttgacaacatatagcaggtgcttgacaaccactggttcagtacaagaatgtatctggagatgattgggcttagtgttcctccaaggctatttgacctctcatcacctgttctccagtttgactcaacgtctcttaatatatattcactgcactgttaagtttctaactctctaactactactgacaaaaccattagatgttcttcgttcaaacccactagaggaactacaccatcccctccgtgatgccagctcagcatccagagtagagccagtgatttcctttgtcaacacacctgcatgccaaaaacccttcccaggaggtctcaaatatcaaataaaagttactccatttttcattcaaagaccatgtgcccaatgggaaaatgacctcatgttgtggtttaaacagcaactgcacccactagcacagcccattgagctatcctatatatacatctctgtcagtgcccctctgggtctagataattacactgagtacactgaagtcctttcattattgcaggcccaacaaaaagtactgccactgggtgaatatcagaaagcatgcatcaatgcactttcaagtcaaatgagaactggctagttaagcagcagcattaacagatgtagagattgtgccagccaaatgcctcttgccaattatggccacacagctacgcccaaattaaaaataacccaacacggccaggtgcactggctcatgcctgtaatcccagcactttgggaggctgaggcaggcagatcacgaggtcaggagtttgagaccagcctggtcaacatggtgaaaccccaactctactaaaaatacaaaaattagccaggcgtggtggcgtgtgcctgtgatctcagctccttgggaggctgaggcaggagaattgcttgaacccgggagacagaggttgcaatgagctgagattgtgccactgcactccaacctgggcgacagagcgagactcaatctcaaataaataaataaaaaataaataaaataacccaacactcataacagaatccaaatgggcatgggaggctccttctctccctacaatatcaccctacagtcgctacataaatgcccctgtaaagtggctcctaagttatgtcattaaaatgttcacctttccttggcaaagtagatctcaacacaggaggaaagagaaataagctaaaaaaagaaatgtggattgtctagaagttacaagggaacaaaaaagtagaaatcctccgtgagaggattttgcaaaaactgtaattaaaggaatctagaccagtggttgcccgatagaaatataagccaaaaatgtaagttttactcttctagtaaccatactttaaaaagaaacaggtaaaattaatttaaatgttttatttaactaaaaagatcaaaaatattatcatttcaacatgtaatcaatataaaagttagtaatgaaatattttacattctttttcttcctgctcagtctttgaaatcagtgtgtattttacactgaccgtgcatctacacttgggccagcacattgcagatgctcaacagccacaagagaccagtggttaccacattggaaagcacaggtctagaataatcctaacttctttttttgtaaaatactgaaacatccaaagcactccaagttttctattagggaggcaaaataactatactgttagaatcatgggcaacgatatcataaattcctaaaataaaaccacatagggccgttatttcaaattacataaaacttgtcttctagaagaattcgaccaaatgccaaagttcttaagatctgccccacttcccaaacaagggaaactgaagacctcgaccagcaccagggccttccgtcagctcctgatacaggaggggctcctggattttgtttccccttcttgacaatacaacatgggactgggttcctcatttgactcggttcatttaaagaatgatctcaaagaagaaaggaaaatcaatgacccctttaggaaatgtagtccagggtgggggtggaggaagcatttcaatgacaaaagccaaacctcagtcataatgcagatccctgtctaacaggtgatcattgttttttttttctattacaggcactctggtctcccgcctaccccatgcaggatggctatccccatgcagaatggctgtgactttcaagagagtcccccaagggagggtcccaagatcaggggctggtaatgggccccaccacaaggctacgctgctggcttttgtttggaacaatagcgctcccatgatacctcactcttgctgacaatattggtaatacgggagcatgaacacagctgtgtgtaaattacacacacaaacagattagatctgtatatttataaggaatacaaacatactaatagctcatttacatacacagctggatacaatgggctgcatgcagaggggagtttgagttccaaagtatttctctaaaattttacaaaaagaaatgctcagattactgctaacccaggctgagacttctgctccccccacccccatgcagtatgtcccccgaaatagagtccttttcatcctcgtttgtgatatttgagatgctatgaaggagaaacctcaacaagtgctgttagatttcacttttattattatttattattatttttagagacagggtcttgctctgccacctaggctacagtggtatgatcacagttcactgtaacgtggagcttccgggctcaaatgatcctcctggctcggcctcccaagtaggtcagactacaggtatgtgtcagttaccatgcccagctaattttaaaaatatttttttgtagagacggggttctcactatgttgcccaggcttggtcttgaactcttgatttcaagcaatcctgctgcctcagcctcccaaagagttgggattatggcatgagccactgtgcccagccagatctcactcctgtaggaaaaaaatcaatataggataattttcagttaaaaagatgtatatacatacgaagagggagacctactaaaacatctgttacaacagcatatagtaaggcagaatctttgcattttcaaaatgttttcataaactttatttgttagagcaatttcaggttcacagcaaaacggaacagaaggtatagggatttcccatatagatgggtctctggatttttcagctaattttgaaaaatagggaaaagagcaatcagcattttgtgctcactacagtaaaccaggaacacaggcatcaggagagctgggctctgattcaaaggcctgattctagcaaggcctcacagtttacttccggctagccatgaacactctctgcgcctgaggttttcgtggaaagacagcatcacaagtactcaaatgtagcgtttaaaagtactaacttttaaaatgttgaatgttccagtaaaacagttaaagaaaaaaaaaggtaataatccaactaagtaaaaatattaacttatacatatctggatagatgataagctcattacaggccctaattttattatttaaaatgtttacaacaaaactctctaattgatattctccctctctctctctttttgccttgatatggtttctataaactcttggtttaaaaaagaaaaaaggtccatttctgaggcttgggtttactgtacttacagttccaccagtaaatcgtctcccagtctgggctggagaagcgctggccacggtttgattgctccagccccaggttgccaggcaacccacacaagggggaagtctgagaaccgctgacagatagccaagtggctgaaacaacagacttctctctgtcaaaaatgtgtttgagagagccacttgcccacctctgctctctgctaaacactacatgattgtaaaatcaaaatcaaaaggccactgtaataaaaacacacttcctgctcaattactaattgttctaaagctgtggggaggcccagatcctacagtgtatggcaacagaaatgcgatactgtaaatgagataaagccagcagcatgcaagaaacctgatctaaatgcatctccgtagcttcaagtcaggagagctggtgtgtggaggaatcaactgcctaagaaaacaccaggaagaaaataatgaatgtcaagatgttaaagaaacaaaccaatcaataactacgaagctagaggtcaagactacttagtaataaaaccaagaacattctccattgttttgaaacacaatctggaggcaatgaaagttttctccctcagatggaaaggaggagcaagaaaggtcaatgacccttgggaaccacaccccctggcggttccaggtggattccctgatacttgactgtaaatgggattacaggaaatagtagcatccttaggataatgcaggacaataacaggtctgagagtctaatgcaacatttaaaatacctatggtgtgagctgggcacagtggctcacgcctgtaatcccagcactttgggaggccgaggtgggtggatcacctgaggtcaaaagtttgagaccagcctggccaacacagtgaaaccccgtctacactaaaaatacaaaaaattagctgggcatggtggcaaacgcctgtaatcccagctactggggaggctgaggcaggagaattgcttcaacccgggaggcagaggttgcagtgagctgagatcgcgccattacactccagcctgggcaacaagagtgaaactccctctcaaacaaacaaaaacaaaatatctatggtgcatgtaccaagccagtaacattgtgcccaacaccaactctatgcagcatccttccatgaaaccactgtattgaaactgtcatcttggactctggaaactatttgtagtatgtggaaggggccagcactgagtgcacagttctttatctcttctgtgccatggaccctttggcagtctggtaaagcctgactccttctaaaaatggtttatggccaggcacggctcatgcctgtaatcctagcactttgggaggccgaggcaggcggacatgaggttaggagatcgagaccatcctggccaatatggtgaaaccctgtctctactaaaaatacaaacaattagctgggcgtggtggcgcatgcctgtaatcccagctactcaggaggctgaggcaggagaatcacttgaaccagggagtcagaggtcgcagtaagccgagatcatgccactgaactccagcctggcgacagagcgagactccacctaaaaaaaaaaaaaaaaaggctgggcacggtggctcctgtctgtaatcccagcactttgggaggccgaggctggcggatcacctaacgtcgagtttgagactagcctggccaacatggtgaaacctcgtctctactaaaaatacaaaaaaaaaaaaaaattagctgggcatggtggtacatgcctgtagtcccacctacttggggaggctgaggcaggagaatcgcttgaacccaggaggcggaagttgcagtgaaccaagaccatgccactgcactccagcctcggtgacagagggagactccatctcaaaaaaaaaaaatagaaagtatgccagagtaatataactgctctatgaacacactaaataacaagagctagcagagggttttctttagctcatgcaggttttttgtttttcgggggggtgggggggctgttttgctttattatgtgacctcagatgataaacccttggagggcaaggacagcaagtttttcatcattcaatttccagtgcaatatgcagcccggtttcctgccccaagctcctaagctagccctcgtcacaccactagcccagctcctatgggggcgtgggtttccttgactctcccagtgcccagaagtgggcctggcatataagatgtgtaagaccatagtccgcaaaatgggatgtatggacacaaaagacatttttttcctatgttctctttccaacaatccatcagcctgagaaggcacacgctcctgtgaggggatgcagcctctcttcttctatccccaccactgcccccctctcacttcacaaaggcagcctcctctcccccgctcccatc

SEQ ID NO: 44 - DNA, 12682 bp, Homo sapiens
ccctgagtacaaaaataaccaatagtaagaatgttcagaatcagctggctgagcagcagcaaaaaacaggatagctctcctctagaaactggtaggagcaagctttctgcctcataaacactttgctgtgtatacacatgtagtcttaattcatgagacataagatttgtcttttaaaaagctgacccaaatacaaaccatctccaatcagtttctcagacacaagtcagaatatgacattaaaatccagtgaattgcactgatattttctcttacagacaaacctagtctgtaggaaaataaattactctttctctctctcttttaatttaactaagggtcttgctctgttacccaggctggggtatagtagtacaatcataagctcactataacctggacctcctatgctcaagcaattctcttgtctgtggcctcccaagtagttgggactatagccacaagctaccatgtctggcttttttttttttttttctggtagagacaaggtcttgctaagttgccagggctggtctcaaactcctggcctcaagtgatcctcccatctccaactccccaaagtgctgggattataggtgtgagctaacacacctggccagaaaacaattttctctaatgaattaactgaaaagatttaccacacagcgtgtctatctttggaaacagcgctgccacaaggtacctggtggtgttcaagtacaaatccccctgacctgcaagaaatttcacctttaataatctttaagaaaggtcaaaagcattaacatgacagatgcccagggcacgagccaataaaaggaaaagttaactgggttatctctctcatatgtagttaaaacagcaaatgcttaatcatttaatttgtactgatgctgatttttttttttttttgagacagggacttcctttgtcacccaggccagagcgcagtggcgtgatcgtggctcactgcagcctcagcatcccaggttcaactgatccctctggcctcagcctcctaagcagctgggactagaggtgtgtgccaccatgcccagctaatttttatattatttatagtgacggggttttgccatgttgcccaggctggtctcgaactcctgaactcaagcaatccacccgctgcctcagcctcccaaagtgccaggattacaggtgtgagccactgtgcccagcccctgatgctaatttttaaatggacatttgaattctcaaagaaatttgtgttgcctcttgtcaaaccaggtcactgaaatgataacccacacaataagccaatgagaaggaaaaaatatatgggattggaaaacagaatgaaaatcaacattaaaattccataattaaaacacgcagatagaaaagaatttatctgacaacgtgctaagaaccccctgtcctgtgtttgctgtcatggggagggaagaatgtctgcagcacaggctttcccagtctgattcacagccctgttatatatgaatgtgcacactcgaaacaagatctgatctggacaatagtcaagtctctaaaagcaagggagttcaattaattttttaaataaacatttcactggattttttttttttaatgatcaatcctgttgacagttttcccgtccatcttccagaagaactcactactcaaccaactgcctggtattcagctgtgactgtgaggatggataactatatttccttaagaaatagcaggaaggtatctcatccaagcagaaaataagaccaacagttgtccaggtctcagtggttctgcatttcttcctaaaagagaaatatgtctctaaacatctctttcccgcctcatggggttgggggaagcaatatgctcagaaaaattttaactactccaggcagctgaataaaacaagctgaaaaccctagatgtgttctccacattactgtgacagaatgcaagtgtgtattcgaaagatttcctcgctggaattataaagcgtacagcaagccagcctgctgtactgccacctcgctcttgctcccagactccctcccatggactaagcaggaacgaacatacgagctgtgaatctggtaggggaaacaggaaacatccaaccaggaacacactggagagaagagaaaacagttaaccacctatgagaagatggcgctgattccagcaggtgacaggtgggacgtgaagggcattcccggccctccagcagaagcaacgtcacggagctgggtgctgggtgggttgcaccgttctgaggcagcacggttctctccaatgactctcacacaggaaccagacctgactctgtttcttccaggacggtcctccctcactccacagcctctcatggcagctggacacccaccagggctggattccacacacagaaaccacatccaatgctctgttactagaagtcgaccatctggatttcaaagacctctgtctctttctgtcctttgttaatcagtctcccttcccactcaaccctctcccctccatgccagagaaaaggatttttaaatctgatgagtttttcagggaagcagaaatgtgagattacactgttctttagcctcacctcatggttttgctacagagatcaacgtcttctaacacagctttgcccatactcttcctgaggctgaaccaaaaaatctttcatgaacagtactgtctccaccagcagaatgtaaatataccacagcactgacttcaaaacactgaagtagagagtcttaactctccttagacagaaggcagaaggctgcaaacatcccccagcagactgcaattgtgctgttccaactgacaagcccagtaagcactgcccatgacaggacctcctgcagaacttctcccagcctggcggacagcggggcaggggtcaccctcagaggctcgccttctctttgctccctagccatcacactacactgggatgagacacaacaagcacccaaatgacacagtgaccatttcttttggtcactgaggttcacgagatgggctgtttttctttttcaatcgaggagctgaaatcctaccagccacctaacaattaacaaccccaaccctgtccacggttaaaatcaacgaaaaaagcaaggccaacttcttgtataacttccttcatacgggaaaaacatcaagttcaacgtgtgttaatcaagtgtcaggtcaatgtaccacgcaaatatatttgatgttttttgctaaggccaatactaaactgttaaacacagagaatatgaggaaaaacaaggttaaaaaaagtgtatagatgtccaaccctcttttaataattccaaaaaaacacaaagctacttaggcaaaaataaatcacaaatctattcaggagcactgtaaaacggaagagaattatctaaagggattcaccggctactgactaattttaatatgaaatgcctcacaaatctccctgtgccaccaacaaatcaccagctgaggcaaatcccagataatgaaacattgtaagaagggctctttttaatagtttagcccatcaaggagtgagtattgattcttattttcagcagaaggagacagtcttatctccagccttacagctcagtgacaacatcagagaatttaatcacagagccttttctgccatgcaatccttaaactgtcacctaggattctgtgccattcctcatccatttgtagagaaactcctggtctcacagatgtgtctgcctacttaaaccacagtaaccatattatatggttggctgtgtcccacccaaatctgactttgaactgtaataatgcccacgtgccaaggacgggggctgggtggagataaatggatcacggcggcggtttccctcacactgttctcatggtagagaatacgtctcacaacatctgatggtttcataaatgggagtttccctgcacaaactctcttgtctgccaccatttaagatgtgcctttgcttctcctttgccttccaccatgattgtgaggcctacccagccacatggaactgtgagagtccattaaacctctttcctttataaaaatcacccagtctccgtatgtcttaattagtggcctgagaacagactaatacaccatagcagcacttcaagtcctacagattaaacacatctatctatcaattaccatttgccagctgtttttctttaagaattttttaacaattcatcagatatctttgtgcatttccaacttgtttgttaagaaatctgctcagtatcttaagagcagattgaaaatcataataatagctgtgccaattctctggacatctgtggatatttgtaatatatccaagacaatgccagtaacaaaagaaaaagccagggggaagtgatagcgaaatcagtcattatttccttatcctgacataggaagatcagaaagtcccccaccttccagagaaaattaaccaaatactaaagttagcagtaatattaattcaaaagtgtccctgcatctttaaatactaaaaaagtactcaaaacacagaaaaaattacactgaaaacaagccaatacttttttttttttttttttttttgagacagaatcttgctgtgtcacccaggctggagtgcagtggtgcaatctcggctcactgcaagctccgcctccagggttcacaccattctcctgcctcagcctcccgagtagctgggactacaggtgcccgccaccatgcccggctaattttttgtatttttagtagagacggggtttcaccgtgttagccaagatggtctctatctcctgaccttgtgatccgcctgcctcggtctcccaaacttttttttttttttttttttgagacagagtcttgctatgtcagccaggttggagtgcagtggtgtgatcttggcttgctgcaacctccaccttctgggttcaagcagttctcctgcctcagcctcccaagttgctgggattactagcgtgcgccaccatgcccggctgttttgtatttttagtagagatggggtttcaccatgtgggccaggctggtttccaactcctgacctccagtgacccaccctcctcagcctcccaaagtgctgggattacagggatgagccaccatgcctggccaagccaatactttttaattcaagtacaaatcaaactacatcactgagaggaatgttccccaatccagttacactaccctactatccattatcactgttgctgtgaataattagtacccccttccagggagtggggggtacagaccacgtgacagtgggtgtcactgtggtgacaagactgtttgagagtgggaggtgggagcaatcatttatgctggtaatttgccttaagatgttattcccaaacatccttccatgatcctttggattgagataccttaatcccaactgccttcatgtccaaggtcaccacacacacacacacacacacacacacacacacacacacacacacatcttccttccatgatcctttggattgagataccttaatcccaactgccatcatgtccaaggtcaacacacacacacacacacacacacacacacacacacacacaaacacacacacagacacacatcttctattagagagaaccgaaggcatttgacagctgcctttttaggtccttctgcctttccatccaaactatccatcgttaacaaggccctatggcagtgcagcagcgctctccattctaatcaggcatcgaagagaaacttcactgtctgtaggctgcaaccaagggcagcagcctcacaacaaaagtgcaccctttgtgtggcaatcatttacctgttgtaaaagcacagtacccttctctctaataaaaattcgaaaggccaaaaatcagcattacataatggccaaacataaagaaatgaaaagcagtctgggtgcggtggctcatgcctgtaatcccaacactttgggaggccgaagtgggtggattacaaggtcaagcgatcgagaccatcctggccaacatggtgaaaccccgtctctactaaaaatacaaaaaaatcagccaggcgtggtggcgggcgcctgtagtcccagctactcgggaggctgaggcaggagaatcacttgaacctgggaggtgaacgctgcagtgagctgagactgcgccactgcactccagcctggtgacaagagttagactccatctcaaaaaaaaaaaaaggaaaagaaaacataataaaacagcctcacgctatgttcactggaaaatttatatgcatgtatatgttttataagttatagaagcccataagaattccaatagttcaggggaaaaaaaaagaaaaaaaaaaaactaaacttgagctatataccgatgtctacccactaaaattactaaaactatagccaggaatacttgtttggtttcgtgcccctctcctttacaagggaggtagaaagcaaggtggagagacacccaacagtcacttccgttttaaaaaacaaaaacaaaaccaaaaaacttacacacagcagatttttctggctagtattggccaatctttctcttgacagtattaagtgctatcctttgtgttaacagtcccatgcatttaatttattggtttaaaagaaatatttcttcatctgattaaaaaaaaaatcaatctgacttttctgtcttgtaattaaaacaaactatcaatacaatggatagggggcaatttctctgaaccaggagctgttccagacactggggacaaaaaggtgaatgaaacacagccccttctcttaatctagctaagaggacagacacgtacagaggcatgatgtgagaatgatgctggctgacagtgcctctcaggcagaagcgagagatgactggaagtgggaggtggagaggagaggctcacttttatttttcatttcaatgtataccttaatatttttaacatccatttttggaattacatgttttacaacttcattaatagagttcagaggcacaagattttggctctaagtttacatataactaagtagtactaccataattatcacaagctggtaaataaacaagatggcctcaatgtgccaagggcacatttatgccaaacaaaggcaaagtcacttcatggcaagctgtatttacactgatggtttctgagtggcaataactgaaagaaaagcaacaggaaaaccgagtcattacaaggaatccagccgtctacacaaaccaggcaccatcccagcatccaagaacatgggccataaggaagcagtaacagttacatcacaagcggctacttatttcacaacatcatcgcccagtctattaaattaatgttggtagtcagaactttattggttttgtagtttggtttgaaattaatttataaactgccttttatagctgcattagggatataagcacacaaattatacctaatttgtgtattggggaagggaggaaattaagtaatatagaagaacacaaaaactatttttgaagtaaacatactcaagtttcaaaaacatgaaagaccctggaactgcatcagaagttccacatcctcaacgtaagcaacataaggaggagaccctgtctttacaaaaaattttaaaattagcagggcatggtggcccgtgcctgtagtcccagctactcaggaggttgagacagagaggccgaggctgtagtgagccctgaacatgccactgtactctaggtgggtgacaaagcgagaccctgtctcaaaaaaaaaaaaagaaaagaaaaaagaagaagttccacatgctgcaaaggacaagatcagatctacttttacactagttactggagttggggacaagccttcatttgctaatgctggccatccatcagaatctcctgagaagtgcttcaaaggagtatggattcctgggtttgactctggaacaaatgaatcagtattctcatcttacatgtgaagacagtgggactctgaaagattaagtcacctgatcgtacaactagtcaatgggtaaccaacatgattcaaaccgatactatgattttaacagtaaaaacgtgaggttttttaactacctccatgatctgggggaagggtatactgcagttccctgaactactctttcaacttctctgtaagtctgaaattattttcaaatagaaagttaaaaacaaaaactaaaaagaatagacagcaggctgagacgtgttaagaggtagaggtgggataggaaatggaaaaggatgaggcagaggcctctgaaaggagggcagaggcagagctccatctccacacagaggaggtcggctggttttcagttttgttttgttgtgggggaagaggaggtaccagtcaatagcaagctgaggagtttaaaaaaagaaggaaggaaggaaggaaggaagggagggagggagggagggagggaggaaggaaggaaggaaggaaggaaggaaggaaggaaggaaggaaggaaggaagtccacatatctgtaaggtgggcaataaaggaacgatctttctgtatttctctacattacaaattcaaactagcatttacgaacttgccaaaaaaaaacctgtttatgtttatagagaaatgcattctgaagtccaaacaactgaccacacaacaatttctaaacccttccactactacataaaacatctgcttctgtgctaaacttttgtaaggcacagtttctgcttcaagaaaatctgtgatgcttggaattgaggtttatcttactgaagaaaaatctgaagaaaagtgtttgccacccatacagctgataattttttgtaatcctaatggatcagtgggaaattgtaccacgaaatctcttgtcagtcaatataacaatgtctctaactaatttcagtaaagtgaaatctacagttattcccttgaaaaacaggacaaatcaactctttcccaacttttttcttttttttcccgcaagacggagtctcgctctgtcgcccaggttggggtgcgatggcatgatctcactgcaacctccacctccctgattcaagcaattctcctgcttcagcctcccaagtagctgggactacaggcacatgccaccatgccctgctaattttttgtatttttagtagagatgaggtttcatcgtgttatccagtatggtctcaatctcctgaccttgtgatccacctgcctcagcctcccaaagtgctgggattacagatgtgagccactgagcctggccttcccaacttactttaagaggtaactaaaggacgggtgcggtggctcacccctgtaatcccagggtgattggattgggaggctgaggcgggtggatcacctgaggtcaggacttcgagaccaccctggccaatgtggtaaaaccccatctctacaaaaaatacaaaaattagccaggtgtggtggcacgtgactgtaatctcagctacttgggaagctgaggcaggagaatcacctgaatccgggaggcaggtgatcatgccaaaatcatgccattgcactccatcctgggcaacagagcaagaccccatctccaaaaaaaaaaaaaaaaaaaaaaaaaacccctaaaaaaagtgataatagattatctccattactggcagcagaaaacaaatttaagtgttaaataccaaactttttttttttttttttgagacagcgtctcactctgtcacccaggctggaatacagtggcatgattatagcacactgcagcctcagcctcctgggctcaaacaatcctcccacctcagccctaaaagtagcagataacttttgaattttttgtagaaacaaggtctttctttgttgcccaggctggtctcaaacccctaggttcaagcaatcctccagtcttggccgcccaaagtgttgagattacaggcatgggttaccacacccagccaataccaaagttttacattacataggtgaagctagtatccaactattttccaccaattaccatgtaatatggttgaaattacacgacctttcaaacttccagatacaggtgacaaagaacatttttaatataatttctattttcaagatttaaaaattctatctacttttaatgtctacctagctgtcacctcaaaaaattcaagacagattctaaattttaaaaattttccaatttatgttccaggaaatttaagtgaaagggaggaaagctataactaaaatttactaatggctagtagtactaatatacatactttaaaaaaaaattaccaaggaataaatatttaggatgctccagagaaaaattatatctgtaagcagtttcaatctcctcattttatgaatgttttggttacttcagctattaagttttaatcaagctaaaaaataggcctttttccttccatcttaagaatgtcaatgggatgaggagggaaaagccaaaaggtgggaggaatagagtaacaaacttttaatcagctagcatgatttaaaggacacacacttctgtcctttaacacagcatgtttcttgaaaataggttactagttcctaaaaaagaacacaaaagctatttacaggctgaaaatctaagattttctattctcaaattttcatttagagaatacattttgggacaagagggaaaaactacattcattttaaggggataggaaaagtacctgatacgatctaatcgtaaaacatgagatcaaagataagaactgaaaatgcaacttccaggcaccaggcataataatttatatagactctaaaaaaggattaactttaagtgtattacttcaacttcactccagtccttagaaacatttaatatccttgggaaagagtaccatctcttcttccattgaaggccttgatatttatagaagatattgccggccagacgcagtggctcacaattgtaaccctaaccctttcagagactgaggcaggtgaattctttgagcccaagagttcgagaccagcctgggcaatgtggcaaagccccgtctctaaaaaaatttaaaaattagctgggtatggtggcaggcgcctgtattcccggctactcaggaggctgaggtaggaggatcatctgcgactgggaggttgaggctgcagtgagccattatcaggccactgcactccagcctgggtgacacagggagataccctgtctccaaaaaaaaaaaaaaaagatattcccatcaaaaaatactacgatatcctaaaaacaaagttagaataagtaaaaccacaagcttacttccatggcctgaaatgtctttggcaattctattgctaaaaataaagcctaggagaagccccgcatatttgtttttatatatatttctttttttttttttttttttttttttttttgagacggagtctcgctctgtcgtcgaggctgcagtgcagtggtgtgatcttggctcactgtaaccttgaacttctgagttcaagtaatcctcctgcctcagcctcccaagtagctggtactagagcctggtactatcacagccacacaacaccatatctggcttttttttttttttttttgagatggagtctggctctgttgcccaggcttgagtgcagtggtgtgatctcggctcactggaacctcttcctcctgagttcaagcgattctcctgcctcaacttcctaagtagctgagattacaggcgcccgccaccacgcctggctaatttttgtatttttagtagagacaaggttttgccatgttggccaggttggcctcgaactcctgacttcaagtgatccacccacctcggcctcccaaagcgctgggattataggtgtgagccaccacacccagcctaacgtttttgtttttgttttttttactttctgtagagacagggtctggtcagagactggtctgaccagttcaacctggtcttgaactcctggcctcaagcactcctctctcctcagcctcccaaggtgctgggattataggcatgagccaccacacccagctgttcagatattttttcaatcaactagtacggaacaagggctgtgccaagtggctttgtaatcttagcactttggggtactgacacaggaggatcccttgagtccaggagttcaagaccagcctgggcaacatagggagaccctgtctctacaaaaatttaaaaaatttttaaattttaggtagcatacacctatagtcctagctacatgagaagctgagaaaggagaatcacctgagcccaggaggttggggctgcagtgagccagaatggtgccactacacccctgcctgggtgacagagtgagaccctgtctgtaaaatcaacaaaaaaaccccaaaacatgaaacaccccaagaaaggcagggctgaaagtcctaacagtgcctgtaagtaataaagagcaatgcactatccctgaaagaacaagaagctcaataaaacttgcaaaggatcattaaatctaatatatgcctatggaaacaaaaaggcatttaaatcgtaggcagttataaaagcataggtttattgatatttgtgatctaaaaatgcggcttgatgccccttttggaaaaaagatgatgaatatgatgaaaagacagtcttaagaataaattgactgggcacagtggctcacgcctgtaatcccaacactttgggaacccaaggcgggaagatcacttgaggtc

SEQ ID NO: 45 - DNA, 9442 bp, Homo sapiens
ataattgttaaattggattgaaggctatgtgcatgcagcttgctgagagaccaaaggggcatagctctgcttagcacaccactagaggctgatttttcaggagagattggctatcatgtagatttggacgaggaaagggtctggtgcactgaagttctcctgggcgagaaattgcttaggtctgatggtgtatttactgggtcttcttgtcattcttcatgtcacagaaaaccttttctttacatcaaagttagcctgtgcactgatgctaggagagttggtgttttcttcctttgtagttttggggcatgggctttgatctgagtgcatttatggatgatcacagggctgtcacccaagcctgttaaaatgttcacaggtgcttctggctttacatgacaagggggcctattcaaagataacagttggccggtgctgagcctccaacatgtaaataagcattgaatgtgatcacttacgaatagttaattttatgttgcatccagaacatgctctataacatagtagttgatccacagacccattaatgcatctaagtgaggggtctggtttaatgaggctattcagcatattcatggtcctgcctctggtttaattctgtcactcaggaatccaagcaagcccagcaccatggatgctgcctgcacctgttgtgctttatcaaagagtgacttttaagttttttgtactatattaccaaatgttcagagaaggaagttttcatgagggccgtgaaataattggaacaactctttctaggaagtcatggaccatgtgagttcattctgtagcattcttattttttcaaagcactctgtcatttcttttgtattgcattcttgtgaagtaaggaaggcaggcattcccagccccattttacagatgtggaatctgagagtctgagtttagtggcttgtacagagtcacatgggccctgagacccaaggcctgagacccaagccctgatttcctgttttgtggtcattgcactcttttttgcaaataacaactcaatggacatgtcaaagtggtgtacacaaagactgagtacacttacatatagcacactgagcacacaatgagtttaatatgtgcaaattcctgagtaagagttgttaggatttagttttgatttgatactcaacagcccctctttactgccacacccgtgtttcaacctgttgctgaccattctctttaacagaggcacacacacacaaatatgcatttaaggatgatcacactgctcccacaaattaaataaaaagttattttggaagaaagacggatgatgtcattcataattagacccattattgaacaaatggctatcctgtgtaactctaggctggacatagagaaggccagaactttgcaaaagaattgtccctaccctgagaggctggcattgtagttggggagatgagaagatgcaattagataacacagggaagtgtgtaatcagttgtccatcatgagctatgaaaacctttatttccctaggattttggggaaagtagggtcactgtgggatggaggagtcaaggaagcagcatgggtccttaaattctcgtaacaaaggatcttaggtgctaggtggaatttggatgaagggaatgggaaaaggaagacgattctatcacactataagctccaaaaatttggggttcagagaggaaacatcagatagctgtaaagagaagggatccatcgtcttctgattatatttgttagtttccagaggaacttacagagtgcccaaatcactgattcctgggacgttttgcaaataaaagtcccaagggtttaggtataaaaggataaaagcctggaccaccaaatgtcttgcagactcaatactttggactttagctgtgggtgtcccagatttcctagttgtcattgctatgtcatcaccatcatcattatccacatgtgacatgtttgcagagctcttgatgggggaggttctgtggtattagaaaacttgtttccctggagtctccttaagaatataaaactgaccctaaatatgaatcagtattttaccaagtaattgccaaacagcaaacaagtatgagctcagagggaagagttaactttgggctaagatatctaggatggtttcaaagatgagatgggacccaactggctcttgacaagtatgtgggctcagcgtgttagatgaatgagtagaagatgaatggcaagaccattgcagatctttgaaaagaccttagaaaactacctttggagatgtgtggaagtaggaatatgatggcatgtttgggaaagagtagaccagcttttttgaagagccgggtccttgtgggatattaggtaaaaggaggagaaaggggctatgatatggggtctttaatgtcagtttgaaatgtctaagaatttagatacaaagtattataaaaccacaaaggtaatcaggaaattctagattgttggaaaatcataggagctaatagattttttaaaatatgaatgattctaaaagatggatgatttgctgttacctgttatggtaactgcatctggatgcaatgtgagctttgttctagtagcaattcattatgagatacttacagattattttctcacctagtcttgaataaaaatgtaataaatacccatccaaggggctgttgacaaattgcaaacataatatgccacagaccagaattaagtcaaagcattgcctaaggttgggcttcagagtcacaagtggttgcttggacgctgagctgtgattttaggagtgggtggtttgccctgagccatcggcattctgcttcctgatcactttgtgtaggaaaataaggtggcctgaggtgtgcattccctgtactggtcaggaagctttgagtgacaagtgaaagaaatgaaactcaaaccttaaccaaatgaaaaacttaactaaaaatccagcatggaagtagcttcagtcatggctggagccagagaggctcagtgtggttatgagtctggctttttctctctctgtttccaatgctgctttcctcattgttagtttcatgttccagcagactccatgtgatgggaaacgtgtgttctggcaatttagagcttgcattgaccaaaggagagtaggtatatattctctttctcttcctttcttcattttatccctgaaattgttgaccccacttggatcatgtgtctaccccacctctggaccaattactggtcagcttgaggaggcagaactctctaattgacagcctcatcagaataaaatggagtcgggagagcagtttccgaaggaagggacatgggccagactaaagtgggggtgggtagggagggagagatcaaagtgataccaactgatgctgactgtcacggggtggggctttatggtcttttggctttaggtgctctccggtccacacagccagcctcatgcctagaataaaaggcaggggctcagccttagcctggagtacaacaaaggatgtgaatatcagagacagggacctattggatctcacagccaaccacagcccaagctttttaagtctgtagaaagtgacttacctctttgaatttttattccgaattccagttaaagttattcatactgatagaagactattattgcttagccttcagaagaagaagaggttgaagttcttcccttagaagttaccagaatttaattcgtggaaagttttccatcttgcatttgctgtacttggactaaggctcttgtaggagataaaatccctggcttttgttcctatttactgtgagttctacctctctggaaaacaatctgggcctggagaaaatatacataagcaatgtttagcatttacctgttagggtcttataaaaatctcatagcaagtgcagttaatacatcctttccaaaccatttgtttggagaaagaggacaaggggtaggagacggatctgattttctccatttggctgatacaggaagtagtacataggagggttaagagattttcaaaggaatattagtggcaaaactgaaagacagaaaattgcactcttaattacaaatcagttttcttaacaatcggtctttgtcttttctgattctagtatgttatttcctttcaaaagggtagcaccttcaacagtcactttcactggagagcccattcaaatccattggtgagcccaacggatcgtagccaagaaatcatttaatgagatctagaccattttacaaggcatgctgggtttccatttattgtagtactgcattcaatgtgtgcatttctctgatttttctttcaaaatagaatgaaaaaactttgttttctgtagctttctcactgattgctaatcctaagtgcagtggtaatgaagggtgtagctgtctggttcaagagttcaggcaagagtagatattattgacaagaggcttctaagcaggtatcaagtattgaataaatttgttttgtgatttttttttcggtattgggtagaaaaattatcctttccagcactctgaacatcagtaatattttatttaattttggctgctattgttgatgctcatgttgttattatgtgagtttgtgtgaggagctggtaaatttcttttgtaaaagggcatattgtaaatattttggttttgtgggccaccgggtgagctactggactctgctattgtgtgaaagcaaccatacacaatgcatacatgaatgggtgggcctgtgttccaataaagctttatttactgaaacagatggagggtcagacttggctcatgggcagtagtgtgcagactgctggtgtatacagtctgttggattctgtctatgcggaccgctgtgtttgagcacaatggaaacacactgtgttttcatatggtttctgcagctgccatccagttcccttccttttcccttcagaactgtgttacaggatacaattaatatcactattactttttgagacctagtctctctttgtcgcccaggctgcagttcagtggcacgatttcagctcactgcaacctctgcctcccaagttaaagtgattctgctgcctcagcctcctgagtagctgggaatacaggtacctgcccaccaccatgcctggcaaatttttatgttttcagtagagatggggtttcaccatgttggccaggctggtcttaaactcctgacctcaagtgatccgcttgccttggccttccaaagtgctggaattacaggcgtgaaccaccgtgcctggcaggatacagtttttaagtgatgtttccaagagctccatttccaatgtttgcattttcatcttaagagctatgaaccttggactgtactcaggggcctgattttagttcttcagaagcaaagactgtaaaaatcttcctgttctggtgctggggttcaggtacatggtctagtgaaatggcactagacaaatgataatagagtgctagactgggtgaccctgagcaaaccacttaatctcactgagtctggtttcaactatacgaatatctagcttgctcattccacagggttgttgtgaggatcattcattcattcagtttctctttagtgagcacatacttcctgccctggcttttgctaggcattggagaaataatggcaaacaaaacagggaaaggcctacccttatagagcttactttcaagtgatcaaatttgttgatgtaagggagagaacacttcaaatcgattgattatacaagaagttagattttcctgaccattttaaacaaatagcatcccaaagtccaagggaaattttggtcattttattaagaagttgaagtctcaagaaagccagttggatggcagtttagataaaatgattcgggttgagggccagggcagggaaagaatgaaaaccaagtttaaaagtggcctgataggtcaaatggtatttctggttctagatcctcgaggaatcgccatactgtcttccacaatggttgaactaatttatgttcccaacaacagtgtacaagcattcctatttctgcacagcctcgccagcatctattgtttcctgaatttttaataattgccattctgactggtgtgagatggtatgtcattgtggttttgatttgcatttctctgatgatcagtgccatcatcctcagcaaactaacacaggaacagaaaaccaaacactgcatgttctcactcataagtaggagttgaacattgaaaacacatggacacagagagggaaacaatacaccggggcctgctggagggtggggggtgaggggagggaacttagaggatgggtaaataggtgcatcaaaccaccatgtcacacgtatacctatgtaacaaacctgcacattctgcacatgtatcctgtttttttttttttttttaagaagaaatgaagaaaaaaaaaagtggccttatagagctgctttctactaaagttcacttctgaaagaaatcagagaggttttcgactccatcagggttccaaacctgaggagattaccattaaagtcagctagtcaagggtaaaaattagagtgtaggaggattcattttgaaacattgtcagcaaccagctggaaaaaaatagcagcgactgtgattactaggaaatttcttggagggtgtagaagtgtatcaggtaatctaatctgtcacctacttcagtggcctttgggtggttggataagcatttcagtttagaagtaaatatcactgaacaggagggagaataacatggttatttaaaactctgaggccttttggccagttttggatttgttgtcagccagacctgatagctcatccaagtttccttctatgactttttttttttttttttagacagggtctctcactgtcgcccaggctggagtgcagtggcacgatcatggcttagtgcagccttgacttcctagactcaagtgatcctcccacctcagcttactgagttgctgggactacaggtgtgcaccaccatgcccagctatttttgtttgtttgttttaattttttagggacgatatctccctatgttgcccaggctagtctcaaactcctgggctcaagcaatcctctggcttcagcctcccaaaaagctgggattacaggaatgagtcaccatgccccagctgacttctacaggttcaactacaatatttacagagggagatctttgggtcctgggtgaggagggaaactggggatggggtagggatgggtaaaggggtcaacaaattagaggcagacctgcttacagccttctgaagatagactttctgcagaatgaatgtgaaaaggttttgtaaagtgtaatggaccaatttttccctagtactctagggaatgtgtgttccatccatgcagatccttgcatcgtgcctgtaaaatagcaaacatgcaagcaactgtggaaaggatcatctttgccatcttatgttcagtgttccagccataccaactcatttgcagatccccaaatgcactatgtgcctttatagatgctgttttggtgcttggcctactctccccctctactttgccttgctagctcttgcatcctctttaagagtgtacacaggtgccctttccttcctggaggttttcttctctcctcctccaccacaagtctggttcaaatgctccaccttaaccccctcttccctcatttcccaaccccagatatgtctattatagcccatgtctcaataaattgtagtcatttgtattttatggtggagaccaattcttggtaattgaaaaatttgtctgaactttaggggaatcattaaaaaatacataatgccctggacatattattttaacttaaagtttagagatgtgtatttatttgctcatcttttgatatgggcaggccttcgtttttttttttttttttttaattggtctgctgattagagttccggattatctttcttgtttaactcacatccataatacatcatctatgatttccagtgcccgattttttttttcatggaatagaaaccaactgggaaagcaatttaaagactctagattctccctactcccagtattttatacttttcccactcacaccgaattaggttcaactacatttttaagtgacttacctttatcaggtctttgcaaaacatttaactaaactttgacagaagcttttattggtactcatcttctgttgatttacatattacttaattaaacaatgtaattataatgacatgtaatgacaatgataaatggttttgagaatggacacggttggctcctgtaaacacatacctcagttgtgggagaagcagtgcttgtgtatatgagaatggaataacaggtgacccgactggtaggagtagcatgaagtaggcatcagaagcaatggagaatcccagttaatccagcagctcagtggagcacaagttaagggagcaacatagattgagctagcccagtgcctgttcgagtggatattcaataatttgttaaataaatgtgagaatgatccaggaagtcgagaacttctggggatatgagcttcaggaccactggatttgaactcgtaattggccatctcctctacctagaggggtgctgggcccgagtcaaaagcctagaacttaaccactgtctgcaaaatgagactgtgaagagaaatctctctccaataacagggtgcagatttcttgccgaggctgctagctgttgctgacgagtgagtatgaaagtctccctccttgctccctggatgacctctttgccattccttcttgtttaagctcctcttctttggctctgaaacctgtgaaatgtttggagactagagtttcttttgtttgtttgtttcttttcttcttctttttttttttttttttttttttttgagaaggagtcttgctctgtggccagactggagtgcagtggcaccatctcagctcactgcaccctctgcctcccgggttcaagcgattctcctgtctcagcctccggagtagctggggactacaggcgtgcaccaccacgcccaggtgatttttgtatttttagtagagacaggctttcaccatgttggccaggatggtctccatctcttgacctcgtgatccgcccacctcggcctcccaaagtgctgggattacaggcgtgagccactgtgcccgggccagagactagagtttcttgagagatatactactgaaagaagctatctgtattaaaattcagtatgtgtaaactactttaatgaacctggttccaccgtagcatatgggaagtcagatggtaaggggtgcgatgtatgcatcagtgtccctctcctggtatagtcccacttccctgtggataaatttaccttacctatagggaggcactcacaagaagcttatgcacacacacatacacatatgtacatttatg

SEQ ID NO: 46 - DNA, 7969 bp, Homo sapiens
aaacagacattgttttaaaaacccatttgtaataagtgtcagtaaatatgatctttcgcttcagctgaagcaactctatggcatcagtttacacctccacacttacttggaagtttataatgcttgttttcagcagctttcacacctagactccatacgatatgtaccagccaccaagatgtttaccagtcctcagaagggcctttcgagaactcttaaaacttaatttgttactgacgctttgcttaaaggacaatgcactttaattagccacaccactggccctttattcacacacatgaggtaagctggacattccaatgcatgtgcaactgggaaatttgagtcctttaatggttttcaacaattaactagggccggccaattgttaggttaaacaaaaagcactgtggcaaaacttgactcacttcactacggctaataattacaaaaggttgtgctggtccatccctcactctacttacctgccaaagtttcaggcaaagtctcaacaattgggatctaacctttaaaatcatttctttaatgttgacactccaaattgtccataatgaccctacattctgctcctactgttaataatcaccaactacttaatagtttattaaaaagttagcaacagacaaatacaaagaacaatgtttccactgtgtaccatacggattacagctcttggacctttgcttgagaacacagctttccaaggcccaaagcacagcccctgtcatcttcatacttcaaatgcagacatgcaagatcaataactcaaggttaacttttcttagatgatagataagatagctaaacttttttaaaagcctaggtaaaaaagagatgttttaaacatacccttggctacagctcaacttttaggtagctgatcctttctccattcctgccttctttccttcaagcttttctacaatatagccttatggttggattttatgttaaaatgtacgaatgtggccgggcgtggtggctcacacctgtaatcccagcactttgggaggccgaggcaggcagatcacctgaggttgggagttcaagaccagcctgatcaacagggagaaaccccgtctctactaaaaatacaaaattagccaggcgtggtggcccatgcctgtaatcccagctaactgggaggctgaggcaggagaattgcttgaacccaggaggcagaggttgcggtgaactgagatcgcatcaatgcactccagcctaggcgacaagcaaaactctgtcacacacacacacacacacacacgaaagtacgaatacccaaatataagttggatgatataattttgtaagagaaatccggccgggcacggtggctcacgcctgtaatcccagcactttgggaggccgaggcgggtggatcacgaggtcaggagatcgagaccatcctggctaacatggtgaaaccccgtctctactaaaaatacaaaaaattagccaggcgtggttgcaagcgcctgtagtaccagctattcgggaggctgaggcaggagaatggccggaacccgggaggcggagcttgcagtgagccgagatcgggccactgcactccagcctgggcgacagagtgagactccgtctcaaaaaaaaaaaaaaaagaaatccttatttgccaaaagttgcatatgcatagggttatatttcacataatacctaaaacaaagacccaaaaagtggggacggttgcactagagaatgcatctgcagaaaacctaagtaattttatgagcagcactcaagtttactgcttcttttatgattcttaatcccgcctactaaattcacatgtctttacaaatcccaaatctgtaacaaggccaccaaatgctcccaaattagcaaaatacagaatagccttttaactacaatacaagctttaactacaaaatgcagccaaactcaaaccagtttgatataattaaacatgttttatttaccttatattgtgaaagggcaaactggcctggcgaacttacttgcattaatctgagtcccctttgccaggtatcaaaatcagttccagtgaatggagaaacaaagataggaaagataaacatttatctgaaactacagttacataatatttggaaccataaattttttactgatactctccaaacataatctgctatttttatggctgtaatttagttatgacgtgtgccagcaataacagtcctgtgcactacaaattgtgacgaagattttaccaagctaggattgcagactgtaattttcctcacagcaagtaatgatcatatcaattagagtcatgtttttacccgagtcttataacttagctcagttagttataaaacactgatttcggaccccattttaataggatgcttaaacaagcaaacgtgtggtatacggcaataaagtgagagacactataggttatatggaaacttgtgggactatgtgggagtgtattcacaccttatctaattgagatctttattttccttatttttctgtctctcaaaactaaattatctgaattatcataagaattagtacctcaggccctgttatgacctatcctgggaaagaaagtgtcctcgtggaaaagtcattcactggacatttttcagtccttatcttccttgacctctgagaaacacaccacagagctaaccattctttcttcttgaaagactttcttccctggcttccacgcaccactctctggatttcctcctacctctctttctcttctctctccatctctttacagggtccatcagtacttcttgtttcttctcattctatctgtaacctctctaagaaatctcaaccacaccaggatttgaataattatacacattccactacaccccattttcctcccttgggcatcttaaagtcacttcaaactcaatatgttaaataatttctccacttcttccaaggctcccagtacggcttgctacaattagaggcgccaccagccctgacattatacagccagcaatctgcaaatcttcctttcctcctgctttactcgctgcctttatccaatccatcaccaaatcctgtcaaatttacctgctaatatcccttcagtgattaaaatgatctcacttcttctcttttccagcaccactaaagcaacttttcagcaattaaatcactcttatgaataccttcattccagagtggcagaatattccagtcactacctgtgcttctggaactgtaatgaaaatttctatccctgtttctccccagtatggctcacatcagacagtcctcgaaaacctgaccagttttgggccagcagagacgtcactttcttgaaccaaaaagtcaaatcccagtctctagatcatggttaccccgataaggcttttcaccctgagacatcccatcaggcattgcatccagttctccagaatttaatccatgtctgtactctacccggtcctgaggttatgtgaggctcaaccagtaacagagacttcccacaatgcaaaaacaaactaatgctgtttttatcagtcaagtcatatatacatatatgcataataaatccttggaagataacacaagtaactgggaacagtagttacttctgaggagtaaacctagtgtgtgtcttggggttgcagggtggtggtggcagggaggtgggcagtacttttactgttcacttctttttttacttatttttttgagacagagtcttgctctgtggcccagcctggaatgcagtggcctgatctcagctcactccaacttccacctcccaggttcaagcaattctcgtgtctcagcctcccaggtaactgggattacaggtacacgccaccatgcccaactaatttttgtatttttagtagatacggggtttcaccatgttggccaggctgctcttttattttatttatttttttttttttgagacggagtctcgatctgtcgcccaggctggagtgcagtggcgcgatctcagctcactacaagctctgcctcccaggttcgcgccattctcctgcctcggcctcccgagtcactgggactacaggtgcccgccaccacgcctggctaattttttgtatttttagtagagatggggtttcaccgtgttagccaggatggtcttgatctcctgacctcgtgatctgcccgcctcggcctcccaaagtgctgggattacaggtgtgagccaccacgcctggccccaggctgctcttaaactcctgacctcaagtgatccacctgccttggcctcctaaaatgctgggattacaggtatgagccactgctcagcccctacttttcactttataactttcagttctgtttggactttttggtaagagtatgtattatttttataacaaaagccagctttttaaaaacaaaccccaaaataaatgaagtcagtaaaagttacgtttgttcattatagtcacatttaccatttgcttgggttttctcctttctgatgggttatcacacacagttgcagcctcaactatgataggtgcccaggtgcccctttgaaaacctaggctaagaagtgctttgcaagtgcaaactaggagaaagatattcagtattttaatatctgcagaaaagccatcacaaatgaatattttttttttaaataaacaacctagcatgtgtatttttctccagtcaccatgttttgactcctgagtctgtcactggcaatgcttaccagcagactagtcacaaaaaagaacagaaattggatttttgtacagtgttcagaattgagatgtgccacagcaaaattttaaaacaatgagttactgtagaagccacaaagacataaaatatattatgtactagaaaacagattatatacaacctttgtgccatagatttccattttaagactgaacctcttagaatgattattaagttaatgaaaggtatgattaattggttgatgcaaaaattatagctagaaggatggatggaaaaataaaacgataggtaagtaaatagatgaattgattaagagatggatgacagacacattagataggtcgttaagagagataaacagattactgcttctcaaactatctgtggtgaaggaccggggttttatttccaatctgtcaagaccagtatgtagtcctatggtggatggcttatacatagctcacaccacatgtgactcaccacacaagagtgacacacccaaactaccctgttccacaagataattgcattggtcacctacttggatgtcatagcaatgccattttgccataaagtttctaaatactctcaacttctctatctagctcttcataggccagttataattcaactgtacactggcatcagtccatggaccatactttgagtagcactaagctatataatcagttacttcccagcagtatgccatcagttcttattggttgggcatccactctaactggttattgaatttggtagaccatgcatcagccttgtataagaaggataagcagactgattgacagatagaacagtggatgacagataaattagataaccgactagctagctaacaaattagatgggaaccggagagctgttctttgggcaaagaatatttctgaataaagtgttaacaatggtactttctaaatgggggattcagagaagatcagaagaatttcttttccactttcctccctccaacagtgtttgagcatataaaattttaattaaaaagagaaagaaacaattaaatgtccatcagtaggggacatgatgtacatttaaattcctaagcaatggaatactatgtggtccttaaaaaaaacagaggtttatgtacagaagagaaatgaactccaagatatattatactaagtgaaaaaaaaagaaggtgcagaagagtgtgtacagtacactaccattgtgttgtgttgacatggtctaggtggatatctacattgatacatgcatgcttgtactcacaaagagtttctctgaaaaaacaaaaaaactagtgctctggggagggggacaagaggactggaggagagtgaaagaaagactcttcccagtaaatgcctttgtacttattttaggttcttggtatttaaatgtatttattacctctttaaaaacttttttttttaatttaaagaagtcacctgaaaacatgaactttcgagtttagaaaatgcgttcctgagagggaggccactggctgcccaggcagggcatcctcagggaactgggcctaggtgggccctggtgggatgactatggttccagaatctcagttttgtctgtgtctagttgatcagcctcagaggaactgagaaagtaccgaaaaccacaagagagtattctgggaacaagcagactcaaaagctattcatttacaagcagaaatgatagatccagcaggggcggtcccaagtcaagggtagcctggtatcccacttacttgggaagtaaagaccacccacaattttggaactgtacttgctaaattgaatataggatggagctatgaatggaaagataaaaagaccataatttccagactcttttaagtcagcataaaatgcttagttctctaaacaaccaggaagatctcaacataggtgacaatggtggggtcttacgctacagtcacaaaaagctaggactcgtgtatctcaaaactaaggagtgagaaagttgacatttactagcaaaaggtcaatgagcccaccctagctgaggctccagaacctcaatgggatgcataatcatctaccaaccaacacctatcttttaatacaagtcagtacaagctcctcttagtctcaaaaacacaccctcagcatttctgcctctatacctctcttcccatcctgtttttcctggaaggcttgtctgcacacctacctatatctttgccactttttgaaggttccatttatgtctaagcacctttatgagacttctctgaacacccagccttcattcatctccctctccactgcatttagtatctggagctctgacattaatcttgcagtcaaaggggcacagatacaatggaatgccatttccaagcatggaagactcctacgaattccagggtgcaagtttacaatgaaaatggctaaaaataaataatacaggattcctttcgaacacctactatgtgccaggcactgtgctcaagttaagcaatgccaagcaagacaaacatcgttcttcccctgatggaggttacagtgcagtaaaaaaaggaaaaccaaaactaaacaaaacaaaaaaaaaacagtaatatgagagtggagcaatgactgaggaaacagaagggcctatgggaggaggagcagcagcatctaatccagagtgggagctgcaagttggggaaaagttcctgcaggatgtggcatctaagctgatatctgaaggtaatggaggagttaagcaggcaaaaagcagggaaataatgttccaggcaaaggaaacagcttgtgccaagttcctgaggccagaaggagtacagccaatgggagaaactgacagacattctgtacagctgcaaatttcagacctttagtcatattataaatgactgacttaggacacaccttacaaaggcttccggcaaaccaaggtggaaggcagctgatccaggctctaggaccacaggtcgaaaccagctctttggcctggtttgtctgtgttccccttctctctccagattctgtcagctgcctgcggtgataaagccagccacacatttcttcttttaggacatactcacgatgctaacacaaacaggagttcaatgcttttttttaattttttttattttttatttttttgaggcagagttttgctcttgttgcccagtctggagtgcaatggcatgatctcggctcactgcaacctctgcctcccggattcaagcgattctcctgcctcggcctcctga

SEQ ID NO: 47 - DNA, 11094 bp, Homo sapiens
ggtcaaatgaaaatgtactttattaaaatattagtgttcttacagattaaatctgaagcacagcaatattcagttctcaggacagttctcaggatagaatgtaaaagaatgccaactcctatcagtccaatagaagtggaaaatcagagctgatattcaaaatttttcctgcatagaaccttagatgttttcagaaagaaaaaaatcaataaggaagtgcttcagtgatcactctaactgcaaattttacccatctccagcctaattcattaattttaatatcaagcagagccaccaccagtgcttatagtacctttgtgcatactagaaaaaaaaaggcagatgttggcctgcaggcttttggcttagcccaattctacctaatagccttgactaaaaaggcagttttcaagtgtgtgtgtggaaggtagggtgttaaaagaggaaaggagaggaaggccatcttcacaacgaataaagtaggagaaggaaaaaatccgttttacctaaagaggggtagttgattaatttaaagtgaaatcaagtagaacaaagtgcctgatggcataatcacaaagaatatccagtctagaatgtctgtgcggttttgtaagtttcattaataagtatttattaaatataaaggaattccctattctatcttgtcattcgaaaaataaaaccaagaaaaaaaaacttctattttttaaacttaaaatattcaattaaaataatttagtcagaccaagtagtttatctgcagatttacagaaatactttcaatcccatcactttagctcattaaatctgcaatgtaattagagaataaaagctgcatacttacataaacagttgatttgaggtcttcaaatgctttcaaaaatatgcaaggtttaccatctctgcttgtagatgaagaagctaaaaaaacaataaatctagccactgcaatggtgtcctacatagaaaaaaaaaagtttttgaatcaatcaccaaaatacgtataatttggaatgtcatataaatccttatttatattattatgtttagaataaaaattacctctataaagtagaaaactggttaacctaaacttgtttaacacttgctgaatacattatttagactaccacttcctctaaaacatcttcaacatctacagctacaatatagccacagatgacaataacgtcccacttcatggaccaggaaaatgctaaatcactaagaaagttttatgtagtgaaactcagatgttccaatagtaataaggatggaatttaaatgaaactaaatctcaaagttgagaaactacattgagaaaggcatgacagtgcaaaaactccacatattacaaaactaatatatgtgcatacaaatacagggcatggacataataagaaatttccatttatatactaataagaacaaagatattttctttctacttaggtttgtaacagtagtaagaagccattctccatttatcccttcctctctcattctttaaatttccttttcttattttccaaatactaaaacagaaatactaaaagagttttgcattgctgcatatatatttttcattgtcttactcccttaattttaacaacgaaaccttaagatacaccaaaatgtctgggcttttggtcatcttccttcaataatttaaaactctatcaagtggaagtcttctgcattaccacagtgtgctctgcacatacaagggcctggtgtcaattctcacaatcctctattcagatttaataattggactgagagcatactgaagatagtggtcatttctaattctgctctgtatttacaggacttggcacaaagcaggccctcccaaaacaaactgtctatgaatcaaacgaaagaccttattttgccttttctaaaaatctcttgccctaaccaggtattgtagctctgcaattcctgcgtttttttcttcacatgagattgcaaacataactgagtgtatgctgataatgccaaattaccacaactcttcatagttcaatgggagaaaatttttcttcttactgaagattttatatttctccgaaaccttttatgcagtttaaaaaaataaaatgaacatgtttctggaataaaaataacaactgagttaccttttttcagttttacaaactgaagtatacactctgttttcaagtgacctcaaaccaatacattctgattaaatgaaaacttgagattttagtcaaagatttaaagttgtttatcaaactaacaccggaagataaacagaagtagggaagccaacagtttatcagttctaaattatccaagtagaaaaaaaaacctacctcttgttatcctctgttccacttaaaaatgttttcaaaagtaaatattatacaccaaatgcaaatgttagagtacagatgaccattttttttctattttcctgtagattctaaacttttttaaaagactgagtatgtatgcatttcttttatcatgaagaaaaattttgaaaagaataaatgactaaaagctggacatcagcattcataagaaaaatttttctgaatttaacagtagctacacacaattcagtaaaaagttacaacccttcctctggcatatattcaacagcatggaaataacaatcacagttttttttaattgaaatgcatttattatattcataaacatggatttatatttgaatatacatataaaaactgcattgaaggcccttcagtgatctcatcccaagcaactctgcctgttttatttccacatacttcccattcaatattagacaaattggatcctctcataagtatagtgcttttccacatatattctttatttattttgagccactgctacaaataaataacatgtttcccatctgtacatatctgacctaatctatatttcaaagtctagccttcttcttcctggtagaatctatcacagattctctctcagaaacaagtaattctaccttcctctaaactctcctatacagcgttttagcatttttcactttgtatgttatttacaaacttttcttaatgcctttaaagcccttaaagtcctgtaagttccttggactgaaagtaatggagatcattccaagatggccgaataggaacagctccactctacagctcccagtgtgagccacgcagaagacgggtgatttctgcatttccaactgaggtactggggtcatctcattaggacttgttggacagtgggtgcagcccatggagtgtgagctgaagcagggcagggcatcgcctcactggggaagtgcaaggggtcggggaattccctttcctagccaagggaagccatgacggtcagtacctggaacatcgggacactcctgccataatactgtgcttttccaacggtcttagcaaactgcacaccaggagattatatcccatgcctggctcatcaggtcccatgcccacagagttttgctcattgctggcacagcagtcccagattgaactgtgaggctgcagcgagtctgggggaggggcttccaccattgctgaggcttgactaggtaaacaaagcggctgggaagcttgaactgggtggagcccactgcagctcaaggaggcctgcctgcctctgtagattccacctctgggggcagggcatagctgaagaagaggcagcagaaacttctgcagacttaaacgtccccatctgacagctttgaagagagcagtggttctcccagcatggagtatgagatctgaaaatggacagattgcctcctcaagtgggtccctgacccctgagtagactaactgggagacaccttccagtaggggccaactgacacctcacacagctgggtgcccctctgagacgaaggttccagaggaaggatcaggcagcaacatttgctgttctgcaatatttgctgttctgcagcctctgctggtgatacccaggcaaacagggtctggagttgacctgcagcaaattccaacagacctgcagccgagggtcctgactgtaagaaggaaaactaacaaacagaaaggaatagcatcaacatcaacaaaaaggacatccacaccaaaaacccatctgtaggtcaccatcatcaaagaccaaaggtagataaaaccacaaaggtcaggagaaaccagagcagaaaagctgaaaattctaaaaatcagagcacctcttctcctccaaaggatcacagctcctcgccagcaatggaacaaagctggacagagaataactttgatgagttggcagaagtaggcttcagaagatcagtaataataaacttttccaagttaaaggaggatgtttgaacccatcgcacataagctaaaaaccttgaaaacagattagacgaatggctaactagaataaatagagaagaccttaaatgacctgatgaagtggaaaaccatggcacaagaactacatgatgcatgcacaagcttcagtagttgattggatcaagtggaagaaagggtatcagtgactgaagatcaaatgaatgaaataaactgagaagagaagtttacagaaaaaagagtaaaaagaaatgaacaaagcctccaagaaatatgggactataagaaaagaccaaatctacatttgattggtgtacctaaaagtgatggggagaatagatccaaattggaaaacactctccaggatattatccaggagaacttctccaatccagcaaggcaggccaacattcaaattcaggaaatacagagaacgccacaaagatgctcctcgagaagagcaacctcaagacacataactgtcagattcaccaaggctgaaatgaaggaaaaaatgttaagagcagccagagaaaaaggtcaggttacccacaaagggaagcccatcagactaatagtggatctctcaggagaaactctacaagccagaagagagttggggccaatattcaacattcttaaaaaaagaattttcaacccagaatttcatatccagccaaactaagcttcttaagtgaaggagaaataaaatcctttacagacaagcaaatgctgaaagattttgtcaccaccagacctgccttacaagagctcccgaaggaagcactaaacatggaaaggaacaattggtaccagccaatgcaaaaacatgccaaattgtaaagaccattgaggctaggaagaaactgcatcaactaatgagcaaaataaccagctaacatcataatggcaggatcaaattcacatataacaatattaaccttaaatgtaaatgggctaaatgctccaattaaaagacacagaatggcaaattggataaatcgtcaagacccctcagtgtgttgtgttcaggagacccatctcacatgcagagacaaacataggctcaaattaaagggatggaggaagatctaccaagcaaatggaaacaaaaaaaagcaggagttgcaatcctagtctctgataaaacagactttaaaccaacaaagatcagaagagacacagaaggccattaagtaatggtaaagggatcaagtccacaagaaaagctaactatcctaaatatatatgcacccaatacaggaacgccgagattcataaagcaagtccttagagacctacaaagagacttagactcccacacaataataatgggagactttaacaccccactgtcaacattagacagatcaaagagatagaaagttaacaaggatatccaggacttgaactcggctctgcaccaagcggacctaatagacatctacagaactctccactccaaatcaacagaatatacattcttctcagcaccacatcgcacttactccaaaactgaccatagttggaagtaaagcactcctcagcaaatataaaagaacagaaattataacaaactgtctttcagaccacagtgtaatcaaattagaactcaggattaagaaacttgctcaaaactgcacaactacatggaaactgaacaacctgctcctgaatggactactgggtacataacaaaatgaaggcagaaataaagatgttctttgaaaccaatgagaacaaagacacaacataccagcatctctgggacacatttaaagcagtgtgtagagggaaatttatagcactaaatacccacaagagaaagcaagaaagatctaaaatggacaccctaacatcacaattaaaagaactggagaagcaagagcaaacaaattcaaaagctagcagaaggcaagaaaaaactaagatcagagcagaactgaaggagatagagacacaaaaaacccttcaaaaaatcaatgaatccaggagctagttttttgaaaagatcaacaaaattgatagactgctagcaagactaataaagaagaaaagaatcaaacaaatgcaataaaaaatgataaaggggatatcaccactgattccacagaaatacaaactgccatcagagaatactatgaacacttctacgcaaataaactagaaactctagaagaaatggataaattactagacacacaccctcccaagactaaaccaggaagaagttgaatccctgaatagaccaataacaggtactgaaattaaggcaataattaatagcctaacaaccaaaaaaagtccaggaccagacagatccacagctgaattctaccagaggtacaaagaggagctggtaccattccttctgaaactattccaatcaacagaaacagagggaatcctccctaacttattttatgaggtcagcattatccttgtaacaaagcctggcagagacataacaaaaaaagagaattttagaccaatatccctgatgaacatcagtgtgaaaatcctcaataaaatactggcaaaccaaatccagcagcagaatcaagttggcttcatccctgggatccaaggctggttcaacatacacaaatcaataaacgtaatccatcatataaacagaaacaaagacaaaaaccacatgattatctcaatagacgcagaaaaggccttcaacaaaattcgacagcccttcatgctaaaaactctcaataaactaggtattgatgggatgtatctcaaaataataagagctatttatgacaaacccacagccaatatcatactgaatgggcaaaaactggaagcattccctttgaaaactggcacaagacagggatgccctctctcaccactcccagtcaacatagtgttggaagttctggccagggcaatcaggcaggagaaagaaataaagggtattcaagtagaaaaacaggaagtcaaattgtccctgtttgcagatgacatgattatatgtttagaaaaccccatcggtctcagctcaaaatctccttaagctaataagcaacttcagcaaagtctccggatacaaaatcaatgtgcaaaaatcacaagcattcctatataccaataacagacaaacagccaaatcatgagtgaactcccattcacaattgcttcaaagagaataaaatacttaggaatccaacttacaagggatgtgaaggacctcttcaaggagaactacaaatcactgctcaatgaaataaaagaggacacaaacaaatagaagaacattccacgctcatggatagaaaagaatcagtatcatgaaaatggccatactgcccaaggtaatttatagattcaatgccatccccatcaagctaccaatgactttcttcacagaattggaagttcatatggaaccaaaaaagagccctcattcccaagacaatcttaagcaaaaagaacaaagctggacgcatcacactacctgactccaaactatactacagggctacagtaaccaaaacagcatggtactggtaccaaaacagagatatagaccaatggaacagaacagagccctcagaaataataccacacatctacaaccatctgatctttgacaaacctgacaataacaagaaatggagaaaggattccctattcaataaatggtgctgggaaaactggctagccatgtgtagaaagcagaaactggatcccttccttacaccttatacaaaaattaattaaagatggattaaagacttaaacgttagacctaaaaccataaaaaaaaaaccctagaagaaaacctaggcaatatgattcagaacacaggcatgggcaagaacttcatgactaaaacaccaaaagcaatggcaacaaaagccaaaattgacaaacgggatctaattaaactaaagagcttctgcacagcaaaagaaactaccatcagagtcaacaggccacctacagaatgggagaatatttttgcaatctactcatctgacaaagggctaatatccagaatctacacggaacttaaacaaatttacaagaaaaaaatcaaacaaccccatcaaaaagtgggcgaaggatatgaactgacatttgtcaaaagaagacatttatgcagccaacagacacatgaagaaatgctcattatcactggccatcagagaaatgcaaatcaaaaccacaatgagataccatctcacaccagttagaatggcaatcattaaaaagccaggaaacaacaggtgctggagaggatgtggagaaataggaacacttttacactgttggtgggactgtaaactagttcaaccattggggaagacactgtcgcgattcctcaaagatctagaactagaaaacaccatttgacccagccatcccattactgggtatatagccaaaggattataaatcatgctactataaagacacatgcacacatatgtttagtgcgccactattcaccatagcaaagacttggaagtaacccaaatgtccaacaatgatagactggattaagaaaatgtggcacatatacaccatggaatactatgcaaccgtaaaaaatgataagttcatgtcctttctaaggacatggatgaagctggaaaccatcattctgaggaaactattgcaaggacagaaaaccaatcaccacatgttctcacccataggtgggaactgaacaatgagaacacttggacacagggtggggaacatcacacaccggggcttgtcgtagggtggggggaggggagagggatagcattaggagaaatacctaatgtaaatgacaagttaatgggtgcagcacaccaacgtggcacatgtatacatatgtaacaaaactgcacggtgtgcacatgtaccctagaacttaaaagtataataaaaaataaaaaataaaataaaataatgtcttattcatgtgtatatttcatataaatggctgccagaggcttctgttcatagtgttcaacaaatatctggtaaattaatgaattaacactggcaaaaactgaagtacagaactaaacaaagagaaaaaataaatggctcttaggatccagtttccatgaatttatgaatcataatggcttttaaaacattcaagtacacagaggataagaaaaatatataacagataatagtagtttgtataaacactcattagatcgaattgaaaatgagattttatatggggtgttctaagcttctgagaagagcatactgaagccattcaaacaagaattggaattacctagatctgtgccaagagtatattctgacataccacagatgtttaactcaattgggtgaaaaaagttaggagaccagcctggagaaaaaaatactatgctacaaaaagtgagaaggctttatcaatgcatatacgagttataaaactaaaaacacatttggaatcactgaaatctttaaactaatttaagatacttcaatattagcaaatgggtcatttcccttttgtgtctgtactacctgtcatccctgtcacattgccttacaaagagtgagctcccttgtcattaaacaattccctgtttagtatagccaaatagaatatttactgcaaaccagtctcagagaagaaaaatgaagtcagtaaaggtcttcttaacaacaagaagtgttcttcaaaaaatcaacaattaacttaactgcttcaccccccacaaaattaaggccacatactgtatgattctacctaaaagactggaggttgccagaagttagggaaagggaaggatgaataggcagagcacagacgatttttagggcagtggaaaatactctataaggtactataatgatagatatatgtcaaaatacatttttcaaaactcatagaatgtacaacactgagagtaaaccctaatgtaaaccatggactctgagtgataatgatgtcattgcaggttcaccaactgtaataccactctggtgagggaacactgatagcagaagaggctatgcataactgcaggtagagaatgtgagggaaatctctctaactttctctcaattttgctgtgaacctaaaacttcttttaaaaagtattttttaaaaaaccaaagctttaaacatgtattttaaaaagtatatcagattatttatttgcatattaacaaatatggtttttatatgttagtacctcctaataaaggaaacagtcagtggtgaaataagcaaatcaacaggcaaataatagcataaactacaagactcatgtattagtttgctaatttttaacaaataatacctcagaaattctcaagtcattacacttagtgggcaagaaaagggcattgaaaatataaaataactgataatccaaaatgaaaaacacttatttgactttaacaagcattaaataattttcctatattgaccttacaaatcttgttaggttaccatattttaaaacatttttcaagagtaagggtacaggcagaaaccaaggacctgacggcgttgatagtgcagtgattgacagaaaatgtttctctataaaaatgtatttcatgagcatttgcatgtactgggttgagtaataccaaggtcataattggaagtaatgtatgtgaataatattagcattaaaaaccaaaattcttaaattgcctacaaatcactgtatgatttgacccctacccacctcatcagccacatcagccacatattgtgtgactcactctggtattctgtcttctcaaaattcattaaatattccaagatgct

SEQ ID NO: 48 - DNA, 11094 bp, Homo sapiens; identical to SEQ ID NO: 47

SEQ ID NO: 49 - DNA, 11610 bp, Homo sapiens
taaatcattaaagatatggttaatagggagagataattttgactattcagcttgcattgatccttgatataaaaagattaattttatattccgtttttaaccttacaggcaaccattagccatttcttttcacagagttgagctgagctggtttttcattaaaaatgtggcatttatcttattgaattctagctgtgatatctcattccaggaacaaaaatatattctgacttaccaagaaagcacaacaagacaaatgttacatttttaataaaagtcattgtaaacaaatttttgaaatttttatgctttttaatctacccaagtatacatcctccttattcctattaatttagaaaattgatatcttttccccttaaaactataggaattatgtgattttattcgttactgaaattaatgaggatacagtgtcaaaattatttggcctgtaatacataaaatgtaatattttgtgtttgaggcattcacagcaaaacttaggtaatatttttttttttttttttttttttttttgagacggagtctcgctctgtcacccaggccggactgcggactgcagtggcgcaatctcggctcacttgcaagctccacttcccgggttcacgccattctcctgcctcagcctcccgagtagctgggactacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtaatattttattgttaatgttccttggatgcttgtagaatggtgctcatttttaatagcttttaattaatttttatgtttttgctattgcttggcaaagttgtataataagaaatacttgtattagtagtcatgttgatctattgcatgccaagattatattggataatgtatgtatccatgaaatcaaaaagtttcagtgttaactttttcaaaataacagtataagaaaaatgcattttctgtcaaaactcatagagtttgagtttttaaaaagtttattgaagagaaagtcagaaccatactatagaattttgatttattttttattagaaccaaaggaatagttagtgctactctaaagttagatcagctaaacaattactgtatatacactagttttatttccataatctgataactttagaaacatgacaaaaaagagcaaacttcagagtcgtatcctattgtgacacaaatcagctatttatatccaaagtgtgcattcaaaagtattcctggttactcttgaatgtggacttgtggaagctcacaaattcaatctctgcattacattttatttctccatttactgatcctggtaataggccaggagctacattttattaccatcccataagtgcacccgacttgctttaccagactatgacacatatttttaagccattattatagcccccactggtacccaactggtcagaaaacacagattcaaactcaagacaagtaaaatgatatttctccccttcctcagacttgattggaaattcttcctttatgcaatcaactaatcatcaaaatcctattttgctggtctctgaggggaatctcaggcagtatagagagcaaaggactttgcagttttgttatgtccatggatctttgggttgtaagtaatagaaaacagttcaaaattgctcatgtaaaaagcagggttttttttttttttttaaatgcactcagtatttcatgatgttcaaatactgaaaaggaaattcatgagaatcagacctagaaagttgaaaaacacggttgtgatcttccctgtgatcacaatctgtgatcacaacaacacaatctgtgatctgctgtgatcacagattgtgatcagtctgcacccctttctctctgcatgttgatacttgtggtttgaaatggccccacacaaatcacaccttacggtctcttagctgcggtgctcactaatgactgtatctcaagagagagaatctggatcaacatggtagagcctaagagtgggagcccctggcccactctgctgtgaccatgaggttagatcaggtgaggcttctgtgcaatggacagtgatcgatatgtttcatataatcctatccctagaaacatggcacaggcactgaatgatagctagaaacccaagcctggagtgattaccagcttgcaatccattctgtggagaagggaggacttctactgatttttggaggatgagggcaattctgacagggagtggtatgagtaaaggctaaagattggatcctttctaaatggtgactagaagggtgaggggagctaaaggtctacatgaagaagttgtggaagcttggaaaggaaggctttgtagaaagccttagataataaaatttttactttggcatcctttgaagttttgttgttgatatggcttttgtgtgtgtttgtgtgttttagcaaggagtggccattggtcagaggtgtgctggtgaatgtttaacaaccagctctccaaaataaaaatgtgtatgtacatattaatgtattaaaaattttattgataggatatggacacacaatttacaaataataaaatatgtggctaagtctgaatgtttgttttccctcaaaattcttatattggaatcctaaaccacaaaaggatgatactagattatgaagtggggctttttagatggttagtgaccttataaaggaggccccagagagctgccttgctccttccactacaggagggcaccatctcaggggaaccatgccctcaccagacactgctgccaactcaaccttggacttcctaacctccagaactctaagaaataaatttctgttattaataaattgcccagtgtaaggtattttagttatagcaaccagagcaaactaagatatgtgtaacaccctttgttgtacatttcatatggctagttgatgatctcaagattctgtcagtgatttttgctaaacttttgtgcctgtatctcatctgcatctgcagtctagccatggtttcccaaatcaagttgcatcccaatctgcttattcttttcccagtaagtttattgtcattaaattttatatgtgatctgctgtaactatttctcatcctgatattaattacattctttaaactggaaacttttcagcgttagaatcaattagaaatgtatatagtgcaacaacagactcacaaagtaactgagcatttagcaattggctcctgagtttcagccggagctggtttcagtgagtaactcttaatgtctgagaggtgatgataccctcaattacaatgttacaatcctcaaaacaatcaatgggatttgattagatatgggagtatggtgaagacaaagaagatttcaggaatgtgtcctttgataaaggggttatgatcatccacaatggagaaataatataggaatccattcattcaacaaatatttatgaagaagcaaatactaatgaggaaaagctaaacattttatatgctctacaggatagttttctaattaattgttcaagtcaaccacagttcaaaaatagatataaataattattgatttctattaaattaagcctctcttttcagcttttagtgatgaccctacttgcacattatgcctgaaatgacatagtcgctggaccctgagccctcccaaagcagaatctgtcttactttcgtcctgtgttcccagcatccagctcaatgtttggcttatactattcaataaatgtgggttgagttaaggaacaaagaatctatacttggctccctaaaagagctagtcagtgatgaaaaggggcagactggttgacttcaaccactttctagagaaagtgttgacagtgttaaatctagggaggctattttttattcttttcaaatcccaggaaagtctatcagtctataaggaagtctacaagaaagattcaataacgtaagtatgttgcttgacactgatgtttctctgtcttcagggtgaaaattctaggaatcattgtttacagggacatccttgaattccaaatcctggaattaagctaaagatttgtgacttaggttggatattgatgtaactctaaatatttagcaaaaccaggctgagcaattttctctgcagcatataatgaatgtgcatactctatgcctctagcttttttagcaatttggaataaaatctttgggatttgttctgacacttttgccttgttaataaacatagtaagaataaggacaaagagaggattataaaagtcatttgtatggtcaagctaaaacagtggcatttacagaagtttataggaaatgtaaggaatgacattttatatacgggcttatttttcctttaatcctatattaataaagtgaattctgtatgggtaatacaggataccctctgtgagttgactgtgtttacaaaattcatttctaaactattgttcgcaatggggcatatagcggtgcatggaagcaatattaaatatagtttttagttacctccacaccagtctacaaaatctgatttagcaaagcatctgaagtctctgaagggactaacgatattatagaccagggtgtggggaagctattgtccctgggccaactctggttcaccccctgatttaataagtaatgtttttattggtgcacagctgtgcttatttattagcatattgtctatggctgctttggggccacaatgacaagactgagtagttgccacaaagaccttttggtccacaaacccaacttttcagtgggagtgtttgcctatcactgaatggtctttaatgaccacaaggaagggtgacctgtgaagtttattcagttttgactgtagagatcaatcaggaattcatgctaccctagtcgacccgtatgctggtttattgtgtctcacagcaccctcttgtattttcccgtccctccagacagtggtacaacttcatgtggcaggaattaattctcaaggtctgaagagaggactctcacaggacatagtctaagagacataaaagaatgggattggattgtttcttttggtgtctcaagttcaccgcagaggtgaggacatggctttatttggcgacaatgccttattgtcggatgacaattgtcggactagtgatgaagtcaattgcttgcttcctttcttcttgctacactgtccccataactagtctctctgcatctcagcccctgatcaggatgggtcttgcgatgagacaccttgcagacatgagttgatttttcaaaggtttagtcttggtcaggagccaatagagcaagataaacagaaataaagacagtgaggcaaggtgagcaggggttcccagactcctcctgcatttcagataatttattagctaggagagttaaccataaagtagctgtttcccatccgtcctaaactgttctgtattgtgttctattattctatgttatgctgtcagtatcactcctagatgacatctatataatgtttattagggaccatgcagggtgctagatgccctgcacgctaaggattttccttcttctctggcaacttgtatatatatatatatatatatatatatatatatttctccttcatctaatctttaaacaactgagtttctctagacttacttgtgagttctcttaatctcttattctatattttctccctagacaatcacatgaacatcacagcttcaagtgccttccctaaacagataactctcaaatgtataactctgtcctggacctaatttctgagcttcagatcaggatacccaactacctacttggaaacatttcctcttggctcactcatggtctttctatctgactcttcagtcagagactgtctcagtaaatacatccaccatccatgaaacttctaaacccagtaattcttgtgtcagttttgtcccttccctttcccttatcccctggatcaaatcacccagtctagtatgtattttcctctaaatataattgggaatccatctacttctttttattcatactgccatcactctcgtcaaagcagccgcatttctccctcggagtaggaaacagcttgttagctagtgcacctaaagctactcttcgcaccaatcatgttgctcttctatttgaaacttttccctgacctccttttactttttggaaaaagtccaatagcattaatgctacctacaagaccctgcattatctcttcacagctctcttcttggcctttttctacttcctcctgtgtgttctccttcttgcctttgaatacattgcttccttatccttagcctagataacccctgaatatctttctcagcagaacttacctcatatccttaatatgatttttttaagaatgatcagactaggtgaggacccccaaatttcccatttgcaactgtattcacaactgtaattaagtaaacaagtatgtaattgtgtaaaatgtgtcagcctcaccagaatggaatctctagaaagacaagagctgtatagttctgtttaggactgtgtttccatctcctaacacaactttatcattactgaaagaattaatgtgccgactgaatgaatgaatgagctcatttaacacttgcatacttgttagatatttattgttgtcaccatttatgagaactaggtagaactaagtttccaatctaggctatcagaccctcagaccatgtactgcgatacactgcaaagaaggtttagtgcttatttgctctcctggttccccattaccatgcataatgaaaagttgatgagttccagctactggatcctaggtaaggaagagcaaatcaatatgtaacagtgtttttggtgttaagggtcaaattgaataaattgtgtaccatattacccttacatttagaaaatggcttcactggatacccttttattttaagatcacttattgtatttttattttaatgcactcgcatataaaatgaagaaacagccagataatgagtacttgatccccaaatcatgaaatcaattttaatatgcttagaagatttaatattttcttagggcaatgagattgatgaagtcctgttaatgaatatattgatgtaattgaaggaaaatgggctcaacagtcttttgccatcagtgagatgaaccctatcacacaaactaagaagtaggtaaaaaagaaggcattaaagacattgcataagcataaaagttcattctaaacattttttattaataaaataaatttgttgatatagataacataaggctaattttctcttgaaatttacataacactaatataattattttaagtatcttatactgactccatgaatctgtttattttctttccatatcagagattgtagacgaaaaaagaaaaaacacctcctttttgcagtacattgatggaaagtattttatttcatatcatattttattaagaaactgatctattatgaaaaacactttttaagccaaataagtactaagaaatgtgaaaagtagcattgttttaaaaaatttaaatttcttttaaaaacattcattttctggaagaagttttgaatacaggtttaacaatttcaaattttttttccatctaaattctacctttcaaactgtattcccatgttaactagcctgaagacagatactaattgtaccccaatttgtaatgcatcagtttagcactattgatccgctaaaaaatgaaagcaaactaagcaagagccagtctcaataccaaaggaatgatatattgattccatctgacaatgctttgtctacagatcaatgtgtatgtgcagcatagaccagttaaaaatgaaacagggtggacaaaggtcgtgaaagaaacagggtatccaagattattggagatcatgaaatgaacatatcttaaagtatatctgatagttgttcacttataaaggaattctgtaggtttactgtgcaaaaaaatcataatgtaaatgttttatgatgacaatgccatatcttggtcctgggagtctctgaagaaattgagactcacttcttaatcaagaatgactttgtcttgattaagaatgactttgtcattcttgattaagaagtgagtcttagagaaaaaaaaagacatgatatggattcagtcctgctatgcttggtcataaagagatgactgtgtatgatatataatacatctgattcttaggttctctaatgcatgttttatattcctgcagttttttttacatttcagattttgaaaatcagatatattgggctgatgagagattgagagatggaagaaatgttttctggcataatcacaaagtagtaattaatcagactgtgagatttcctccctgtcgaataaaatttaatatactgtagtgaaatatatgcatatacaatacattatctgtttgttctcttcatcactgtattaaagaatcacaaatatgttctagaaccagaggtgggtaatgttgatagtatagctatggaaaaatagcctaccacaaatttctttttttcttttttattcctctacacattttattttcttgggcttgttacattttaagagcaaaagtaggtgtcagcctgtatcaacattgctactttaagaataaaaatactctgttttatgaattgttcaagttagcatgtctgtggggatttttgaagattcgaatatggtcagatgtgaccttctgagttgatgtaaaaagaacatagaaactaatttatgtgtagagatactggatttcagaataataataataatatttggaaatcacatattagaaagtcagaactagttccaaaaatgtatatttgggatttccttatctagatgctatttatgtttttaaaaccaatttgaagtctattcaaataggaataaggaaagaaactattatagcctgtatgcagaggaaatatctgtcaacccaaaagtttagcagctatgcaataaaccataatgtgtattcaggctttgcttatgcaacttattttattattaagaagtgtgaatattctgtaatagcaatctttggacaattgtatacacatgattttctacttttgcatttcttctgattcaattctgcattaaaatatgacaaatggaattcatgcaagaaaatgtgtttctgaataccttgcatagtccacatcttctgttattcataatccctgacaaaggatgacagatttttgcttttaaccactaaagtggaaccaccctgtggcaatagcataaagccagttcaccattcacttggcctgccagcatgaaaattctttgaatatttgagaaatttttaattttcaaatttgtgatttctaaaagtttgtttatgatatgaggatatagttcttacactattttaaataagctcaaaatgttactgtattatattgtctttcatcttataaaccttgtgctcaagtactgaaatttaatgtgtctagggttacctatttaggattttaaattatgttctaagatttaaactgtggatttaaatagaaatagtgattattattacattatagataatacatagtattaattaacaatttatttttatgatagcaaactttactgcctattaaagcatctaattttagtttatttttcttatagttatattaaaaaacatttgcatagaactgtaacatgtttaacctttctaagtaaaatgggactagaaaagctcctttattacattattcatcgtaagcttacagataagtgagagaatttgacattgttttcacaatctagcctataaaatggcttaggtttttgaattgatgattacctacttactcaaaactctttttttaaaatcaaaagaagccttccatcaaaaatgtccccaataaaatatgacagccttctgtgaatacaccctgtcctctgaccagtcaattccttaatatccagatgcaagaacttatatcagtcggtatgccacacactacagtgtgcaaagctaggataataaataaagtgtagcagtatgtttattaaaaatctatgccttaaagcaatttaaaacatttttaataacgataataactataataccatatacatgattaataggaggtttttactgtcttataataatactttccccttctctttggcatatgcttagtttcagatacaaacttttcaacctacacagccttgattggattggaaaatgtgcttgcacgctctctctctgtctctctcggcctctagatagatagataggtagatagatgatagatagatacatagatagatagattgattgatagattgatagatagatagatgacagagttgacctctgagagggatgagcaaatggcaacagcaacaagacatccaaagaggactagcaattgtccaaatgactacccacttagactgatttctgagcatttcaagcctgaaactgagttttaccaggaaataaatctgtatatattttatatatatatggaaagagagtgagcatacccaacctacgagagagagcaggtttgccagaacacttcagactgtttagggtgaaaagtgagtatctgaaaaagagtgtgtattgaagagaaggggatacacacacacacacacacacacacacacgcatatatgtgtatatatattgtgtatattacatattagattatattaatatcaatagttatgtttattacatgtaaatcaagcatattatatatgtgcttactagtcatttaaattgtaaccatttaaaaatgtaaatagcattcttggctcaccagctctacaaaaacaggcaacaggcagatttgacccacagggtgttgcttccagatccctgtgctaaactgtacttttaaagtatatgcagaagaagaaagctttcttttgtggatgatgtgttactaaataactatcatataatactaaataactcatattggctttgtaagaaaaagtgaagtagtttttttgagttagttttacatacagagctattaaatctgtagtgttctatgtggtcaaagtcatttaaactaaaagaaatctcactagttcaagggaaagtcaaaataataaccatgatgggggagaacaaaaattgcaaaatacaaaaggacaatatatattgtccttttgcattcaaaccatttttaaattcttacaattatcatcagctttagcagctaattttctaaatgttaattaaatagactagaacattctatttactattatccattgtcccttaaattaatagcaaaaagtgagtaatatcttgtaagttattaagaagcaattagtatcttaatacagaacctggactaatcacttcattgaaacagtcatctgctttatcaactttgctcaggatttgaacatgatgatcaaggaaatatatttaaaaaggaggactatgtcatttctaaaatgaagatatctgatgatttttccattgcagtgtatctgtattttatgaagctacatggctttgt

SEQ ID NO: 50 - DNA, 11610 bp, Homo sapiens; identical to SEQ ID NO: 49

SEQ ID NO: 51 - DNA, 28281 bp, Homo sapiens
tggcatgttagtgaattgtacacacagagagcagtttaatctaatttcaacatctgtaataggcaacactgcctcattccctcagttctacaaagtaaatgaatttagtgcataccacagagcctctaaatctgtgaatattatgtgattggatgtttttgtaatacagtaacaaacagaaactgatcttattaatttagatttctatttgtctttctctccatgaccacacttttcaacatttcccctctaagtttcattcagcttgtttattattattattattattattattatactttaagttttagggtacatgtgcacaatgtgcaggttagtttacatgggccatggtggtgtgctgcacccattaactcgtcatttagcattaggtatatctcctaatgctatccctcccccaaccccacaacagtccccagtgtgtgatgttccccttcctgtgtccatgtgttctcattgttcaattcccacctgtgagtgagaatatgcggtgtttgcatttttgttcttgcgatagtttactgagaatgatgatttccaatttcatccatgtccctacaaagaacatgaactcatccttttttatggctgcatagtattccatggtgtatatgtgccacattttcttaatccagtctattattgttggacatgtgggttggttccaagtctttgctattgtgaatagagccgcaataaacatacttgtgcctgtgtctttatagcagcatgatttatagtcctttgggtatatacccagtaatgggatggctcggtcaaatggtatttctagttccagatccctgaggaattgccacactgacttccacaatggttgaactagtttacagtcccaccaacaatgtaaaagtgttcctgtttctccacatcctctccagcacctgttgtttcctgactttttaatgattgccattctaactggtgtgagatgatagctcattgtggttttgatttgcatttctctgatggccagtgacggtgagcattttttcatgtgttttttggctgcataaatatcttcttttgagaagtgtctgttcatggccttagcccactttttgatggggttgtttttttcttgtaaatttgtttgagttcattgtagattctggatattagccctttgtcagatatgcaggttgcgaaaattttctcccattttgtaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggctttaggtctaaagtttaagtctttaatccatcctgaattaatttttgtataaggtgtaaagaagagatccagtttcagctttctacatatggctagccagttttcccagcaccatttattaaatagggaatcctttccccattgcttgtttttctcaggtttgtcaaagaccagatagttgtagatatgtggccttatttctgagggctctgttttgttccattgatctatatctctgttttggtatgagtaccatgctgttttggttactgtagccttgtagtgtagtttgaagtcaggtagcatgatgcctccagctttgttcttttggcttaggattgacttggcgatgcgggctcttttttggttccatatcaactttaaagtagttttttccaattctgtgaagaaagtcattggtagcttgatggggatggcattgaatctgtaagttaccttgggcagtatggccattttcacgatattgattcttcctacccatgagcatggaatgttcttccatttctttgtatcctcttttatttcactgagcaatagtttgtagttctccttgaagaggtccttcacgtcccttgtaagttggattcctaggtattttattctctttgaagcatttgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcgtgtagtctgcaaacagggacaatttgacttcctctttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatggatagctcttattattttgagatacatcccatcaatacctaatgtattgagagtttttagcatgaagggttgttgaattttgtcagaggccttttctgcatctattgagataatcatgtggttttcatctttggttctgtttatatgctagattacatttattgatttgcgtatattgaaccagccttgcatcccagggatgaagcccacttgatcatggtggataagctttttgatgtgctgctggattcggtttgccagcattttattgaggatttttgcatcaatgttcatcaaggatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacctctggtagaattcggctgtgaatccatctggtcctcgactctttttggttggtaagctattgattattgccacaatttcagagcctgttattggtctattcagagatttgacttcttcctggtttagtcttgggagggttatgtgtcaaggaatttacccatttcttctagattttctagtttatttgcgtagaggtgtttgtagtattctctgatggtagtttgtatttctttgggatcggtggtgataacccctttatcattttttattgcgtctatttgattcttctctcgtttcttctttattagtcttgctagtggtctaacaattttgttgatcctttcaaaaaaccagctcctggattcattaattttttgaagggttttttgtgtctctatttccttcagttctgctctgattttagttatttcttgccttctgctagcttttgactgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcagtttccatgtagttgagcggttttgagtgagtttcttaatcctgagttctagtttgattgcactgtggtctgagagacagtttgttgcaatttctgttcttttacatttgctgaggagagctttacttccaactatgtggtcaattttggaataggtgtggtgtggtgctgaaaaaaatgtatattctgttgatttggggtggagagttctgtagatgtctgttaggtccacttggtgcagagctgagttcaattcctgggtatccttgttaactttctgtctcgttgatctgtctaatgttgacagtggggtgttaaagtctcccattattattgtgtgggagtctaagtctctttgcaggtcactcaggacttgctttacgaatctgggtgctcctgtattgggtgcatatatatttaggatagttagctcttcttgttgaattgatccctttaccattatgtaatggccttctttgtctcttttgatctttgttggtttacagtctgttttatcagagactaggattgcaacccctgcctttttttgttttccgtttgtttggtagatcttcctctatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctggttagttgatgcagtttcttcctagcctcgatggtctttacaatttggcatgattttgcagtggctggtaccagttgttcctttccatgtttcgtgcttccttcaggagctcttgtagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtgttggagttgctcttctcgaggagtatctttgtggcattctctgtatttcctgaatctgaatgttggcctgccttgctagattggggaagttctcctggataatatcttgcagagtgttttccaacttggttccattctccccatcagtttcaggtacaccaatcagacgtagatttggtcttttcacatagtcccatatttcttggaggctttgctcatttctttttattcttttttctctaaacttcccttctcgcttcatttcattcatttcatcttccatcactgataccctttcttccaattgatcacatcggctcctgaggcttctgcattcttcacgtagttctcgagccttggctttcagctccatcagctcctttaagcacttctctgtattggttattctagttgtacactcatctaaatttttttcaaagtttttaacttctttgcctttggtttgaatttcctcctgtagctcggagtagtttgatcgtctgaagccttcttctctcacctcgtcaaagtcattctccattcagctttattccgttgctggtgaggaactgcgttcctttggaggaggagaggcgctctcctttatagagtttccagtttttctgctctgttttttctccatctttgtggttttatctacttttggtctctgatgatggtgatgtacagatgggtttttggtgtggatgtcctttctgtttgttagttttccttctaacagacaggaccctcagctgcaggtctgttggtgtttgctagaggtccactccagacctgtttgcctgggtatccgcagcagtggctgcagaacagcggacttttgtgaaccgcgaatgctgctgtctgatcattcctctggaagttttgtctcagaggagtacccggctgtgtgagatgtcagtctgcccctactggggggtgcctcccagttaggctgctcaggggtcaggggtcagggacccactcgaggaggcagtctgcccattctcagatctccagctgcatgctgggagaaccactgctctctttaaagctgtcagacagggacatttaagtctgcagaggttactgctgtctttttgtttgtctgtgccctgcccccagaggtggagcctacagaggcaggccggtctccttgagctgtggtgggctccacccagttcgagcttcctggctgctttgtttacctaagcaagcctgggcaatggcgggcgcccctcccccagcctcgctgccgccttgcagtttgatctcagactgctgtgctagcaatcagcaagactccatgggcgtaagaccctccgagccaggtgcgggatataatctcctggtgcgccattttttaagcccgtcggaaaagtgcagtattagggtgggagtgacccgattttgcaggtgccatctgtcacccctttctttgactaggaaagggaactccctgatcccttgcgcttcccggggtgaggcaatgcctcgccctgcttctgctcgtgcacggtgcgctgcacccactgtcctgcgcccactgtctggcactccctagtgagatgaacccggtacctcagatggaaatgcagaaatcacccgtcttctgcatcgctcacgctgggagctgtagaccggagctgttcctattcgtccatcttggctgccctccccctcagcttggttttaataataataaatacttattttataaactcatgttgagaaatagcgatgaatctttctaggacaacaatgttaaatcagattgtacattcattctgtggaaacgttgattgggtcaattttctgttcgctataataaatctattaatagatgaagagttttatttgtatgtgcgtatgagtcaccagaaatattaatttagaatctactatacaaccaagcagtttattatatattttatatatgctatttcaaaacaaccacaaaataattatattctatttacctgttgcatctagttaatgttcccaaaaagtttactatgataaaattttaacacacagagcagaattgaaaaaaatccatatacccgctaacatatacatatacccatagatccattaagttacacatattcactaatattttactatttctgttttatatcatctttctcatctatccattcatccatcaatccattcatcctccatgttatttttatgcattttaaattatattacagacatcagtttactttcccctcaatacatgaacaaggttagcattagagtttagtatttgtttttgtttgttttgagacacagcctcactctgtcacccaggctagagtgcagtggcacagtcatggctcactgtagccttgatctcaacctcctgggctcaggtgatcctcccacctcagcctctcaactagctggaactacaggcacatgccaccacacccagctaattgtattgtttgcagagatggtgtttcaccctgttatccaggctggtctgaaactcttaggttcaagcagtcctcctgccttggcctcccaaagtgctaggattacaggcatgcaccactgcacccagcctaatataggtttacactgaattttttctttgtataacattttcataaaatgaaatgcacaaattttaaatgtccatctacatatttgttgaattttatgtatgtatgtatgtatgcatgcatgtattcacttattgtaatttgacaaactatgattgtatatatttatggggccaaagtgatgttatgattcatgaatacaatgtgtaataattaaatcaagctaattaacatatctatcacctcaactacttatttttttttttgtggtgcaaacacttgaaatttactctctaagattatttactctcactattattaagtaaattcaccatgcggtgcaacagatcccagtaaaactcaaactaacttactcatcccatgtaacttgggctttgtaccctttgaccatcatctccacatttttcctacagctccagtcactggtgaccaccattttattctctgcttctatgagttcaatttttctagattccacatataaatgagattatgcagtatttgtcttcctgtgcctggcttttttcatttggcataatgttctccaattccacacatgttgtcataaatgacagaattttcctctattttaaggccgaacattattccattgtgtatctttaccatattctctttatctattcatctgtcgatggacgcctaggttgattccataatttggctattgtgaatagtgttgcaatgaatatgggggaggagacatctttcccacatagtgattccaaatcttttacgtaaacacccacaagtggaattgctgggtccatccattgagctctggcaaatgcacatatctataaaactcctataaaaatacagaactaacactcagaaaagttcttcatgcttctcctgagtcacctcctctaaaaatctgtcctgggaattttttttttttttttttgccgtagattacatttgtccattctggaaatttttaacacaagaatcacactacatgtactcttttgtgtaagacttttaaaatttagcatactgatattgagattcattcatgctgctgcatttatcagaggtttgctttctttattttcttgcagtattctgttgaataaatatactgcagttcgttcatccactctcctattgatagacatgtgggctgttttcagtgtttggctatcattagtaaagcttctatgagtgttcatgtacagcctttttataaacatatgttttcatttctctttggtaaacaccaaggagtgatattcctgagtcacaggatatgtatatgtttagatttatagaaatctgacagattcttttccaaggtgtttgtcaaattttagtaactaccagcaatgtatgagaatactacctgctgtatgtattcctcatcattttatactgtcactttaaaaaattttagctatactagttgtaatatttaactattattaaatgttatgtttcctgttgaaaactttatgtgcttatttgatcatttgtatatctttttaatctttaaatatttacccatttttattggattgtttgtcctgttattattgagttcgaggagatttttttttcctcactctgtcatctaggctggagtagagtggcacgatcttggctcactgcaacctctgcctcctgggctcaaatgattcttgtgcctcagcctccccagtagctgggactgcaggcatccaccaccatgactggcaaattttttgtattttagtagagatggggtttcaccgtgttgggcaggctggtcttgaactcctaagctcaggcaatccacccgccttggcctcccatagtgataggattacaggcatgagccactgtataatttggagaccagcccttagtcaaatatagttcttgttatgtttgttcctgtctgtgaccttttaattcatttctaaaaattgtgtcttttaacaagtaaaaatttataattttaaataaattttaatttatcagtttctttctttatggtcatcattttctaggacctaagaaaaattgcctaactgcaaatcacaaatatattgtatgtttgcttctaagctcttcatagttttagcttttagttttggtctgttatgaccttaaatttgtgtatgtgcatatgtgtgtgagtgtgtgtgtgtgtgtgtgtgtgtgtgtaatttgctggagaagtcaatattcttgtttttccctatttataggcaattattccagtccattttgatgaattgtctttctggtgctattggattactttggcaccttcggccaaaatcaaatgactatttcttggctctctattctatcttattcatctatttacagtctgtaagccatggccaaactgccttgattactgcagctttttagtatactttgaaggcacaatgtgtaactcttctaatcagaattgtttatttattctaggtcctttgcatttctatataaaacttagagtcaccctggcaatttctattaaaaggcccgctgcaattttactgaatttcattttaacttactgactctatagataagtttggagagaactgacatctcagcagtgttgagtattcacgttataactcatctactttaatgtttatcaacatcttttaaagttttcaatgtggagctctcacctgtcttgttaaatttatttctttatatttactatttctggtggttatataagctgaattgtctttattatttcatttttctatgatttgtgtctacaatataaaagcaaaatggattattttatttaggctttggatttgagaagcattagtaaatgaatttattgattgttttgtagagtacttagaaatcttctaggaaatttaccatcttgtcatctgaaaatactgatagttttgtcttcctctctgattattctttcttttatttttatactttattttatgacaatggctaggaccttcattacaattttactggaatgagtgagggcagccttacacttttcctgatcttaaagggaaagtgttcagtattaaatgattaatatgacagtacctgtagatttgtcattgatatactttatcaaattaaagttccttgaaaagttttttgcaagtattctgtctgaatccattgaaatgtcgatatggcagtgtacactgatttttgttcattataccttatatattattttataataaattattttatttaatttgccaatatcttattaagggtttttgaaattatgttactgatggctattctgtgtttttagtttttgcaatagatttgtcaaattttgatgatagattatgttgtgcttctgagttgggaaatattctctcctgtattttcttaaaaaagttattttcaaagtgtttgacagaatttacaaaggaaactgcatgtgccttgagcatatttgtgtgtatgtgtaggaaagaggttttataaccaattcaagtttacttataaggggttattcaaagtttctattttatcatgcatcagttttaaattacagttttcaaaaaaaaatgtctatttcacttaagttgcccccttttttggcataaagtgtttcataatattatcttataatttttaaaaatgtaataatttatttagtgataactctttttaaatttctattattggtaatttgggttcttcttatatgatcaatctaaaaggggctatcaattgtcgaccttttatttatttatttatttttattttttgtttttgtttttgagacagagtcctactgtatttcccaggctggagtgcagtggtgcaatcatggctattgcagcctcaacctcccagtctctaggcatcctcccacctcatcctcctgagtatctgagactgaagccatgtgccaccatgcctggctagttttttaaaaacctttttgtaaagatgggttttcgccttgttgcccaggctggcctcgaactccaggcctcaagcaattctcctgccttggcctcccaaagtgtcaggattacaagagtgagccatcatacctgacctgatttttctttagctttgtgaataattgtaattggttgtctatttatttcactgatgtcttttatcgtttgtattattttctttattattcttattgagtgtttatttttctctggttatagaaatatttaatattttctaagtatttaaaatattgaagtcatagcatttctctcaagtcttcatttagatacatctcaaaagtcttgattttttttattatcattcatttcaaaatatttgatttcttctgggatttcttctttgagtcatgaattattttagagcatgttatttaattaccaatgtttggatttgtttgatttttttaaaatgtatctttgggccaatcatttgtgtattttgcagtttgttatctgatattaacacagctattccagccttatgtttactatataaataagatactattcttttattcatttcctttcaacatatctgtgtctttacatttaagatgtatcttttgtaagatggaaattagtttggtcctgatttttaatgccttctaataatctctgatttttaataggaatgttaacattaacattgaatgttaatgttattattttttaataggttaacatttaatgttaatgttaccgttcctattaacattacattaaatgttatgattggcatggttggaattatttcttttatgtttatctcctctgttactatcctttttcctttgatctttggcttactttatttttcactttccctgctggcttcttattaatctcttaactttgtaacaatgactctctacattagatttaattttcattttagagattgcagcatatatttacaattaatcattaagttatagttaatgtcatgtcattttatgtgaaatgtaaaaacattgcaataagttcatttacagacactccttatttgtgaaaagttgccatatatatatacatatacacatatatatgtgtgtatatatatgtatgtatgtgtgtgtgtgtgtgtatatatatatatatatatcccatgatgcatgactataatttggctttaaacatttatatgtatcttatgtgaaaatatgttttagtttattcatttatcacttcttatctctccctttttgttacaggttcagtttttttcatgtgttacaatttcattgagactaaagaacttttaccaatttttgtagcatagatctgtggcaaaaattcacttcagttttattttatctgtaagtctttgtcttccttcttgaaggctatttttgctgcatataaaattctgggttcgccaattttctgtatgctccaccttctgggttcacgccattctcctgcctcagtctcctgagtagctgggactacaggcacccgccaccacgcccagctaatttttggtatttttagtggagacggggtttcaccatgttagccaggatggtctcgatctcctgatctcgtgatccacccgcctcagcctcccaaagtgttcggattacaggctgagccactacgcccagccggttttctgtatttttttaagaaaagatgatgactgatgatgttctcctcttctggctcacatagtctctaatggaatgttaatggttgtacaaatttctgttccccagtatgtgtcgtgttgtctttctcttgctggttttgagattttgtctttatttctgatactctgcaatccgacagtgatgtgcaaaggtgtgactttcttctcgtaaatgctgtttgatgttttctgaacttcttgaaattataattcatgtctttctccaaattgggttcattttttgctactacttttccatttttttttctgataccctttctccactttccagcactccacttaatcagtatgttagtcttttgatgtaatctacatagctctgaagctcttttttttctgtctctttttcaggttaggtaatttctattaatctctcattgagtttgtcaactcttttatcagttttgttcttattttaaggatatcaagtaaaacttatctaggtagtttttagctataacattttcaatttgtttttaaaaaatataattccatttatctgccacagttctacatttttgcatgcattgcaaataactttcttttactttgctaagcatagttatagtagctgctttaaaagtcttatctgtaatttcaacttctagattaacttgagataagcctctgctgatcatcttttctcttgacgatagttcaatgtttcatgtttcttcattgtgtaaatttgaattatgaactgaacaatctgaatgttgtgtgaaatggactccaaattctgttacgttctgctgaagagttctcatattttcattttatttggagattaactttgttggacttaaacggcaaattctgtcttttgggtggcatcaaattttagttcagttgttttattcttagcatggctacttttaatctatccttcacatgtcatagttcagggaaaattctgaatttgagactgagtttgtttacagaactgaggattctccccgctctctcatttttttccatgattactgtgtacattcctgttactgtgattactccaaactctgttatatggcttttcaaataagaacaactgtggttttctagcagagttttatccgtcctctataaggcagacttcagcctgacctcaagctaaatgctgtaaaactggaaacttcatcttatgctgtgccttcttcacctctcatgctgtgccttctcccctgagcctccttccctttcccaaaggatgctgacatcccttcagagtctgcctgcttttgctcggtacctagatccttgaggtactttctttttatgtattatccagaactaaatatttatacatggaatgtctgtctagtagtagcttattcagccataggaggaatgaaatgctatatttagttcattttaaacattagttcaccatttatttttttgaccactcctaatattccaaatactatcttaaaaactggaagacacaaataaataaaaatgaaaagtccttttcctatggtagttcacaggtaacctttgaagactgacatgaaatacatcatgggtgaacaaatgataattggtacaccaaattgggcatgttttctattaatgtataccccttaatctaagagtaatgttcaaaatttggaatatttggagtaaaaacagcagcaacagtaacaaaaaatgaaacaaagaacatgtaatagcagccacatatatggccaatatagcctcgaatgcttattgtcttcacctgtacagaaaaagtttgctacatttttattatgtagcaaacatgaaaatgaatatcttttgaagtgtgaaatacaccttatgaagggatctcaaaatctgcttgatggagtcaggatgtgtgttttgcactgagttttgaagaacttctagaagattcttatgttcaggttgggatcaagaagtggccatgggtagtccaaaaagatgttcaagaaaaaattattcagtgacagttgttaaagcactgtaaggcaggctttattcaggcccatcactatagatatagagaccactgcaatggtagggtcttgccatgggggagagagattgggctcaattccaaatacagcatgggtagtgtgaatttattataattaatacatattacttttatctaaatatgtagctgttaggttactatatattaagacgtactcgccacatatatcttatgatgtgatgaatataagacatattcatcacatttattaatgcatgttttttgcattaattttgatctctgatttttgcttagataacattttctccaagctattttaaaaatactgctttgctaaaactgccagaatctattttctagcttctctacagtctttatgaaccatgatatttaagtagaaaggctcttcatatgagtgggcttgattttgctttactatttctagcggaagaggatcttgctgagatttggaagcaaactggacacttctccatcacattataggttttatctgtcaggtttttagaacgaacaaatctcaccacctgtctgccctctttttcagggagttcctaggctcaaattacagtgaaacattctactccatgaaaggagaagcgttcaccaggcatcctcagatcatggtatcttatggaactttactgtgtctcttctctaaaagcagtatttcctgatgtgattttgaaaccctgttctagctgtacaagctgtttcagaaagtactacatcagaaataagctctgaattgattactctcactgaaaaattatagtataaaaatacgattgtgtggaccctaacctcttactgcctaacaagcaaatcaatgactgctaatatagctttgcttttcctaaactgatttctgtacactcaatatggtgttaagtctaggagagggtaaagcaggacaccaaaaatataaggcaccttatgaggctgtgatcaagctaaacggataaaatctgaagctatgaaacaactttaaaatctccattaattgatccttatgtgattctcatccccttgcccggtttttctgacgcaccaatgttgaggtcttttcttcaatcctcaaatgaatttttgttcatttattattattattccattaattttaataaaatctagatacagattttatttttacatccccattgcttttttccagaacatgtcctctgtaaccttctaccaagaacattacttttaccaaacctatacatttaaaaaagtatttcctccatttaaagcaatggtgaactttgttttgttttgttttgaaacagagcctcactctgttgccaggctggagcgcagtggtgcaatctcagctcactgcaacctccgcctcccaggttcaagcgattctcctgcctcagccatccaagtagctgtgactacaggcgcatgccaccgtgcccagctaatttttgtatttttagtagaggcggggtttcaccatgttggccaggatggtctcgatctctccaggctggagcgcagcggcacaatctcagctcactgcaacctccgcctcccaggttcaagcgattctcctgcctcagccatccaagtagctgtgactacaggcgcacgccaccgtgcccagctaatttttgtatttttagtagaggcggggtttcaccatgttggccaggatggtctcgatctcttgaccttgtgatccacccgccttggcctcccaaagtgctgagatgacaggcgtaatctaccatgcccagcagcaaatgtcaacttctatgagagctaagtcttcatgcaatcttcaaaacaggacaagaggaaaactgggtaacattcttttatgcagggggtgggttatttgtgagggtgtgaggtccctggaagaccacagaaagtgtcatccatagggaggattttaacacatggaaatgatgggaaaaataattacctgattggactaccatgggcagagcatcaagtagggagtaataaagacaccaacttgattgaaacagagaggctggagagaaaggctagtttcgtaaaaattttagggtggattaaaaagtaatatttctaaggaaaaggtcacaattctaaaactactgtcgtcattaacagactattaaatttgtagaggaagaatctatactttgctttacacaacataatcacataattaaggtaaaatgtctctgaagcaggctcaaatatttccaaatgaaagaatttaatgaatgaatgcagaacaaatatcaatgcaatttgtcaaaataaaacattgatatattctgaacagaaaatatttagatattagtatctatataaaatcaatatttatacatatagtaatagagtcttcttctattttaggatcattgtttttaccaaggatccatagtacacgaatatgattcagctgccagtatcagtacgtgtaatggtctaaggtaatgcagaatatctttctttttcctttatgagttttcctatggattttcaaagaagttaactttgttgattttgttttatcactcctggtatatagaaaaattaatgagaaaaaagctgctgtgcatttttagcagtttcagctgtagcctatgatttacattttgacaaagagatgcctaatgcatagtcctgaacaagacaagctttgcagtatatgaataagggattcatatttggaagattactgaaaatcatttagtctgggctctcattttatagatcaggatactgactgaaattagaagctttctcctgaatattccatttgctagtggtaaaattgagcctgaaacccaggtcttttgaaggctagttttgtgaattcccattatgccgtaaggcttgactcttttagctttttactaaattgagctgtgtttgcagcctcttgaaagtaaaaattcagaagtaaagcctatagttctctatagatcataggctcatggacaaagaaagatgatgtggagaggtaaagaggaaaagaacaaggaagttctgtctttaattacgggaaatttgcttgactagttcttagtgttttcaagaatgagaacccctttaatgacacagttaccacatattagtatttttactttcatatatttactttcatatatattccatgtcatgatagacatagaaactcacataatttttgcaataactcttaagacttgacagcggtccacaaccaccagtgggacttgctacactacctgtactcaaagcagatattggactgtgaaacttctgaaaatctagtaagttgactcttagaaaaaagtattgattcagtcaaaggcctcatatcatcacatttccttaccactgaaagcactctcctacctgttcatgaagcactggctttgtggtttctctttcttgaaaaggcaaagtcaatacaatgaaatagagtaattataggccttgaatacaaattgtgttcccaatttctacaggggattcttcagaataaacgaccaaagatacctcattgaaccagtgaaatactcagatgagggagaacatttggtgttcaaatataacctgagggtgccgtatggtgccaattattcctgtacagagcttaattttaccagaaaaactgttccaggggataatgaatctgaagaagactccaaaataaaagtgagtactttattattatctttaccccaaatgaaacaccttttattttcttgatgatgtctagggataaagtatgagtccagttactgaaatatatgtgctactttcagtctggcacttcatctgatatttgaaattggaaaattttttcttgtctatgtaaaaagtgtttatttcatagagtttgtttaatcagtttcaagaaaggatgattctacaattctatgtatagattgataacattggggctatgagtagttggaaatcatgaaattttcaatgtcctaaaacctaatctagagatagtgtctttccttttcttccctgccatttttttttgcagagttattgatgacaagctatgttctcccctttttatcattcaaatgttttaatggttaaggatgattaaggataaaacaagttcagtttttggtgggatggttgtataaaagtagtccttggagctttaggcttttctatacaactaatccatatccccttaaattcccagtggatgttagtctgtaagctacttggttgtttttcttcttcgtatgtccatgatttgtatagtgtctgacacatactgtatgcctaatggatgtttcctgattgaataaatcaacaaataaatgattacttagtccatagaaaaagatttagccaaatctttgaacaatttacctctgttttgtcctcagagaatatgtacatacctcagcgcatgcacactgaaagctgaatacttagaagaatttcctggtattggtgttttatagacataaaagattggccaggcatggtggctcatgcctgtaatcccaacactttgggaggctgaggcgggccgatcatctgaggtcagaattcgagaccagcctgaccaacatggtgaaaccctatctctattaaaaatacaaaatttggccaggcagtagtggtgtgcgcctgtaatcccagctacttgggaggctgaggcagaagaataccttgaacccaggaggtggaaggttgcggtgagccaagattgcaccactgcactcgactctgggcgacagagtgagaccctgtctcaaaagaaaaataaataaaaataaatttaaaaaaaagatctatgattagcaaaatttgtacatgtttgcttggaattgagactactgaaaattagaaagttgggaagcaggggaaggagtacaagaaatgcagtcagtcctgttggtccacactatgttttaactctcagttacagatggatgtttttcacgtgagcttactaatgaaacacttactcagtaaatgaaaaaaaaaaaacctgaatgttaaagtatgtgtttatgattatttacaactcttatttgacctgaaagcctaaacaaagcattaggaaaaagagctaatgcatgctaggcttaatacctaggtgatggggttgataggtgcagcaaaccaccgtggcacatgctcacccatgtaacaaacccacatatcctgcacatgtacctcggaaattaaaaaataaaattaaatttaaaaaaaagaaaagaaaaaaaagaacaaatagaaaatactaaaatccgatgtataggaccccatgtttaatcgtatagatctcatttagataaattcgtacaatttttatatattcatatgcctccccattttgtatcaatatcaacatttcttaccttgaaaatactaggattttttttccaacttaaagggttaagatagaaagtgttaactatacttcaactgaattttccctaactttacagggcatccatgatgaaaagtatgttgaattgttcattgttgctgatgatactgtggtaagttttcaatagaacatttctctctttattcttccttttggaacttgtagttatcattctagcatagagagaaaggtattctaatcagagttctattctaggctcaaagtcctatttttagcttcccaaaacagacatacataagagattatggggtcctttgccacaatagcagactgacccaaaatagaacacccctccccattaagaacatatggaaatgctgaatgacatacaaaaagttgaaaatattttagcaacctgttgttaagctcaaaagaaaaagtggaaaatctccaagtactaaaaatgaagaagaaaatctctatcagaacagtgagtaaaatttaaaggcttggtgaccccgctatacagaatacaaaaagaggcaattgtaatgtaattgaatgtaaacccctgagaagcacaatactgaaatttggaaatgagacctctgcattattctcagagccataaagggctgcccatctcagaaaagggaactagaaacgctccacagaaactgcaagagataagggaaattttctgtctgcctatagccatgagcaggtaaaatgttacacatgggaaaacaaatctcctgtctgtgttatgcacagatgtgggacatgatattatatatttcttcagatgcagcactgccaagcaaattttttaatataaaaacttattagagaaccgctaaactgctggaagtcaagtcaaaaatgccctaaagtgactcttcaataatccaagataaaatgaaccacatgaggaagagtcaatcaacttaaaaaaaaggaaaataagctcacctggaactgtaaatcatccaatgatatttcagactgtgctgtgacactaaatgttttaaagttattaaagatgtaaaaatgaattaaaatgacactgaaatgactagaaaagactggacaaaacaacaggcatacttgaaaaactacctgttttaacatttataaaaggaaaacgtatatacccttgaaaaaattaaacagaagattagacacatgtgaagaaagaattagtgaactagagaatggaggatatagagaaaccaccatttctccagagaaataaaaagttggaaactgtaaaagagaacataagagacattaattcagaatataaagcttataaagagtgaatgggaatgattggatgacagatgacaaatgagagacaattcttgagaattttccagaaggaaaggaataagcaaatcagataacatggtagaaaaatttctgaatatcaaagacaaagaaaaaatcttttaaaatcaactgtaagaaagaggcagattgactataagtaaatcacaaacagagcatacgttttaaacaacagaagatacagtttctagaaagtaagttcaaacagctaatgaaaaatgttataaaatttaaattgagtactaaagtatcaggcaaggataatatattcggagaaagaaatcatacttaaaatgttctatggaattttagattaggaatgtaaaggtagtcacaattttacacttcataagtaaagtgtgagtattaaaactttaattgtaatcactatgaacctagcaattagaatgtaaatatcccaaaagggtagagggaaataggtggatttgaaaataaaaaaaaaaagaccaatccaacagaaagcctcaaagaaaatacacacttgcacacatacacctacagtcatgcaccacataacaatgttttggtcaacaatagaccacatatatgaaagtggttccattagatgataacaaagcagaaaaattcctatagcctagtgacatcgtagccatcataacgttacagcacagtgcttcactcatgtgtctgtggtgatgctggtgtaaacaaacctactgcattgccagttgtatgaaagtatagcacatacaattatgtacggtacacaatgcttgataataataaaaaacaactatgttactggtttatgtattcactatattatactttttgttgttattttatagtgtactcttattgatatatttaaaaagttaactgtaaaatagcttaggtgagtctttcaggacatattccagaagaaggcattgttatcagaggaggcggcagctgtatgtatgtaattgcccctaaagaccttcagtgggacaagatatggaggtgaagacaatgatagtgatggtcctgattttgtgtaggtttaggctaatgtgtgtggtttttgtcttagcttttaacaaaaaaagtttgaaaagtaaaaataaattaaaaaacagaaaaaagcttacagaatagagatataaagaaaaaatatttttgtacagctatagaatgtgtttgattttaaactgatgtctaaaaaaatcaaaagtttaaaaatttttaaagtttataaagtaaaaatgttacagtacgctaaggttaatttattattcaataaataaaaatatacttgtgtaaatatagtgtagccaagtatagagtgtttacaaagtccaccgtagggtacagtaatgtcctaggcctttatgttcactcaccattcattctttgactcgtccagagaaacctccaggcctacaagctccattcatggtaagttccctaaggaagtgtaccaggttttttttttttgtcatttataccattttttattgtactttttctatgtttgcatacacaaaaagcattatgttacaattgcctacaatattcagtatagtaacatgctctacaggtttgcagcctaggaacaataggctataccatatggtttaactgtgttgtaggttataacatttaggtttgtgtacgtatgctttatgatgtttgcacaaagaagaaatcacctaagaattcatttctcagaatatattcccattgtcaagcaatgtataactatattacatatatacatacacacagaatagtaaatacaaaaacagaaaaaaatatgtgaaggtaattccaaatgtgtcagaaattagagtaaatataacaattacatctgcctgttagaagttagaaagtctcaaattgaatataggaaaaggacattatgacatttataagaaatatacctaaacttctcaagagacctaaaaaatctcaaaactagtttcttctctccaaaaatatatcttatgattttaatagtatataaaagagaatttatgatttaaaaagttatttgagataaattggggaattaatcagaaaaagagcaccaaaaggatacaaaatatgaaaatacctaacaacaaagtataaaaagataacaaaaaaaaaaaaaaaacaggtttgccagaaaagtagggtattttttagctcctctccatcagaaaatgtaaggtcaagaggaaaagcttcagcaaaaatggacaagatttgaaccacataaatgcaagtttcatttaaccaactgatatactaccttgcatttaaaaaaaaagaatatgtatttttttcatgtacaaataacatatttgaaaaaattaagtgggtatctggccacaaagaaaatacatagaaatagcaaagagatatcataagatcactgttttcttttttaccacaacccaattagaagttataacagaaattgttaaattaaaccactaaaagactattggtttggaaactgaaagtacaatatatttccaaatattaattgtctaaaaaatcaaatctgaaattatggactatttataactgaccataaaaaatagtaaagtaaaatttattagatacaggtagcataccagtatttagaaagacatttgtcaatttaaacagttttattaagaaaaaagaaagaaaataaatggactaagagtccaactagagagattagaaaacaaaacaatataaatccaaagaaggtataaagaagaaagtaattttagcaatgagaaaaatcaataaaaccaccaagcaaaacaaaaaataccacaatggagtagttcaacagagccaagtactaattctttgaaaacattaatgaaatagacaagcttctgacaatgctgattaaaaaatatagaaatatatgtaaaattagaagacaaaatataaataaaagttacactttattaaaaatatatgaagaactatgtgccaataaatttataaacagatgtagtaaaatgctatcaagctgactcaacaataggaaaccccaaaaagatttacagcagatttgaaaaattacataagtagtccacaacctatcagcaaataaagacaccaggagcctcagattcgtttagtggcaaattttaccaaagttttttataaacaaacaacctttgtttaacaaagataaataaccttatcttttacaaactgttccacagaataggaaaagaggaaaaaaccccacattttataagtttattataacctttgtattatttatctaccactgtgtaatcaactactcaaaacctggtgggtaatcaatgactcatgcagctgcagtaatctattgtgtccaatggctggctagtctaagatggcctcagtcatttgcctggtacgtgatattgggtttcagctggccatgtatctccaataggctagctagttgtgctttcttgcatcatagctgggcatcaaagcaccaaaagagaggtgaggctgcaatgtgcaagaacttttcaaccttctgtttgtacatgttttcatgtctcaagcaaagtaagtcatatgtccaagactagaatcaacattggaggaaacttataaaaagatatagatacctgtaagagtgattccttgagtcattacagtaacaatctatgacaactgataatattggtaacagatctagacatgatcttatgagaaagtaaaattataagctaatgtcccttataaatgcaatttcaaatgtccaaaaaatatttgcaaacccaagccaagatatatccataaaaatttacatgagagtgacggtttcctccggtaatgtgaatattgctttgctttgacatgaatagatttttaaaaagtgataatttcaaatatctcaaatttatatatatagtatatatttgtgtatgtatacacatacatataattcaacactcattcataataaaactcttaggatataaaaagtggaagaaaataaagtatatttaccaaactcctattcagtataaacattaaacttattaataaaatgttggcagttttcctccaaaattgggaataaggtacatttgttcattgtcaccagatttctttcaacatttttactgaaattcccagccaatgtaataaaaaaggtaagacccatcttaattgaaaagatgtaacagtttttacacattaaagatagaagaaactataattaacctatgaacaaaattttaaatcaaaattagtaagttctaagcactaaacagataggcttacactggcatgttgctgagaaattttataaagaatgctgagacactttgctcttaataataatatatgtgttattaaagaccaagaataggttattaaaatttttactcatatactaggtgaagggttgcttggtgtgattttagttgcattaaactgggctttagtgtatagctcttgctcatgctgctttaatagtatcttaaaatatttaaggttttctttatttagagaagttcctaaggtaaatcatccattttcattagacaaatagttaatgagcattcaatatgctaggttctgagtattaatgatatatatgatagccaaataaaaaaagcagcagaggtcaggtgcagtggctcacacctgtaaacccagcactttgagaagccgaggtgggaggactgcttgagaccaggagtttgagaccagcctgggcaacacagcaagacctcatcatgacaaaaagaaaagaaaaaaaatagctgggtgtggtggtgtacacctgcaatcccaactacatgggaggctgagacaagaggatcacttgagcccaggaggtcgaggctgcaatgagccatgttcacgccactgcactccagcctgggtgacagagcaagaccttgtctcaaggaacaacaacaacaaaaagagcaagaaagcaagagaaggatagaaaatttgagcattgcagtcagataaaataaggaaaccaaaggcagtctttggaaacctgttgagaagtttatatatctccacaataatgaggaattctcagcaggaaagtgaagtgaggatatggatgaaacactgacagctagcaagttgaaaaagaagagcagaacacaaatgtctgaatcctgggaaacacccatcattaaataaagatttggcaataaaagtgcaaagctcatacctaaccattcctcctccctcccctctgattgaaactcactgattgataaagcatctaatctttgtgatccctaaaatagcttcagaatattctccacagtgaattttaggcagtgaattttgggtaatttttatcaatcaatcaatggaaatcctgttgtgaaacacatttgtcatccagcatttaagggataatgggaatgcacaataaaatagtaggagtgtccggggtaatagaaaccaagaagaaatttcttgaaacagaaaatagtcaacattaaatgtggagaagatgaccagaaaggaaaatatgttcacaatgtatttgataattaagagaatatttgtgggttattaagaatagtttcaatggaatagtggcagttataatcagagtgtagtaggttgaatacgtggaagatgaagattgaagagattctaatgctatatcttagcagtattttgatctttaaggtaacaggacagcaatggcatggtaacaagcagatacttgcgggattcaggaaaggcaggttaatttcttatttttattatgaaagaagtttgaccatttgcatttatccctacaggacaccttatgttattattaagtacatttgatcaggtctaaattgataattgatacaagatcccgatagtacaaaaagggaatgcagttataaggagacaacaaaagtcagagtagactggacatgaaaagtctggtttgccctcgtagctatttcctggagggaaggggtagctacagtttcctgtccctcttcagcacttctccagctccagtgggtttttaaattacatattccttattttgtgaacaccaaggacacagaaggactaataaagttgctgttcttcgccatatagattgctttgtagctttaataggtttgtttcatcaatgtgataaaaatggactctaaagaacactaatcagttggtttaataaattaatgcaatgtagtacaatgtaatgtgaaaaggaaacagagttagaaagaaaagcttgaagtaatactacacctaagaatgtctttaggagggctgtatttagttattttatatcaaaaatgtatttaagttgtctagtttttagctgaatgaaaggagttctctttcttcattaggccaatgatttttttctttgtaatagctgatgaatgaagtattttgttgagcttttatgcaactcctattattaatgaatattaatatgatatttatatttccagtatcgcagaaatggtcatcctcacaataaactaaggaaccgaatttggggaatggtcaattttgtcaacatggtaagatttgatacagtttttgaatcaagccaataatacgaatgcaaagaacctttcagcgcagttctctgctggactattgtagttacctgatattaagggagtacaaagcacaaagactaataagcaaaaatccacgggaaaaaataataacaacaaaccaca

SEQ ID NO: 52 - DNA, 16492 bp, Homo sapiens
taaatgacgaaataatctgtacaccaagccctcatgacatgcaatttacccatataaaaaacctgaacatttacccttgagcctaaaacaaaagtaaaaataaaaataaagtccttttagttgaatagttttattacagatgcagtcctctttatttattatttattttaataactaaaaactactttcttatattgtggcagtgtctcaaaaacaacctaaagattggctgcttttccaacattatgacatcttttaccttgtcaatagctgaaatgccaaccaggaaaataccttaataaataactgagtaataaggtaaacaaatgtaagaaccaaaatgaccccttgatgttgagtagccctacaaacccagtctagctgggctgttacctgagagagagagataatcttctcttatttaatctgcaatttttttcacttactgtgctgcatcatataaatatttaccctaacctgttatagaatattcacctttacctcaattatttgtcatatcataaaaaaaatctctgtggtcatcatttctaatgatcatgtagtctattatataaacatgtgataaattattttgctacttccccttgtttaaagatttaggctgttttttaagtctttgctcttatactcaataccacagaaagtatctttggtcataaattttctttaagtttctgagtagttctttaagattgagtcctagaagaggtgtaaaagaacttaggacacttgatacatatgaccatttggaagctattatttctcaactccaaatctctctttatttaagcctttatttatactttgattcctgaagctaagacttagactttgtaaaccatatttcttctttgacagctgctccctcttcaattctgccaacaggcacactagagggggaaaggaacactggaggagggaaaagtcttcgctgcttcttgtttcttattctcatcagcatcatttatcatcttgactgcactactttcctcctgtttccctttctgtttttgtttttgtcctttggcactctcagaaccagctcattgtactccttaaagacatcagcccctgtaaggtagcactggtccttagaggtcaaagtcaccctccatgaggtccttcttttttgcttctaagacaccaccttcagctgaatggtaccccatccttttcccattgctgagtcacagagtgggctgagtcctctctcttctaagcttttatgttctattaactccagtcaatttttgttgttgtttcccagctccaggaagcagagggcagagagtgtaactggtctctctttcactctttgtgagttactcaatgtcttttggttgttgttggtcttttcaattctctaaaatgtctttgacagactccttatcttactttctctctgttaaaataaatgatgggataatatttgcccaaaaagcaaggcattgattgatactatcaaattcctttatatatgcaggacatgaagtgttagtttcatccagccatcttaagcagtatcagctaactaaattgataaatgaaaggatcgtaattatataggtgaagaaatgcatcactgttgctttgaagtgacttttactactacgggagttaattatcttttatacatgtattattcatcatatcttccaatactttactgctttgaaagttctttccttttttatagatttgaacaatatgcacatattatctccatttttacagaacatatatatatattcaatatataaaatgttcaaagttcaacatataactctatctatctatctatctatctagactttaaattttctgaaatttgtgttctgcaagtgatcaacagacctctgtgcaaataggaaacaaagcctaatctgacattgttgcttaaaggaatttctcatggtttcttagcaattctgtttcatattttatgtaattaaaaaccatactgtagtattttaatagtttttgccatattctatttttctaatatatgctgtgtttcttagacagttgattactattgtcatccatatggcctcttctgcagcttcatagatacccatgctggtttaatcctgataactgtttaaatttttctcctgcatattatgtgtttgtgattgtggtcttgctaggatggggattaaataaaagagggtagtgtttgactctggctaatggactttaagatgttagattgttttaaaattccacttttcaaccttacttgttttgtgattttaaagggatcatttaaagtctctgattttgggtttatttaagagtaatctgataatgggcatttattacaagcagaatgggtggtagttattaaaattatttgatatgtttggaaactttgaattcatctggcttcatctttgatgatcctcaactttgcacttgaaacatcatctgtaagagctttccaatacacactcattacaattttacttaggcacattctttaatcttcctctgagataattcctctctatatatattgttcacacgtgtcccctgtttcactgtttctcaaaccactatgcagatttcttaggcagtgcctgcatcgccaggaaacttgaatgcctgtaggtcaactagactctctagagaactaggaactggcacataatgaatgagtgaggaaagattattgagctgctctaatcctcagagttgttttatatctttgtcatcctttccttttatatcaacttctccgtgcccccagttcatttgattttcctttctatagtttctaattgtttgtttttcatgacattttcccatccagctgagaaatctctcatatttttagcaaaaaatcatagacaaatgtctactatttttactttaaccatgggagaatttaggcaggaatataagctgcatttcacacaaatatctattaatcattttcaaaatcctataaatatatgatcttatttaaaaatcatagcatttaatttatacatttttctaccaaatatatatgaattaaaattgtatttaatatttaatattaggaattaacatacacaccaacatgccaattaaaagagaaagaattgagggaaaaagaaaatgtcactaataaaatatcatttttaataaaataagtttaacttagccatataactaaatttatatgtataatatatattaaaatatatgtacagaaataataaaatacagaatagcaatatgtaaactatagctttttttcagatacaaagagattttttaatttaatttttagagtcttctacattttttagattttcttcaataaaactacatgtttaaaaacaatgttaatttttaaaattgaaaaccctgtaatttggaattggatatatttttactctgagaaataaaaagtgaatgaaagagagaggcagaaagaaagaatattgccttaaagaataaataatatttattgatttcccacaattgaagtttcgagaggtagatcctattttattataaagctcaaaaatgtgtcgtcaagtatcttttatctttccattccttattacagcttttttgtagacctgacacttctcaggttgtaatatggctgtaaaaattttccagagtcacatacttttttattcatgttcaaaaggaaggaatattgtagggataaattaaagattctgactgaatggcttacgtgacatgtcctaacctgaaacaactgatgggattcgttaagatcatgtgctccataactgaatcttgcactttaacctacttctgtggaaccaaagagaaatcaaggccctctcagaagcagatatttatactacgatacaaatacaaatgtcaagtagggaaaatgaaatatctctatgaattacaatagctgtagccaaacaatcagaaacctcagtgacttagcatgttaaatgcttttaaatatatttgtagcacagtccagtgctggtcaggtgactctactagacacctttcctctactagacaccttccctccagggaccacaattgtctttattttatgactacacaatctgggacacattggttccaaagtcactctgtacaggttattattcctgttgttctcatttccagcccttttctgccttggtgcgttattaggaacaacttcctttctgactgtctcccaccctttccctcatgggaggtgctgtcagaagactgatgtgtgggaaaatattagttgccaggattttttccccatctctttgtgctttgggtggcatcctcaggatggccacatttcctccacagatatagacgcatccaggcagcatgccctggttggatccagttttcaattccctgactcatgagctccttctgccttggttactccagctctctcttacatcattgtcccatttggctttggtgctattacatcacctgtgtaaacaatgtttgatgttaagttccatctttttgaagagagagagtctcagaacggacactgacaaatcgaccaatggaagcaggagaggtggctggaggatcacacaggatatttttaagttccagtctcagaaataatatatagactttcttccacactccatttgaattatagccccaaactgactgcaaaggagaatgggaaattttacatgtgccagaaagaagaaagtggtttggtgagcataaagtattgtatgctatatctaataaattcctagaagtgtgggtagtcaactgacaggatacttgtaatatgaataaattaattaattcatactaatatgtatttgatattattgttagttctgatataatgcaaaatatatacaaattcttaaaaaccagcacgcaataaaacatttcaaagtaaaaatcataggacttatgggaaaaatagagtcaaggacatgacactaaaaaactttgtactatgataaataagacaaactttaagaacttagtaaaaagagtttccaagtgttaaatgatttaaaaattcaccaatattgcaataaatatggtaccttaccttgcaaaaacctgaagtttttatgtgatagtaggttttggaagagttacagcttgtgaattgttaagtaatggaaggaaagttgttcaaaatttgatggaaagttggaacaccagatatggatgttggtggctcattacacatgcaatgagatagccagcgtagatgtttaaaatgcctatttatgtgcgcgcacctacaaatacatacattttgtgtattcagtgggatgcagttgtctgtgttcacctagtgtttcttatggatgaaattgtgtgtaaacgaatgtagaattttgtggcaaatgtgttttgtgttccgcaactgtggaacacattgtgttttcagaacaagatttacagctgaactcattgtacttcaagttcattaaatcactacttttcacaatgtcacagtaaaacatgggacttgtaattgcaactagaaatataacaaaatatcttcccaaccaaaaaaaaataaaaaattattatatgctagtattgagaatttgtgaaggaaactgtgttggaatttaataacattacaacacgggaatagtttcaaaatggctgactaagacatctagcactaacctcctccacaaagaaaaaccaacatgacaagtggatgatcactttaagtagagtatctaagaagtaacactggaattcagcaaagaagtgacaggaagcacctgagacactgaaagaaagggaagcaaagcaactaatttggctgtgatcagctgggagcctggaaaggctccccactgtgtggagcagttccagacgtggagaggtccttgatgccggcatgctgtgagactggcttggggagctacctgaagagagtgtgatggcattgctccgggagggagtgatgctccacttggtcccacacacctgctaagagataagaagttgcatcccagagccattttgaaagaccagcctccatcagaatgcatcctgttctgaggccaaatagcccctgcatctcagtcactggagttcactgacattcctccccttgcacacttgtcttacattcacacagaggactacagtggcatgacatcagttacacccactggaatggcagggtccccagcactctagtatacacagcgtcctgtatcttggggaatgggccatgcagcaaacttcgttggcataggacaagggagccatagcacatgctccccagagcctgaaaccctcctgcctgggactgctaccactgaaagcaagcctacctccaccagcagtggcagggctccagtgcagtttcacatgccttagagactagacgtccctgttggtgccactgctgcagccactgccgccatctccagagcatgaagcgtgtactctccacagcctcagagctgatacttgtggcttccgccacagaaagaagacccaatcctccagaagcaaggtcacaacacattcacacattccctgataacaggctctatctgtccacaccactgctgatggtgggcctggggtctacccaaccctacctgccacagctgatacccatgaacagtaccaagaggcctgaggacaatcccacccagcttggcaccacttgtgcagtaccaaaacatactgcccaagggcctgggaatcaccgtgccccatccaccactgctggcacctgtacactctttctgagggcctgaggatggccctacccagcttacagcagccaccattaacaccacagcatgctgcttaggagcctaagggttttcccaccaccattactgccatcactcatgccatacacactacccaaaacccaaagatccacctacccaaccagcccaccactgtcacaggcacaaagaaggaagtggcctagaggttcaagaactggctcacttggactggctaatgctactgactacatacactgcctgggagcctagtgacagtcatgcttatcctatcattggaatcactggggctgagggactgacccatctagaatcctcttccccagcaaaacctcactatagccttacaattaaacctaagctactgaggaaatcacagacatcattgctgttctttacagctgaagaaggcatatgaagactatactacttaatgcacccataatcaaatttaaagtgccctgctcagccaacagcataaatacatctttataaaaaagtcttcctctaagaaagcaaatcccaaaatggaagaagtgactgttacaccatatgcacaaataacaatataagaactcaagaaaaataaaaaagcaaggaaatatgtttcatccaaaggatcccagtgatttttcagcaacagatttcaataaaaaaagtatgaaatgccagaaaaaagaattcaaaataatgatattaaagaagttccatgaaaacaaaaagacacagacaaaataatacaaataaattgaaaacttattcatgtcctacgtgagaaattcaacaaagtgatagatatcataaaaaagaatcaaatagaaatcccagaaatgaagaatttaatacatgaaacaaaaaataaatttaagagcttcaacaatagactagattaagtagaataaagaattttagaatttaaagacagtttttgaaataacccagtcagataaaaagtttttaaaagaatacacaaaatctatgtcacatatagaacatcataaagcaataaaatatttaaatttgggatgttccaaaggcaaagagatacaaagggcatagaaaacctatataacaaaataataactgaaaacctcctaagtctagcaagatttagatatccagaagtagtaaacttagagattctcaaatggatacattcaaaaggtgtttttcatggcacattatagtcaaaatgtcaaatgcaaatacaaatagaaaattctaaaaacaaagagcagggtgtcttgttatatgtaagagaactctcagcagattggcactggatttctcagaataaatcttacaggccaggagagtataggatgatatattcaaagggctaaaagaaaattaaaaaaaaattggcaatcaagattactatacacagcaaagttttgctatatgaatgaagaagaaatagtctttcccagacaagcaaaaactgaaggaatttataactattagatcatccctacaagaaatgtttaagggtgtcctacacctggaaacaaaaggcttatatctatcattgtgaaatacatgaaagtataaaactcactgatagagttttaaacatacaaatgaggaagagaaagaactccaatgttaccactacaaaaaaaccaccaaaccaaaatgatacacaataagaaagaatgaaagaaacaaaagatatgcaaaacaaacataaaatacttaaaacatttacatgaataagtcctcaaatatcaataataaacctgaatataaataaattagactttttacttaaaatatttagactgtctgaatagttttttaagtgatctatgatatgctgcctacaagaaattcacttcacctgtagacacatatagactgaaagtaaaggaatggataaagattttccatacaaatggaaacccaaggtgatcagaagtagttatacttagataaaaacaggctataagtcaaacacagtaaaaagagaaaaagaaggtcattataaaattatgaagggatcaaatatatatatgtgtgtatatattatatatgtgtgtgtgtatatatatatatacatatatataaaccacagtgtaataaaactactagctggtaacaagaggaattctggaaattatacaaatgcatggaaatcaatcaacttggtcctgaatgaccagtaggtcaatgagaaaattaagaagaataattttaatcctatttttgaaacaaatgaaaatgaaaaaacaacacaccaaaacctattggatacagcaaaagtagtgctgagaggaaagtttatatcaataaatacctatatcaaaaaatagaaagattttaaataatctaataatccacttcaagaaactagaaaatcaagaactaaaaacaccccaaacttaatataaggatagaaataataaagaccagagaagaatgaaatgtaatagagacaaaataacacaaagtcaaccaaatgaaaaatttgtcttttaaaaagataaagtcagtaaaccactagctaaacaacaacagaaaacacccaaattaataaattcagaaacataaaaggatacattacaaccgataccacagaaatacaaaaaaaatcagagacaacatgaacaatatatgctaacaaaatagaaaaactagagaaaatagataaatttctggacacatacaacctaccaagattaattcaagaagaaatagaaaaccagaacaggccaagaacaattaacaagattgaatcagcaataaaaaagcctcaaaagagagaaaatcccaggacctaaaggtttcactgctgacttctaccacatgtataaaacaacatcaaaattcctcaaattattctcaaaaattgaagagtagagaattcttcctaacacattatatgaggccagcattattctgatatcaaaactagaaaatgacacaataacaacaaaagctacaggttaatatccctaatgaacataaatgcaaaaatcttcaataaaatattaacaaattgaatctaacagtgcattagaaagacaatatatcatgataaagtggaaggcatgccaaggatgcaagcaccgattgtttaacatatgcaaatcaataaatataatacatcacaataacagaaggaaggacaaaaacagagagtcacataagaggaatttgataaaattaacattcctaacattcctacaggtgtagaaaaaaacacatcttataggtcatatatgacaaacccacagctaacattatactgaatggagaaaactgaaagcctttcttctaagaactggaaaaagacaagatgcccactttcacaactcctattcaacatagtactaaatgacctagccatagacatcagaaaataggaagaaataaaaggcagacaagttggaaaggaggaagtcaaagtgtctttctttgctgataaggtaatcttatatttagaaacacttgaagattcttctaagaaacacttaggccagattaaaaaaattaatttgcatgatacaaactcaacatacaaataaacagtagtttctaaacactaataatgagctagctaaaaaagaaattaaaaagctagtctcatttacaatagctataaaaatacctaggaataaatttaaccaaagaggtgaaggacttctaaaataaaaaccacaaagcactaataaaatacattatagtagacacacaaattaaatgacatcccacgctcttggaaagaaaaaaatccatattgttgaaatgaccatattactaaaatcaatcttgattgaatgcaattcctatcaaaataccattgccattttttacagaaacagaaaaaaaaatctatcctcatattcatatggaaccatataagaggccaaacagataaagcaatcttgagccaaaagaacaaagctggaggcattatattacctgacttcagaatatattacaaggctaacagtaaccaaaataacaaggtattggtataaaaacaggcacgtagaccaatggaacagaatagagaacccagaaataaaaccacttatttacagccatataattttttaagaaaggtaccaagaacactgatagagggaaaggaaactgtcttcaataaatggtgctaggaaacttaatatccatatgcagaagaatgaaactagactgctttctctcaccatgtacaaatatcaactcaaaatgtactaaagacttacacttaggacccaaaactgcaaaactactataatgaaacataggtgaaacattttaggacattggcctaggccaaaattttatggctaagacctcaacagcacatgaaacaaaatcaaaaatagacaaatgtgactatattaaactaaaatgcttctgctcagcagaataaataatcaacagaataaagagacaacctgtttaataggataaaatatttgcaaattatttatctaacaaatgactaatagtcataatatgtaagaaactcaaataattcagcggaaaaaaacaaatgatctaattaaaaagtgaaaaaggagaaaaatatacatttctaataaaacgatatgcaaatggccaacaggtataagaataatactagatatcactaatcatcagggaaatacaaatcaaaatgataatcagataacatcataccccagttagaatggctattattaaaatggaaaaaaattatagattttgttgaggatgcagagaatagggaactcttatatactcttagttgggatgtaaatgagtagattcattatgtacaacaacatggaaatttcccagaaaaaaaaaacttaaaaataaaactactatactatccagtaatctcactactaggtatacatttccaaaagaaaggaaatcagtatatcaaaggtataactacacctctatatctattgcagcaaataacttcacaatagcaaagctatggaatcaacctaagtggctatcaatcgattaatgcataaagaaaataaggcttatatacacaatggaatactattttgccataaaataataaaatcctttttttttttgcagccacatggatgaaactggaggttattatgttacataaaataaaccaggcacagaaatacacatattgcacgtgctcacttatatgtgggatctaaaaaaagctgatcttgtaattgtagagagtagcatgatagttatcagaggcttggttaattatagtcttactactcctcaatcttcacttttagaattaataaaatatagtccataattttacatttaaaacaataacattagaaattatgtgaaagaattaaatcaacttatttttttgaagagtttaaaaaattcaattattacaaccatctaaaacatctgaagtgcatctttcttggacatttctaattgggaaacatttcattatttctacatgattagtaacctgctccactcttcatatatccattctggaaaattcttggtgcctgactttggcatcttattttaatcttttccaaattgtactcataatttgtctacaaactaaggcattgtaaatgctttaaaaatcatgagaggaaggccaagcatggtggctcatgcctgtaatcccaacactttgggaggccaaggcaggtggatcacttctggtcaggagtttgagaccagcctggccaacatggtggaactctgtctctactaaagatacaaaaattagctcagcatagggtgcctgcctgtaatcccagctactcgggaggctgaggcaagagaatcgcttgaacctgagagctggaggttgcagtgagccaagatcaggccactgcattccagcctgggcgacaaagtgagactctgtctgaaaaaaaaaaaaaaaaaagattatgacaggaggcctctagataatattaaggggacttgaagataaaatctgggtcaagttccatctcacattatatttaattcatctcagtgagaccattatcatctacttacctcttttgtacatttgatatccacaattatgtgtgtgcacgtatatacacaaaaaacagacgcacaaacagaaactcagcctccacaaataaaaatgctttccaaaaacatcaataggtctaatttcgtcaatagtgtatgtatctttaatttttttatatatgtataaaggcaaatctaattttttaggctttctcaaactgcttgtttctccacaactctctactattttaaactctgttttgagcattggttactgaaaaatagataaaagagccaatctatagggttcaaaatttctattaagggacctgaatgttttaaaaagagtattaatgataaaatgttaactaataggattgccttcatatgctcacatattgtgaaattatggagcctccctctgtttcagagactccctctgccaagacaataagaaaagcaatttggacatgtcttaaatcacacttacgaagctttaattaaggctaactataaagtttagtcaataataacagatatttaatatttttgagttcatgtacatattcaccagttttaaaatcttattactatattgtccaatacacagattctcaagttaattcagaattaaactctgtgtgtgtgtgtgtgtgtgtgtgtgtctgtgtgtgtttatttttttgttcctattgtctcctggagtttccagcactttgtaaaagataaaaattaactgtttattgaatgttagtgatgatttgttgaataaatgaacaacaaggacaactgtgcatggtggatcacagctgagactgcgccactgtactccagcctgggcaacagagtgagactctgtctcaaaaaaaaaaaaaagataaggttagatggcttaggttccatttcaataaagatttctagaaaatgttaagatgaaagcagacgtttccatagctggagaacagtgtacagcagtacctaggatagtccctgaaacagagggagggtccataattagtgtggactgaactcagagctttgccctctatcccacttgattgcctgtgggatcacacgagttttttctggtgcaggactgtgtgcaccaagtgcatgcctgtatgtgtgaaaggggggatgggaaatagaattatcattccagatctctgtgtgtgtgcatagaaaataatgcagtaatttgctggaaggatacactcatatttttttccacattgaccttctgtctccaaactggtgatttgtttattgaacaagtacacattaaggtcataaattgtggttatgttgtttctttgctacaaaggataatttttaaaatatcactgcagtgttaaatctaaggatgcagggctcttgaatattaagtatcaacttgctacccagaaagggaccaaatgaatgattagtaatctgcttatacagcagaaatagctagtctactttatgtaaaatttagaaggcattaagagcctaaaaatgcattagaggttttttttcgcttgacatacaatcagtaataacaaatagtcataaaatcacaattattgtttcaaagttcgctgacaatgacacacaacccttgtcctttacaaagttttctacattgcaatcagcatcctggggggctgtaatcaggaatgggttagtgctgtgtgagttgacatttcctataacttcaactctaaagatccaatcagaatttattgcaagcactatgtatagcaacctttgactgttacagcaaccagaagttaaatttctttatgtgtgtgaggagagtgattaacttcaggagcgagttcatcatcagtatcagcaatcaaaactggaatgcagcctcacacctaaaaatcaaaataaggttgatggtactgctctattatcaaataagatgatctattttgctggtaacaatttcatgaatttaattaaaactatcagcgtaagcatagggttttttcatctctctcaagttttcatctaaaaaaattctccaggtaattttttaaaaaactttaaaacttatatcttgattgatggttaaaatatattcatgataaacctagaaagaactgtgtaggtatactttattggcaaagatatgctatagagaatatgggtatattatgtaaccaacataagatttagtggaaaagaagactgaacatttatatgcagtctgcaccaaatatatgtgtgtgtgtgtgtgtgtgtgtgtgtgtgtgtgtgcgtattttttaagacagagtcttgctctgctgcccaggctggagtgcagtggcttgatctctatcaggagttcaagaccagcctggtcaacatggtgaaaccctgtctctactaaaaatacaaaaattagccgggtgtggtggcacaacctgtagtcccagctactcaggaggctgaggcaggagaatggcgtggccctgcgaggcggagtttgcagtgagccgagattgatccactgcactccagcttgagtgacagagcgagactccatcttaaaaaaaaaaaaagagcccagctgatgtttttgaatttttagtagagacgaggtttcaccatgttagccaggatggtcttgatctcctgacctcgtgatcctcccgcctcggcctcccaaagtgctgggattacaagcgtgagccaccgcacccagccaaaaatatttttcagttgaatcctgttttgaatatgatttatcatctatgatgagagtacgggaaccaccaagttgttctccataggactgaatgcatttatcatttataaatggggcttatgataagctcaaacacatttttcctattctactggagaaatatgataggcatagttcatttgaataactgtgagtgctagtttggaagttttgtttaatgttctaagaaggggagatattgttgtctgcaatataaccatttgttttattccattaaccaaacaatactcaacagaaagtcttgcacataagatgcaaacaacaaatactagctcaatgaatgaaacagttgaaatgaatcttatgagtgagtttgcttctacaagagctataaaaatagtagaagctccagctgaaatgagtaatttaatgcttgtattaagaaaaacagaaaatatctagagaagtggaaaatatcttgttctgtgttctaaaaatatgacctatctcccacatacatcccaatattttgcaattgctgcaggtgattctctgacttttcaaatatgaaacaaaattaagtcatacgggctatttggaatgagaataattagctatacatcaatctcagttgcatatttaatatagctcatataaatagaactacataaaactgatgcattatttaaattgtgtattgaaaatatattcattttgactgtaggcatattggttattgtaagtggtttatatttgaatacgtaatgtatgatttaaagaatttcattttaaaactcagggtactagtaaaactgcaaaatgtagattattttatgcaaagtttacacataaactctgactatactttctcacaataatataaaaaatcatcagaaaaaaagtttaacaaagtggcatgattgaatactcctgataaaaggctctagactttccataaaggaagaaaatatgagaaggaaagtttaatatttctggaataagtgaataaaaaacactttgttagggtcacaagaagaaaaattgaaagcctttcatcttaatgacacctatgccattaagagtggccaatgacagc

SEQ ID NO: 53 - DNA, 15159 bp, Homo sapiens
ctttgcctactccccgccagggggcctgctgaggtgagccatctggggcttcagagttggctggggcagttgggaccagtggaggctgagggttggctggtgctaggggctggactgggagtctgacttctggtcacatggaggtctgggagtggcctggagggtggagggtgggggctctgaaatgccatgcgccccccaggatctacctagcaaagccttaccagtgggaaagacagagcagggagcaggcaacccagcctgccaccagccagctccccgggagccatcccaggagtgcaggagcagggcttgcttgtggctgggccccccgattccggaacaccaccaccccgcccccttggccttagcttctgcttcggcttcccttgcagtgaggatgcgatggagtattccaaggagttcgtgactgctgtggttctgggcaaagacctcgtccccaggtgagtccttggccccgctccatggtcccttgccaggctgttcctccctcctccaggcctctccccacccccagcccccgcatctctctcagtccgattcctgtctctcaagggaccccacgcccctccccacccttagttgcccagtggtgagaagcccaggtgaacgcacgtgctggcgcccgccctgcctgtcctctcactcctcagctctgctctggggagctgctctgtggacacctctccaccccgtgaccctggctgacgtgtcttcttgttccaggggctaggcgtgtgcctgcccctccgcccctggccccatacctctcatagccgctgaccaggcctggctgacggccctgtctcgttccctccccaggattggcctctctcagctggaaggcttccgcagacagctcctggatgtcctgcagcgaagcaccaagcccaaagtgagcccccacctgggcaccctgcctctgtgcagcctcatctgtccctgcccttgacccccaccggtttcttgggacaaagcacaagaggccctgccatggaaggccagggcagggtgtggctggtgttgtgggaacttcaggaagtcagaccctcagcatccccaagctcaacccatccatcccctgtcattgtgcagatggggaaactgagacccagagtgggagggacttgcatttgctcacataaaaagttagaacagaatcaggacaggaaccgagaggctcccatcacacagagctgggagctgcccacagtcaggagaaagcgatctggaggctttgagcggtgaggaaaggcctctgccgaagcctctgagattccctaggctcagggagggctgggaatgacctgtggagaggatttgggtacagtttgttctgattttctgctgtgaccaagaggagagggtcagcccttcctaatccgcatcaggtctctggaggacactggcagacggggtggccaggtgggggtggggacatggtggccaggcacactgaggcaggccagcgcaggaggagagggtcctctgtgtggtcacccctcctcaccccctgccccccgccccctgccccgggcgagccctcagcccattcaccatctcagccccgtctggaccgttcccagctttggtgccctagaccctgtggcaggcagggccctgggccaggtaccaggtgccaggcagtgagcagggcagcaaagctttgtgggactttgcctgcctggaggagcctggttctggggaggtggaactgctcccaccagattagtcctgggcttttgtcaggccaggcctggcaggtccagctggactcaactccagggtgtgtttggcctcggacttgtggagtgatccagaataagtcccttcccctcactaggcctgtctccccatctactagatgaggggttggctgggcttccagccccttgccagccctgaaattcaacaattccatgtcatctgtccttggcaccttattggccgtctggccaccgtgcacctcagccactgcctcttcaggtgggcaccgacctttaatgctctggccactgcccttcccctgcccctttgccatcttactgcccacctctcacctgctgagccccccttctcggtccccctgcccctgccccccagccagtgctacttagctctgtccccatctctcccactccaccccgcgcagtggcggatcatcgtgggggccaccaaatgcatccccaagtcggagctgcctgaggaggtagaggtgaccaccctggccagcacgcggctctggacccaccccagcgacctaactatagccctctcagccagcactccactctacccgcccggccgcatcatccacgtggtccacaaccaccctgcagagcagtgctggtaggttctgccagggtctgctgctgcagggggtagtggccagggcaggggcagtggagagcagggccggccttggctcaatcaccgctcggggctgggggtggaggctgggagaagatggcccagggcctccatggaggggtttccccagcatcgggctctggaaatggaacaaaaggccagccctgagcaggactccaggcgtctctctccatagtctggctttgcctccagtgtcagcccttccctggtgtgccccagggcagctctccccactggtggtccatttaaaagtaggtgccctggagggctcacccctcaggccctggccagctcacacctcagttgtcacttggtttcaccaagggaattcctcgaagacagctgtgagcaaggtgggggctgcgccaggagagagaataggagcaggcaagtgggtagacctttcccactgtgctccttcagacggctgggccctggctcctccctccagggtcggcttcctcccctgacacagctggtgagctgggccgtgcagcaggtggagcaggtgtggcccaggccaaaagcaggtcgaaggctgtggagggaccatggctgaggctcgaggtcagcctttcccaggctgagggcagggcaggagccaggccagggaacagagccctgctgccaggcaggccaggggcctccaaaccatgccagctctgctgagcagggcagagaacagagccaggaggccctggcaccgagggccaggccaccaccccacccttaactcccctctgtccatgtccctctcagctgctgtgagcaggaggagcccacatactttgccatctggggcgacaacaaggccttcaatgaggtgatcatctcgccagccatgctgcatgagcacctgccctatgtggtcatggaggggctcaacaaggtgaggcagctcccggcagggtaccaccagggaataaggcactgtcaccccatcagaaccccgtaagcaccatcagatcactgcccgattttacagacaagggtgctggggctcagagaagtaggtagctgggccagaaagccccactcaaatacttcaacctcacacccctggctctgtccacatcaccacgttgccccatggtggggaggagataaggagactcccaggggcctgtccctgaggcaggctcagctcagaggcccggaaggccacctggcccttaacagatgaatgggcaagcagcgacagccacagccatcccctggctgcggaaaggctgaaggcaggtagggcaggagcactcgccgggctgtggggcgagtcgtgaccagatgggcaagtctcaggccttggggagtggtgacctcaggaggaggagagtgggacccaagtgactccatgaggctttgcttggcctgagaggcctgggccctggctccacatcggccccacgatggggcctgatgtccctccaccacccccagcctcctctgtcctgtcctcaggtgctggagaactacaacaaggggaagaccgctctgctctctgcagccaaggtcatggtgagccctaccgaggtggacctgactcctgagctcatcttccagcagcagccactccccacggggccgcccatgcccactggccttgccctggagctgccgactgcagaccaccgcaacagcagcgtcaggtgagccttggccactcccagccccaccccagggtgagtgtggttcagagcacatagacttgtgtgcacatgcattttgtgcatgcactgggctcagctctgcacacgtgcacaggaggggtcaaactcaccctctgtgctctagggctctcttgctgtgctccagctgtcccacagcctgctgtccctgaatcctacatgagccaggggaggcacacagacccacaaaccctgggccacaaaagcacagattcactctttttttttttttttttttttgagacgaagtctcgctcttttcccccaggccggagtgcaatggcgcgaccttggctcactgcaacctccacctcccaggttcaagcgattatcctgcctcagcctcccaagtagctgggattacaggcgcctgccaccgtgcccagctaatttttgtatttttagtagagatgggatttcaccatgttggccaggctggtcttgaactcctgacctcaggtgatctgcccgcctcagcctcccaaagtgctgggattataggggtgaaccaccatggccggcctgcacagattcactcttacacacttagacgcaaacagatggacacccatttacttacatatttgtattgaagcttacacacatacatgtgcacacaattattagttataagtacacaggtcaccccctacagacatgcacatgtacaagacacacaccaagacaaaggtggagacacatatacaaggacacatgtggacaggcaggtgctcatggaaatgcatgaatacacctgtgcacagacccagacacacaagccagctgacatacacagacgtctggtctacacactcatacacatgaacagaggcgtgcacacatgctcacaggggcacgcacatgggggccacagcgcccttgctattcacacactctttgaggggtgcgaggctcttaagtggtagtccttccaggggaggattgtcctgcctttctaggaccttcccacacaggccctgtgtgcttggtcacagatctggtcaagaggctgcttcctggcccttggtagggacaactggacgtctctccctgccatttgtgcatttcctgtggcagctgcacaacccgatgaagaagccagtgtccatttccggctgcggtgactgctgcaagccacccactccctgccctgtcactcattccctgcaggctggtctgcggagccaggggcactaggctccccacccagcagagggctgcggcccatgggagacaggaggagacccggatgaggaaggaagtgatgagatccctgggagtggcacccagggttgctggctctgagattggggtggaaccagttgggcagctatgtgcagggctctctcccttccctgtctccctgctgccctctgtccctccctccctccctcccttcctccttccctccctccctccttccctccctctgtctctctcattccactgtggcctcatgagtgacctggggcaggctcatgagtgatctggggcagccagtctatcagagcctcattctcacattggtacaatgacaggggttctggtgcagagaaccccagcagcactcctgaagtcctagtgctgccagcagggccttagcccctcagggaccccgcggctcaacccagcatcaactcttttgtcttctatcttgggttcttgtgagttgtttttaaaaaataatcattcctggctgggcgcggtggctcacgcctgtaatctcagcactttgggaggccgaggcaggcggatcaccaggtcagcagattgagaccatcctggctaacatggtgaaaccccatctctactaaaaaatacaaaaaattagccaggcatggtggcgggcacctgtagtcccagctactcgggaggctgaggcaggagaatggcgtgaacccagggcggagcttgcagtgagccaagatcgtgccactgcactccagcctgggcgacagagcgagactctgtctcaaaaaaaaaaaaaaaaaaagaaaataagcattccctgctgcacatcatcaacaactgctaaatgaactgtaccctttattccctgcaagttccttttagccagggagctggggttcagtcccctctcccttctgagtcttataccccctgctctcctctccctctgcaggagcaagtcccagtctgagatgagcctggagggcttctcggaggggcggctgctgtcgccagtggttgcggcggcggcccgccaggacccggtggagctgctgctgctgtctacccaggagcggctggcggcggagctgcaggcccggcgggcaccactggccaccatggagagcctctcggacactgagtccctgtacagcttcgactcgcgccgctcctcaggcttccgcagcatccggggctcccccagcctccacgctgtgctggagcgtgatgaaggccacctcttctacattgaccctgccatccccgaggaaaacccatccctgagctcgcgcactgagctgctggcggccgacagcctgtccaagcactcacaggacacgcagcccctggaggcggccctgggcagtggcggcgtcactcctgagcggccccccagtgctgcggccaatgacgaggaggaagaggttggcggtgggggtggcgggccggcctcccgcggggagctggcgctgcacaatgggcgcctgggggactcgcccagtcctcaggtgctggaattcgccgagttcatcgacagcctcttcaacctggacagcaagagcagctccttccaagacctctactgcatggtggtgcccgagagccccaccagtgactacgctgagggccccaagtcccccagccagcaagagatcctgctccgtgcccagttcgagcccaacctggtgcccaagcccccacggctctttgccggctcagccgacccctcctcgggcatctcactctcgccctccttcccgctcagctcctcgggtgagctcatggacctgacgcccacgggcctcagtagccaggaatgcctggcggctgacaagatccggacttctacccccactggccacggagccagccccgccaagcaagatgagctggtcatctcagcacgctagcaccccagttgcgtggccagccgggcccaggcaggagcaggtggccctgtgggcacctggtgcctgccccctgccgggcagctttaaggacagacccccaggggcagtttagcctcaggcacaggcatcgctgctgagctgggggtccgcatccctacctcagcttaggacccccagagccaaggtggctgggatctggccccacagatggggaaagatggggaagggtgtggagtggggaggagcctgggcagcctgctgggtgggccacactcagcctgactgccctccatgggggcattctggcaccccctgctccaggacaggccatgggcaagctgcctcccatcactgcctgctggctgctctcccaggggccaggtggagagcagtgccccccgacacatgtattctcatctgtggtccaggccggcatcgtcctggccaccccccagatctggtgcctgctggccggccccctggggtgcccctgccgaggtggcctgcagtgctgtacatgtttacagaagctgctgggcttggctcaggatgtgttctgggcttgcaagccccccgcccaatcatgtgttcagtagccgtcctctgagcagggcccaaggcagccaggggcctggaggggccagaggagggtggggtcagggccgccccttctctgccttgtgcctctcatgctgcctcctctgcccatgggtcctgggcacccaggcctgccctgcctgctggctacttcctggcttaccttctacccccaaggatcctcaccacccaaagggtggtgggcactgctgtgaccaccccagctgcagagtcagtgccctgggtggaaggaaggcactgagagcccccttcctctgagggccccacctcaccccttggtgtcacccccaccacgcctaggcagctctgggccctgggatctggaaccaacacacccctgttcccctcagctttccctcctcgctggcctgggcaccctcctgggagcaggccttcctccctcccacccccaatgtcctgttggtaggaggtggggccaagagtggggtatggtgggccttggctggagacctctgtccactgcccagggaggggcctggggctgggagcagtcccggtttagcctgaggtccccatagggcttcctcccctgctgggtttgggaagcagttagggagatagcgacccggagtttccccagaagcggggtgggagggtgtgcatgctagtgttggcgcgtatgcatgtgcatgagtgtgcaccgttcctaaggaaggggcctctggggctgcccaccctacctgccctgcctgcctgctgcccctcccagcctgccaagaaaacggtaggggagcatgatggggcctttgaggcagggtcgcagggacaagctcagctttaggcaccatctgttcccatcgcgcctgctgctgtgacccgttttggaaaactggtgtgtaccgaggcgctgactgcacggctgaccgcctgctcgtgccttcattctgcagcggcatggtccctcccattctggctccacctgcagcctccctgggtggcctaggctcccccgaccaagagacctccctctcatgatcactggtacctgggggcctgaattctggcccccggctccccacacagctgggactggcctggatggctgtcctgggagcccctgcccaccctgacagagggagctgggcctcccctcatcctctgtaactcccgccttcaccagactcaaggacaccctggccctgctgaggcatacagagcttcagcccagcacagaagcaagacaaaatcagtggctcttagagtttagaaaacaagacagactctcagatgaaagatctgacaagcaccgtggccagtcacagggagagacttgatgtctggccttttaattcctcctctgccagggtgggtcctgggacctctaatgtgggcatgtcgtccaccccaggacgagccatcagggacagaccccccacccccaaggctgcagccacaccatgtttcaggcttggggctggggcaggcttgggctcaatcctgggcacccaggggcagcccacccctaacctggctcctacccacctcgcccttgaaggatgggcctgctgcacgtctccctcctccaccccataccacactggggggtctgagccacccccctcagccccgttcggctcagaccgacccccactccatccccagacctgcagcacaagtgcgcgggcctgtcctcccaggggcctgggcgactccatatgcaatcagtagcgagcagccgggccccacagaccctcatgcactctcttacgtgccattctccccagactttttttgtacttaatgtatgaaagatccaaactaatattgctgtaaaaaggagagacaaattaatatagcttattctataaatatatctgtatataaaggtttctgtatattgtatagagctgtgtataaactggatgtagaagcacgctggctgcctcgaatgtctttgcatcaggtggggactgggtagaaatttgatgtcgaggttgcagcagagcagggggttggcatggggccgggggccgggggggcctctgccactgttccctggatggaacagaaagcctaagggggaaacagattccttgggaccagagcccgtttcacccacaagacgcagggtgtgtttgggtggttcaggtccagccctttgtctgtattgggttagaacttcgtttctcaaagttcacggtgctcatgactcactggggcgcttgctaaatgcaggtgcgggtttagtggtccggggtggggcccaggtatagatttcttacctgctcctgctcggctagtgccctggcccggggccacactttgagttgcagggagggagtagaagacccttgaagccccctgtgaatgagggcagccacttgcggagtcctgcctgtgtgagagatgtaccagcgggtgcacgttcatactacagcctggaaagatacagcttgctggcctccccttcctccctgaggggtctgagaggattagctgcccaagactgccaagctggcgactgggggaccaggctagtctgaccatgcccacctccctccccaacaatgcagacagctagggcaggcaggggtggaagatcccagtgggacagcactgaaatgcaggggccactagaagtctttgctgagggctttcctgagagggcgcaaaatacctggccagacccagtgcagcccaggaaccccaggccagcatagcttccgggcagtgaggcctagggagtggctggaaggcccaggtggtggggcctgccccctctacacagcaggtggcgctgttcagccagtcagtcccgccttggccgcagagtctggcctcggcactgacccagccaagctgaccggacctttcccttcccctgaccctgcccccatctcggcccccagtgtccagtggctctatttggtgaggggctggggagagtgatagaagaatgcccccagccttagagcctgtcttcacccacagccactgaacagaagcagaaacgggccaaacaagggtgaagacctgcccaaggtcgcatgggaggtggggacagactggggaccagaatcagggcctctcagcctaggactctggcctccaccacacctgatggctttcagaggttctttgccctcagtggtctcaatggtctgcaaattatcctgtccagtgagcacagcacaggcagaagaaactgaaggccagggaggctctgtggcttgcccggggctgcagccagggtgtggcattggggagggtcttgagagggcagtgctgggaagggctagagaggcactctgcctcacgctccactcaatacctgcagcagccccctcctgtcccggtgcccctgcagtcaggaaggggtctaccctgcaggaccccacactcaggtgtgcccttgggccctagtccggggaagctggaccaccagcctcactggcttgctggattgacactcaccccactttgagccctcctcttcctctgcgaaatggcctgatgccagtgctgtgtgggtccacaggaggccaggagagtcccacggtggggaggacagggctgtaccttctcctgggctggcctctacgcccattacccattaaccctcaggtgccagcatccctctccccagtgctgccttcggtctaccacctcctcctggccctgctcccactcaagggacagtgatgggtgctgagagctgattggaactggagagggcaccatttactgatcactgacctggcactttacctccactgtaaggcagggatactgagtgtgctttatagatgaggcctctgaggacagagggcaggccttggggactaggtggagctggctacaggggacagccatgtctgctgggctagggctgaaatctcagcccctcactcactgtggctcggtagagaagccaggggcacagatgaggactcatctccattgatgggcccccctaggtccttgtatgcaagtcccctgggctactttcaccggcccagccaccttcctgccccagcctctgccccagcgctgcttgggacccaacttcattatggagttggcagatggcagcctcaactcttggctgagcccttgagtctgggacatttcagccacctctttcctccagtccagagatgaaaatccctggggacagttgctcctttgctcagtgacctagtgtaacaggggagatggcagggcctgagctcccttagccaggtcagctgctacagggttaacaggaggctccattccaccccttccaacttcaaggctaccctagagattgaataatctatactcttaattgattataatgcaatggagttggggcgttagggacaaagtacgagtcttcccttctacctccagcccttgctgaccaggacagggacaatgtgtagctcaacggatggtggtgagaacttagatgatggtcagttatgcagtatgtgggatacggaggaaagatccgtgggtatgtggaggcttgtagagaagctggttctgtggctggtcccaggcgactcgtaatgtaaatccgtttctcagaatcgcgtggtgtaggcgggtgtctactttgtccgcaggcaggcctgaccccgggtggaggaggggcagggtggagaataacaattgtcttaagggagtctgcggagggagaaaaacctctggggtgtatcagctggaaaagaataggagtctcagtgtggcccctctcccccctctcagcccagcccctgcgggggcggtgagggagctgcggtcagcacacacagctggggcctccagcaaaatcccattctatatatctaagagcaacagctctgagagcggcccccagagggacaaaacctcattgtgaggcacccgccggcctcagcaccccctcccccaaccccagaactgtcgtggcattgacccttttcggcgggccaccatgggcctgctgactgggccacatctggggctcaggcattggctgcccctcccccacggctggccactgagaactgacagggaggctggggtgggagcggcttccaggcctctcaccccatccccacggggtggcctggcttgtgccccaccctccctggggatgctgcaaggcagaggtgagagtccgaagctggctacgttggcatcttgatctgccagcagtcccccacacctctggcctctgtttagtggcttgtcaaacagtggttgggtggggtaggtttttccagcttttacgtgctgccttgaagggtcccgagaggcttcaagttgagccactctgaagcgggatgattctctaggtctgggattccagaattatccgctcccaaggtttcagaggtccaggattctgtagatttttgtttgtttgtttgtttgtgtttggagacagggttttgctctgtcgcccaggctggagtgcagtggtgcaaacatggctcactgcagcctcactgcagcctcaacctcctgggctcaagcgattctccttcctcagcctccccagtagctgggatcacaggcatgtgccaccgtgcctagttaattttttaattttttgtagagacagggtcttgccatgttgcccaggctggtctcgaactcctggcctcaagcaatcctcctgcctcaacctcccaaagtgctgggattacaggtgtgagccactggagcctgactggattcggtagtttgaagatgccaccatacattcattcaacacatttattgagcacctactgtgtgccaggtcatgttcttggtgttgaagctatagcagtgaccgatacagaaaaatatcttgccctcgtagggcttccattctagagcaagaaggataataacagaaactaaataggaatcttttacatggtgagcaagaaaggcctaggtagggagaactgctttaggtaggctggttggggacatgacatttgagctgagaccaactgctacaaagaagtagccatgtggagacaagcattgtaaacagatggaatagcatgtgccaaggccctgtggcaggtgtaggccttgcatgtttgagcaatggcaaggaggtcttggtggctgttattcagtgagcaatggagagaggggaagagctgaggccagtggtagaggcggggcctgagaaaccagagcaagacattcagatattgttttgagtgcaaagggaaacttagttttgcaaaggaatgacatgatcggatgtatgtttcagaaagggtgatttgggagaactgaaggggatatcagtgagacgagaggctgtgcaagttgggcaggacagagatgtggaggcagtcagtcataagggtgaaggcaggggcacaaggacaaccgctttatcctggacttatatcgagttagaacctccaggtttcattataccagacagggccacggcaaaggagagttcggattcccggggcagccaggatttggctctgaactttaatgaccttgaaactcttaggcagggcggggagcggtggctcatgcctgtaatcccagcagtttgggaggccaacgtgggctgatcacctaaggtcaggagttcgagaccagcctggccaacatgaggaaaccccgtctctactaaaaatacaagttagcccagcgtggtggcgcctgtaatcccagttactggggaggctgaggcaggagaatcgcttgaaccgaggaggcagatgttgcagtgagctgagatcgcgccattgcactccagcctgggcgacagagccgaactccatctcaaaaaaaaaaggagcttttagacctgcattgtccaataccacagccacacgtaactgtttaattacaattaaacaaaatgaaaaaatcagttcctcagtctcaataggcacatttccagtgctcacttgtggccagtgactaccatactgaacaacacagggaacatttccatcatcacagccacaggacagggcttcctggcagtccttaatgcattgagcctcagtttccccatctgtaaaatgcaggtaacaacagcatctccttgataaggtgcctgtgaggagtacatgagataatgcctgtgtggcctggcacataacacacgttccctaaatgcaggttgttattgttgctgagcggggtgtgtgggtggctaacgagagggatgggggctgtctctgaggtttggattcggaatcgtgacatcttgtcccgtgcaagacgaaggcgaggacggcgagggcacacccttccagtcccgaccccacagaggccaagcggcccttcgcccccaccccgacccgggaaggccccgcgcccctcaagcctgggacggtctcgcgtcccccgacccgggacggccccgcgccccg

SEQ ID NO: 54 - DNA, 16194 bp, Homo sapiens
ttccagcttccagcactgctagggttcctggggctttccgtctctgatccggttccataagaggtggagcctcctcgagtaatctcatttccaccaggtctctctaactccattctcatctgcggcatgtctgttaatgccttccactctgggggtaccttctgaagctggctcttaaaatttccgggaaccaagtctggaactggtttcatttttatcagtggtaagtgttgcctatctctagagggaagtaagtctttggcaatgacctgttcaagttgcttctgctgatcttcatagtccttcagatctacttcacgagctaaagccctactgcatgaccctcgacaagatcggatcttaatatcaatgtccacctagagagaggggagaaaaataaagagaaaatgtagatacaaatacataaactacgtctattgagttcctggtagttaattttccttctggaaactggtttcattttttttgactcggagacctaccacttaatattctctgttttctgcctatcgagcaccctcagtggaagagatgttgggtattgcagggctagccaggataagcaatggatgctgtttaattcatcttagcctcagaatggatcaagagtaaggtgctattccctctcaaaggaaacgctaattaaatgatccttggtgaaactcaggctgagggctcagaggtgtggtgatgtaatgggctttggaattagacagggactgaacatttgcttttgaaatttactatctatgtaccgttggaaaatttacttaatatctctgaattttttttcttcaactgtggagtgaggaaaataatacctacttttaggtagatgatggatataacacttttctctgcatatagtagacactcagtgcataactatcgccttccttttccctctactcagaaacaaggacatctgggaccacagccacatacttacctccagtcgtttcatatcaaccaactgagctctaacatttttctgcagaagctggatatgctgtactttttctatgactttgcgcttcaggacttcaattctgcttctcagatcctctgacactcggttgtaggtattatcacggtctgaaatcgaaaatatggttattgaagtagctgctgagtgatttgtctgtaattgccagcaaaaaagaaaggaagaaaggaaggaaggagaaagaaagaaagaaagaaagaaagaaagaaagaaagaaagaaagaaagaaagaaagagaaaaaagaaagaaagaaactagcttgtaaatatgcctaattttattttggttacagtttaatctgtgagttcaaaacctatggggcatttgacttttggataatgttatgccctgcagccttccatgaatgccagttaagatgtcctaatagcaattagtaatcccaaagaaatatagaagaagaactttctttggaattttaaaggtgtaatttggagttaaaatagttggtttgattgcatttcaattattttataacatccttaatcaagggacttgaacatattggattttcttactgatgagcttttctttttaatctatagatttgaaatggttcctaagctgttttgggtcaacaggatcactcacttgccagctagtgttgcatcactgattttaaatgtcaagtgtttgtgaaggtgtaaaaaggcaaagcaaaacttgagaaactgaggactccctagactcgctgtccatgcccagagtgaatgcaatgtttcctaaccctaatgagtagactgtgagaatgacgtagcttgaccctatattttaaatttaaaaatctacctaatcagctcagtggagtctgggagttgaattcccagctctgtgtctttgaacaagttccttgacctctcagttttcacctttacaaagcagaaacaaaaatatcaactcaaagagtctgacccatcctactttcagtatatactgttgaaaagaacacatttaaattcttgtttttaatccaaaattctgacttattttgtgaccttaaacaatctcagttaacatcttttactttgaaaaaataacgaaaacaaaagctccctcttaaaattttcagggatattatgaaggtatgtgtttctacactaagtactttgggatgaaattgtcatagatataagcggatatcatatttatttaggatttttgttgtttctgttataaagtcaaagcagtaaatatgtaatacttactattggctgaggaaaaatcgcctctcaaaatttccattatattagtggtcaacgaatgagaatccttattgttcttctgatattcaaatagtgaatttttgagcttatttattctgtttgtaaaatcttgattgacttcatcaatcaaccctttcatcctgcagccagaagggcatttgtagttctgaaagtgaagggagaaaattacagtaaggatctatctctcagattcagaataattttgcatgtttccatgcagcccccatttcttcctaccctatctcttccagataagttggcttaaaagtaggtaagaggactagttagaggtcgcagagaaactctggaatgagggtccacttagccataaattaggtgccaggaaattgaggccacaatactcaggagcctggttttgcctgagcatgcaactgaaatcctgtctgttcacccactaatgatccagagttggggaggtaaataaacagtgctcttgggagtaggttccttttctttatttgctatgtaggtaactattcaattattttctatttaaaaaagtttctgggaccaatcaggtcagcctgtgagcccctctagcatcagagggaaggaatctcctgcttcccccgctgactgcttacccagtcttcatcagagcagaagggccagtctgaatctttgcaggcagattgatgtctttccacaacccttgggccacgcacgcctcctccttcagctagaaagtcaccttcaccactatctgcagtctttaaagattcattcacatacacaaaagagagcaacagcaatgttagccagaagaggagacagtggcatgcctacaagtccccaggaagagatggcactctcacagagattaaggagagcagacacagggcttcggcaagcttcaggtttcttatcttcaaatggaaatcctaggacccattttatggagttgttatgagaattaaaggagacaaggtgtacaaatttcttaactgtgtgtgacacttaaataagcatttgataaatattaggagttttaaagaatccatcctaaaaggaaaattatttgaatctataaaatcagttaaattttaccttttcatttttactaatgactgcagacagaaagttgaaaactactgtagagctctttctcctgtaattgctgcttcagtagaaaaacctagactatcttaactgaatgttcctctctccttcaagtttctatgtaacctttagagatggattcataatttaaaagaataccattactgcggaaaagcgtattgccttactaactaatctcttctgatactgcaaagatatttccaaagataattcgtttgctttttcttctgtcttgacaaacacaacaataacctttcagcaaaactgtactaacactaaaagttctgcttattatggacaagtagcaagaaattaataactaaagaaaacaaatcttaccataaaatgttttattccattaactagcattataatgcaccaaggctttataggtacaaggatggcaaataattcttgccctttttaaaacaaaacaaaacaaaatgtggtaagactgaatgacagatgctaaagtttcccttgtgagtttgtacactctcatccatctaagatcttcctcttggtgtcatattaccctgtattcttgaggtgtcaagcccacccaggaaatttcctcccaggcctggggtcataaagctaagagtgtgtcaggacatagagcaggtagactctgacctccaggctctttgtggaataaacaccagagagaaagcaagaagaaaaaatgaaaagggccatacccatgctgtgcccaccacacttaggaccaggcagacgatcctcatggaaaacatcttttctaagggtggggctggctcctgaggagcactccagctgaaagaaaggattgctgccactcctagttcccatcctatttaaatctgcaagaggtttggttaatcattggctttgtcctgtgtagacagtcaaccctccctctacgtcctttgttcctcctatgctgttggtatcccagaaattcttgctcaattcccctcagcttgtttgcttccgataagctgttgcaaaggtagcatttgattctccagtcaacaattaggagatctcacattccaggaacagggtggctttgagaatgaaaagaggagcataggagggtatatccatatttctaaacgtgaaagaatatagaaggtgcttaggtaagctagctgtagcccccagtagtagtgatttagcaaacaatatttcactttatgcagaaattagggttgggtgatctggcttataaaaaaaataactttggggataagctggccctgaaggctttctataagtttatttagaacatattacttttctctatttaaaatattaagatgacagcagccccaggaacaaaacatcttgggttcataatccaagctgcaccacttccctgctctatgttcttggacaagttactttacctctttatacttcagtttcctcatttataaaataaggatgctgataagctaccccatgcttttatgaagaataaatgagttaattcttgtaaatctctcagaacagtgactgtcacataggaaatactcagtgaattatgggagatcataaagtgccatgaaaaataccatttatttcctgtttctgtgctagcaatctcatttctgagtgtatttccaaaggaaatgaaatcaggatcttgaagagacacctgcattcccatgttcattgtagctatattgacaatagccgagatatgaaaacaacctgtttccactgatggatgagtagataaagaaaatgtgtatatatatatatacacaatggagtattactcagccttgaaaaagaaggaaattctgtcatttgcagtaacattgatgaacctagagggcattatcctaagtgaaatgagcagatatagacagacaaatactgcttagctggtcgtggtgacaggcacctgtaatcccagctactcaggaggctgaggcagggagaatcacttgaacgcgggaggtggaggaggttgcagtgagccgagattgcatcattgcactccagcctgggccacagagtgagactccttctcaaaaaaaaaaaaaaaaacggaaaagaaagacaaatactgtatgatctttcttacatgtgaaatctaaaatagtcaaactcacggaagaaaagtgtagaatggtggtggccagggcctgaggcataggagaaatgggggagatgttggttagagggcacaaagtttgagctatgcaatataaataagttctggagtccaatgtgcagcatggtgactatagttgataatattatgctgtatatttgaaatttgctaaaaaggtagatcttaagtcttctcaccacacaaaaagataactatatgaggtgttttaagtgctaattagattaatagtggtaatcatttcacaatgtttatgtgtatcaaaacaccaatcagagagaagttcccctttaaaggaaaataaaaaaacaaacatccagctgtacaacctaaattatgcaatttttatttgtcaattatacttcaataaaggtaaaaaacatcttcagcttacatttaccagatgtattaggttggcggaaatagcaaataaaaataagagtgtcccagttaaatttgaatttcagataaacaacaaatctatttgagtataagtatgtctcatgtgatatttgagacacacttaaaatttttttgttgttcatctgaaattcaaactttactggacatcctgtactttatctggcaatcctaccttgcctcaaattctgcttcctacatgaagccaatcctaatagagtaatagctaatgtgtattgaatgtttactaagtcttgggttctttgctagacattttgcagggtacctgattcaatgtccaattaaaaggaatctcatgttctttcatacttccttagactgtgcaccactaatggcatttatcattataggagtaccgtctgtctcctccactagatcataaacttgagaattgaaatgttttattggtctttatattctccccaaaaggtgtgggccctcattgagcaagaaagcataagtgggttccagagatgcgaagttgcctggctgcctcccccagcactgcagacgtgtgaagctttctataaatggatggaagccctggtgcaaggcagtgcactgtctgctctatggaagactccttgtctgatcaagctcacccctgaagcagcttgctatgattttagagttaactgcagagcaaagaggaagccccagagccccatccaggttccagagggcaatgattccatgaaaagctgggttacactcactcacaatgactgcactggcaaaatgtcaggattagataggaaggtgaggcttgatctctgcacacattttcctatgcccacaagaagtgcccctttgggaggtgaacatggtatatagcaaagaagttcccgagagtaacctggtaggccttaggtgagtcggctgaacataatctgattgaaggtaaattaacagaaaacaatttggttgaatgccaccaccctagtgccatgtcagggtgtttccaaggatgccacctgagggctttatccttgcctctcagaatcagcacatctcacaccctttcttactcctggcctctgctcacatggcatctactcagagaggccttctctggccacctgatctaaagagctgccactctcgcatgtcattccattgactctgcttggtttttccacgcagtaccttataactcctggacaatgtgcatttgggaaggtatttgtttattctgtgtcttgcctacacaaagcttcctgaggccaaggcacaaggactggcacaaatgtcaggcatagagcaattgctgctcagtatctgctggagaaatggaaggctgtcaccatatggtggtgacaatgcatggtgggctttccagcatgtgagacctggattccagctaagtgacatgggcaaactatttaaattctctgagctataaatgggatgatgatatttgtcttacaggattgctgtgaagattatgtaaaatggtgtatgtaaaatgttggccatacacagcaggagctctagaaacagtagcttttattgttcctagaatatcccaatgctccatgataaaatgttcccttgttttgactgtagtaccaggagtccctaatgaggcacttctgtagctcactgtttggccccacactgcaggctgctcactaggctgggctctctgccccatgaacaggctgtattgtaagctttggaggagtaggttttgtttagctggaaaaccatgcaaattaataggcatgatacgagtatcattttttaaaaagcatgtgacaataagcgtatctttaaatgtgcaaaactggaaaaaagatggaagaaattttcagttgcttaaattataatctgccgtgcattggctttttctttttgagatggagtctcactctgccacccaggctggagtgcaacagcgccatctcagcttactgcaacctctgcctcccgggttcaagcgattttcctgcctcagcctcctgagtagctgggattacaggtgcccaccaccatgactggctaattttttgtatttttagtagagatagggtttccccatgttgaccaggctggtcttgaactcctgacctgaggtgctccacccacttcagcctcccaaagtgctgggattacaggcatgagctactgcaccaggtttgtctttttcctatagataactacatcctatttaccttagctctaatgagaaggatgtttgatatatctatccttttgaagttaatgtaatataaacatttaaatataaatgttaatataaacatttgaatgcaggaatttacacatttgttatgccataacttttggcatgactagaatagtttttactagttttaatagctttatttgtgtggtatataatgtatacagaaagagtagaaattctatagctatatgtttcagttttaaactatatctactcatcacagcttccacaggaaaagtaaaatatataaccagttatctatatatttgcaattgtataaatacaacttaaaaatacaaaacaaaacaacagtgttattttgaatggaatatttgtcttaccctgggctgacaccagaaattaaatgcattgatttctgagagcagctcactcattcactcatttgtctaaatttagcaatcatttatcctatgtatattatttctctagtcctgcatactatgtgcttaagataaaaaggcaaacaatgtatagtcttttaccttcaagttgcttacaattggcaagcaagtcaaatacgttatgcagctgagaattaagttaaactatgtaaacttgacatttttgtaggtcaaaacaataatatctacagttttatacggtttaatctaatataaaacaatggaaaaaatctgtaagctatatgctgagttctgttagaacacacagcagagagtgttatatcacttacgtattgctttttgttttgtttgtgtgagatatttcttaaaaagtcagatttaattcaggtctcaaaatacaagatgtttctgaaaaattcttatgtcatctatcataaaaatctacatgaatctgtacattctttccaaagacatttggtatcctaataacaagaagataatagtactttgacaggaactattttgttaaaacaatattaagtgcattcttggaaagtactaaaattatcttctaaattttgaaatgactaaattataaaaatttacaagattttggcatttataaatacagtctgatctgtaatgaattcactggacaacattggcaaagctatttaactttctgtagtttttttatttttcttttttttttttttttttttttttagagacagggtcttgctctgttgcccaagctggagtgtagtggcacaatcatggcttactgcagcctgaactccttgggctcaagggatcatctcacctcagctgcctgagtagctgggattaccagcttgtgtatcttattttctctatttgtcttgtgcacctcaagggtattgcaaaagtttgtctttaccaagctgcttactgtgaaaggtaaatgaactggtaggatgacctatgtaagtgtgactaatggagtgtttaatgtttattttcagaactcatcaattttctgacctcaaatggtttccccagaagttacagctgcaaagataaaataggaatttccttaatacccagaagtgattctgagttgcacttaagaaagtgaggaggaaaaaaaaagagctttttgtgatcgtgatttattctatcacactgttatttctctttaatctctttcttcaggaaagacacccattttattttttgtagttgaactgactttagattaatgaccacttaattgaataactttttatcatttttgagattaaaatctattctgttccaataatataataataattctgtttttatccttaggcataattttcatggtcttttacttaagcacttttaatcaagttctcattaagtagttatgagagtgtgtgtgtgtgtgtgtgtgtggagagagggagagaaagagaggtgaaagtagagtctttgagtttttcttactgttttatctcttttcatgtttaactgcagtatcaattacataattcatttttcaagattaatttatcttacctataatgtgcgtgatctagatttactaatttttggcacttaacgtatattaaaacttaaatgctagttttgaaaagtaaaaccattatacagataatcaattgatgtattaatatcaacaacatggattcattctcacatcatatctattaaatccatggtattcagtgcattgctggatggtctcactgtggttcttctagtaaagactggcaaacaaaatctaccggttggtgttggtttaacagtgacatgttaaaaattggagaaatatcatctgcaaggcatgtggaatttccacaaacaaggaattatatgaaaaaaaggggtaagtcaattaccaagatccatataattatctgtggtatttattgggccctatattaatggaagattttacataaaaattttacttagataaaatttgacaaaaagttaccaagaaaaacagtagagaaacctaaactgagggacattttacgaaattcatgactggcacaccagaacagacttccttaatttgtgaaggttgtgaaacgacaaagaaagactaagaaacagggaaccagaggtgactaaggagatgtgacaactaaaggtaatgtggtatttggatgggatcctggacagaaaagggacagtagtgtaaaaattgttgaaatctgaataaagtgtgaaggttacgcagtagcaaggtacctgagttggtttcttagttttgacgaatgtactatagtaatgtaagacactaacgttaaagaaaactggggcagggcgcggtggctcaccccgtaactggggccaggtgcagtggctcacgcctgttggggccagggatggtggctcacacctgtaatcccagcaatttaggaggccaaggtgggcacatcacctgaggtcaggagttcaaggtcagcttggccaacatggtgaaaccttgtctctactaaaaacacaaaacttagccgggtgtggtagcgggcgcctgtaataccagctactcgggaggctgaggcaggaaaatcacttgagcctgggaggtggaggttgcagtaagccgagatcatagcactgcactccagcctgggcaacagagtgagactcagaaagaaaagaaagggaaagaaggaaaggaaagaagaggagaggagaggagaggaggagaggaggagaggaagaaagagaaagagagaaagagagaaagaaagaaagggaactaggtgatagtctagtgaactctgcatagtacctttacacattttctgcaaataaaaacatgattccaaaattaaagctttatttgaaagcaaaagcaagcaaatattaaagttataaaattttatttccaaacttaacataattcaaaccccacacagcaataccaatcttaagagtaaaaaacaagagtaaaaaaaaaaattttgttttattgtctctgaaacagttacacatattatctcacttgacccttatcacagctttgtgatgtaaggaggacaaattatgaaggaaaacatttccagtccaaggtctcttaaatgttaggtcatattgtcttaatgtcacattttaactattcgtcccgaaatatttcaaagaagccactttcataacagagtggaatctgccctcctatgtttatctaagtagagtcaacatttagatttatttagtgaggattctctacttgcctcagttcacctcatgctttaaagttgccagtagaagaaaatctgggtgaggatctgagaaataggagtgagggccaaggatacggattttggatttgggaaacacatttttgacccagctgtagacatgattaaatgtcatgatcctgaatttaccacgatttcttccttcaaatatttcccaatgaaattgaggtgagcaagagcttaaaattgtgccagctacccttcccagaaagctttccaggttgctacagagcagtgttctataagccatggttgagtctaccatcaatgcccagaatgagccaatggcaacaataccatttgggccaaagctcatgtttatgataaccgttagtctatcttttaactaattttttttttgagacagagtctcactgtgtcgcccaggctggagtgcagtggcgtgatttcagctcactgcaacctcccaggttcaagcgattctcctgcctcagcatcctgagtagctgggacaggcacgtgccaccatgcctggctaattcttgtattttttaatagaaatggggtttcaccatattgcctggctaatttttgtatattttaatagaaatggggtttcaccatgttgcccaggctgttcttgagctcctgaccttgtgatccaccctccttagcctcccaaagcactgggattacagacgtgagccatcacgcccgtccccttctttttttttaattttttttttaattttttttattttgaggcagggtttgctgctgttgcttaggctggagtgcagtggtgcaatcacggctcacagcagccttggcttcctgggctcaaatgatcttcccacttcagcctcctgagtagccggcaccacaccattcccagctaatttttgaatttttctgtatagatggggtttctcaatgttgcccagaatgatctggaactcctgggctcaagtgatcctcctgccttggcctcccaaagtgctgggatcataagtgtgagccaccatgcctggtgtttttttccttctcaaagcaaaaaatattaacaggcttccagtatatagatcattagtggagaataattacaactgatgtacacttttatggggtgagttaattctgtaacaaacatttgttccaaaataatttgtgaaatctctctcctgagaatcaatatcatcaaaactatgttctctgattataatgcaataaatttagataataattaaaaatagaccgttgaaaaactcataaactttagaaccaaaaagtgttcacttcataacccttgggttcaaaaggaaatcaaggaaaattatgaaatactcagattgtagatagatcttttttttttccttttcattctgctttcaaaccacaaattcatgtgtggatagatcttaaaaacacaatgctgaaataaaaaagtagtaagtatgatgaagacttcagcagtgattgtcaaaggatttgtggtgaaggactagttttattaaaattctaatcagccacagaccaggtttttatagaattcaataaaaataattactaaaaaaatgaaatgttaaaaagcaatgatattcaaaatataggcccatatttttattatgagatttgaaagatataaaattctatctcagtaagtatatcagaacaaatataacataggaaaaagtttctccctgctaattctcaatttttgtacttagtgcagaaaagtaacagaagtttcgggaccagtattctaagtaacactaacttatagcataatgtcatttgcataatttaaaaatacatacacacacaaaaaaaccatgatttataagaatgcatacaaataaagaaacaaatatcaaacctattaaggtgattgtttattaaggggaagatggaacaaaaaggaaatgtgaataaatgagaatcaatcaatcaacagagcaatgagaatgatgtactgggagtgtggtaacaacttctgtctctgcacgcatacacgcacacacacacacacacacacatgcacaaacacaaagagataaatgaaacgtagtctttcccacactcttggtctctttcaccaacttatttatttatttattttgagatggagtgtccctctgttgcccaggctggagtgtgatcttggctcactgcaaccttcgcctcctgggttcaagtgattctcttgcctcagcctcccaagtagctgggactacaggtgtgcaccaccacgcccggctaattttttggtatttttagtagagacggggtttcaccatgttggccaggatggtctcgatctcttgacttcatgatctgcccgcctcggcctcccaaagcagcttattattttccatccactttgactcatcttactatctttaactttttctccctctttgagctacatcaaagtgataagaaatcaacgggtacacatatttcccacagggttaaatgtgtattttgttttcacccttttcatctgaataaactgaaggtatctattataaataccttggctagtttatactaattagaatcagagcaaaagaattttggatcttggaaagatttcaactatgctgtccatacatttattttttcatttctcgctcactttcaacccacccacaggtatgaaacagaatcttcacaggtatattttaaaatcttggtatttggtcaggaagtcatcaccctctctgttgattcaagaactctgctctgtagttgtatggtttaaagtcacagtatcactacacctgatctcttcctttgtagatgcttccctccataggtttgtcacggtgtaagacactacacatctgctttgcacttcgcctcactacttttcagtgactagagtttttctgtgtccgggaaaataaagaggagggcttagcaatagtcacctgtgatttgagctgtgaaaaaaatatataatctgtctctgggagaccccaaactctttttttcacttaaaaggtttttttggttgatttctcaacataaccctttcaattgccactttatttgaggagacatgatgcaactgagtctagaagggtttttcatgctttagttcttactgtaggctttcagtgctcaccgctggatattaataactaaacaagtagaattttgaaattcttttttttgtctctgcctcactgggttgcaaagtgaaccacaaaattaatatgtactcgttataacaagccaaacaatgcagagatatctaaagaaaaagttagtagcctctttctaccaatgaatgctggattattcaacatgcagatcaagcttgtactcaggatacctacaaaaatcaggagactcctaaatgtttttgaaagaatgctatatttgatatttcagaagaagaattggacaagtgataatgggagacatcaggaatctttagacttccttatatttattttgtgttttagtatttttttgtttttgagacaaggtctcactcactctgttgcccaggttggagtgcagcagcacaatcacggctcactgcaggctcaattccccaggctcaagtgatcctcccacctcagttttcctggtagctatgactacgggtgtgcaccaccatgcctggctaacattttttggtattttttatggagacggttttaccatttcgcccaggctggtctcaaactcctgggctcaagtgatcttcccaccttggcctcccaagtgctgagattacaagtgtgagccatcatgtccagccatgttttagaattttcatgtaattatatattgtggattggttgacaggagaacgagtatgtacaaataaggatatatgtcaagattatattttgttcatgaagtatatgtatatacaactttacataatttttattttagaattattcttacatcttaaaatttcacttattttgtaaatatttccatattcataaaaagctattgtgcttatataatccttatattctattttatttactaataagctatcttgcttgtccattcttccactgttaaatattttcttaatttcctactaatatgaaatttacatctatatttttatttctgtatataactattttcttttttaaaaatgattttcttgggataaatcactagagtgatattgcatgaaaactcatgaatattgtatatctctttgtagctatgaccagattgctcacacaaaggattttataggttcacaaagggtaaactgtatgcattctggctttagaagtggtttggaggaggatgagatggtagcaggagaggctggatgtaagaaagggaacaggaagtgggtgattgcccttatcctggcaagagatgtatctcaactacaaaggtgacaatcggtatacaggaaaaaagtgaatatgataaat

SEQ ID NO: 55 - DNA, 8427 bp, Homo sapiens
gctcaggctggtctcgaactcctgggttcaagtgatcctcctgcctcagcctcccaaagtgctgggattataggcatgagccaatgtgcctggcctggcttggtttttaatagataatcatagactttcaaaaacagccataaaaaagcagaaggaataaacttattactcttgagttttagtgttctcttatttctctttgccccttgcagatataatacacttacagttaattaacattgacattgacattctcctgttgagctttgattttataggcaagttttaaaatctgttcagcaatcatccttttagaaaaatgccataaacacaaatttgcacacaaatgcaaagcatttataggcaccctctccaggctccaatgcatagcacccaaggctggaagcccagtccttgaaaaccagcaggagacctgaaagagcagggacatatggactttagaacccatttctacttgcaacttttatccattctggcaaacaggaggctgccactttttgtcttactcagcgtctgctagtcttaaatcacccttcaaccaaagtgcttttgcttcagaagttctaaatgtgccttggcatttatagagctccagttatgagatgcatatgaaaataatctgtgtttcatctttataaagtccttattgaatgttcactttattcatgcccattatataaagccccttcataaattatcattgtttagttcaaaagggaatttttgtttttatagatagattattgctccttttaaaaacaaaacttggctgggcgctgtggtcacacctgtaatcccagcactttgggaagctgaggtgggtggatcacctaaggtcaggagttcgagaccagcctgaccaagatggtgaaactccgtctctactaaaaatataaaattagccaagcatggtggcccatgcctgtgatcccagctacttgggaggctgaggcaggagaatctcttgaacccgggaggcggaggttgcagtgagctgagatgacgccattgcactccagcctgggcaacaagtgcaaaactctgtctcaaataaataagaacctgcctaatatgttcttttagctttagttgctataaagacagatatattgcctaatttttgtaatttgctcatccaaattacccatgagtagctttgcttctgatttcctttaggcaacctctccgtatgctgttctctttgaatcttaatgccctgaactagtctacacagcatttaagaagccagctccacttctctgaaggctttgccccggaggaaacagcccatgggactgaggccctcaccagttagaccactggtctctgtccactgcactgtttgcttcaggtgccacagaaagtggacatgcccaatgcgtgttgatcatgtaaatcactgggttgttttttctaatacctgggtgattttgattttatgactatttcctaattcctggtgcttgcacttaatcaattgtgttaagggtggcatctgcctctcatatacagactgggagttatgtagatggacattggttgtcttatttcataaacagtgtccccaggtctggtttgacaggactgatctccagtattagaatagaacatctactttttaatttttattattattttaaaatttttattttttaaagagacagagtgttgctatgttgcccaggctggtttcaaactcctgggctcaagtgatcctcctgccttggcctcctcccaaagtgctgggattacagggatgagccaccatacccagcctgaacatctactttttatttatgaagaaataattattcttgggtagtcagcaacactgtttatgatgtacttagcgagagattttaaatatgtacttatgtaagtatatatttaaaaccttaatatatattaatatgtgtatctatatctatatatatatgtatgtgtgtatatgtatatctgcatatatagatataaaaactttacctctgtgggacattttcacttataaaatctgaggcttgatattaaaagaaagtgttcctggctgggtgcagtggctcacacctgtaatcccagcactttgggaggccaaggctggcagatcacctgaggttgggagttcaagaccagcctgaccaacatggagaaactccgtctctactaaaaatacagaattagccgggcttggttgcgcatgcctataatcccagctactcgggaggctgaggcaggagaatcgcttgaacctgggaggcaggggttacagtgaactgagatcgcgccattgcactccagcctggcaacagagcgaaactccgtctcaaaaaaacaaaaagaaagtgttcttaacccaatcatcaacctcaaactatttgcttatgtatatgtatataaaaaccatcttctgccccttttagggactctgacctagaatgtggctatgtcctggttaaatgtcctcacatgtgtccagtcatggtgtccccatctctttcttgtgcattagctcccagttgaggataaaatcaggatcattgcacagaagatctatggagcagatgacattgaattacttcccgaagctcaacacaaagctgaagtctacacgaagcaggtagatgtttggttagtttgtcctttcaactctttgcaaagcaggacttggagtcacaatctctgggtcctcccagccctgccaagtacccgttgcttcacttctctgggtggcagccttctctcctctgaaatactgagtttggattaggtggcacagtccctggttctttatttacccataggcgttatatgaatgtgtagaaatccatgaggaaatacagaatgtcttaccaaaatattgagaacgtctccagtttttgttattttgagatagggtctggctccattgcccaggctagagtgcagtggcacaatttcagctcactgcagcctctgactcctaggctcaagcgatcctcccacctcagcctcctgagtagctgcgcctacaggcacgcaccaccacacctggctaatttttgtgttttttgttgagatggggttttgccctgttgcccaggctggtcttgaactcctgggctcaagcagtccacccatctcagtctcccaaagtgctggaatttataggcatgaaccactgcacctgaccctctccaattttattctcatatctactccaaactattattttaaattagttttatgttatttccatagatggaaataaaatattcacttgtggactacagttgtgagtacctaactccctcacccaacagttctttttttttttttttggcttaataaataagctggaggacagcaagatagagatgtatataaagggagttggatgtttcgaataaattgaagaatccatgtaatcacagggcccagatggtcattgctgggttgtcatcttttcatttgtcctccctctcttcccttctttccccagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacggtaagtgcatgctgcaagggagtagtgggcgcatctgcacttctcgtctgaagtgtgttgccgaaaccatcaagcaaatgccaagtgagcagagttcactgcccagaagaaaattggaatcgggcctattatgattgctgtggatcataagctataaagcaggagctatatagctcttgctgtggaccatcttggtgtcaaatcaagaatgatgccaggactactcatactgaataaaaaattctgtttcccagggacagtatgctcttcactgaatctaggatgagcccagttgataggctggggtagtgctaacataatcacagttaatgtttattgggagccttacatagattaactcagtccccccacagccctaggaggtagggacagaggttttactgacaggcctagaacttacgtctgaaattcagggggttcattatttttaagtaaggaatttccccattaaaaaatgcaaatggacccttgagatatgaaaggtgaggttgcttatttacgcttcaaggtgaacaaggtgtccattgctttcttatcttacagattttatgcatattcaaagaagaatattgccagttgggaagcagaggggagggatgcttaaggacataatcatagtttgggctgacattgttccaaggttaacttggatcctgaatctaggttatcccctaaatctgccctgtatcctgtatctacagattgtactgccatgcaatacaggactgaaatattaaactaaatcaacacacatggaaaagaaaccaacatacatccttttggatttatgtcattctttcagtatagtaagaaagtggtaggaggtggcattatagagttgaaaacgtaggacattagagctgaattcattttcacctcttcagatcttggccttgggcaaattatgaaaggtgagagccctgctgccctcagctcacactgtaggcaacatcatcacatcacagtggtgcttagcacaaatgcctgcatctcactgcctccttagctctctatagagagcagaaggcttagacttgctatgatgtacatcagtctccaggatttgtagaaatcccttgtggtaggaattttccaccatttttacccagcaccttgaatagtgcagaaatatgtgttgttctttttggagaagttgtcagcagctaccagctgaaagacgggtagctgtactctttcttgtcacttttgatcttcacatgaagaaaagggtaacagtagaggtgaaagcaaatctggaagcagtcaggccagtgagagtcaggctgtaaggtggagagagacacagcctgccgaactcaagactttctcatttagaacaaagtatgtgtcagaggcttttaactttaagttggaccaaggcgtttccacacatgatcaaatggtttaatcactattctaacaccttccagttgccgttggggccttaacgagactcagattatttgaatattttctatattaattcaaagtgtgatggcttattttcagaactttatatctaggttcatacatgtgcgtacacataatattgtctttttttgtattttttctgattatcagtgaccagtgtttaggagggaaaatcctcttggggaatgagtgaaaatatcaaaaatcctactcatcactgtttagggaaccatctttagggttttctgctgacatgcacatgcccgtctacaacaatgggcatgtgtcttttatctttataatgtcatcttccggtttttctgctgtgtctaaggacccatcctttcctctctcctacttgtctcacacctagcacctccttacctcttacacaatataagaatataaaccagttgtcagatccctataatgtgttttggggaatattgattggtactcagaagtcagtcagaatgaggttttctaaagtattgatgatgttttgtgttacagaagatgactctttttaaataacctttttatagttaagttttagaagtaacctaagctgttttcctgtctagatttgatttggaacttgtgtgtattcattatataggacattgttacagataaaaatatacggagttttcacttgcaagccgtacatatttgcatctaagtagaaatttgtcaaagccgagtctttagaaaagtagtgagtacaaatataatttgtaagcattacaagtttagttttagaaggccattttgggccagtaagaatggtgattataaaaccatctagattatgtacaaaagtgtcttggcccaagttaaaggatactaactcctaccatcgtgttgctgaagcaaaaatcacatgggcagctcagctagcaagactgaacgaaacaaaatttaaaagcaggcaagccctgtacctccttttggtcttgcaaagcgtgagctgaggaggcgagtgagcaactcctctactccccagcactcattcttgtaaggtgaaggtggaaacacctcctgctactgcttgtgaccacatggaagatgatagtgaaggctggcatttggtttgcagaaggacatgaggaatcagtttcttttcttttccttttttttttttttgagatggagtcttgctctgtcacccaggctggagtgcagtggcaagatctcggctcactgcaacctccgcctcccaggttcaagcgattctcctgcctcagcctcccaagtagctgggattacaggcacacgccaccatgcccagctaatttttgtatttttagtagagatggggtttcaccatgttggtcaggctggtctcaaattcctgacctcaggtgatccatctgccttggcctcccagagtgctaggattataggcatgagccaccacgcccggcagggatcagtttctgagttttttaacaggatcagtgacttgatttttaatatgtaacaagagtacccactttattgacaactataaaatgatgttctatctttatgccttgggctttctttctgaaggaaaagtgaaagtaaagatgactttacgtttattttagacatggccttgctctgtcgcccaggcaatcggatgatcatggctcactgtggcctcaacctcctagcctcaagcaatcctcctgccttagcatcccaagtagctggaactacaggcacatgccatcatatccagctaattttttatttcctgtagagatgggggtctcactatgttgcccagggtggtttagaactcctggcctcaagtgatcctctccacctcagcctgggattataggcgtgagccactgtgcccagcattagtttatttgtaatgcttttttacatcctagatgagcacaatgcctggactccccacccggccctgtttttatgatattgatttggaccctgaaacagaacaggtgaatggattattctaaacaggtaagttgttactgggtaataatttggcttttttcctcatgtagcttatttatgaattatagggctcaaactgacgctataaaaattcacattctaatgctttcaaaacatttcttttcagacttccctgaggggagaggggatagtaatgagagttggcaataaccaatgaattgaaatatttatatttcaacacatttttggaagaagcgcagcatggcttgtcacaggttgacagtgtaggggagaaaactgctgtccaataaactacagaggaaactacaggagaggttagactccctctgctgaagccccaggaggcttggggttcagagttgatgacacattgcaggtcaggaacagctgacggtctgtatactctgaataggtagttagaaggcaagaattagcaaatgtcttaggaagtataatagaaaagagaaggaaacaggaccaatctggcagttcttagggccttaggtgaaagggccctgagtaccgactgcaatgagtgacattgcattgtttgatatttttgaaatttcaacaggacgtgtctctccttaggcagacccttggggctgaagcagcaagttgcagtgtgcacttatatccctagacacatcctgttgaaactgcaaaaatatcaaacatgaaaatcctaacatctttctccagagacgaaaaaagtggcttgcctatgaaaagaatgagaactagacttaacgcccgtcttactggcaataagaagcttttagacaatggaggagtgtcctgtaaggtcacagggaagatgactttcaacatgtgctcacacctagccgaatctatctggatattttcagacgtgcaagggtttgccaccccacatctcttcctaagaagttatttagcaatgtacttagcaaaatgaggaattaaccaagaaaaaaggaagacgtgagttttgggaaactgaaccctcatttggacattagcgaaggggcattctgataaccatgcaaatgacctgaagttacaaatcctgtgtggaacaggttgggggagcacctgagaaaaactagaaaaagctagaaaagacaaggatatcaaagggtcatagtataaaacaaaagctcttgcattatttgagaaagttaaggtccaagtagaagcaaactgtagtttgatgctagaacactattctttgagagggtatgtgtgatactcgaaatgcagtcatggctcacggcttggtctggtcttgaacagtattcacacagtactatggaaataccatgcatcattttcaagtccatttatggacacgccctagaagagctggtggcaggaaaggatgtaaatgt

SEQ ID NO: 56 - DNA, 54785 bp, Homo sapiens
cccatggctgctggtgagaaggggctgctgcacagcctgtctgcagctgacacaggcttcctggagccaggaaagggtggagaggcatgagtgagtgcctggcagttgggagacccactctccagcactggccctgcctcggctgtgtgaccttggctaaagaatccgagcatgctttttttttcctttcctaatcatgtactttaatacaaaagtgttggcatttttatgcatgttcccttcagtctttgctcatgtgtgtatacacacatacacagatacacacacatatatgaacaacatttgagttttctaggtctcgctttccttatttgtaaaatgcaaacaattacctctgctttaataatattaaataaacttcaagtggtggttgttattcagctctgtgggctgagtactctttatcttccatgcaccccacccctaacatttacaaaataaaacccaaatagctcccacattgggtctgctttccatttcaggattgtaatatttggggtcagtcaggcctggttcgtctgtcacctcatccaagtactcgcagcgagtttgttgacagcgccagcgtaacttccactggtcatcaggagccttgcaagctaaggcagggtcagaagggtcagagttggcggtgagggtggctcagacactgatgggccctgcctctctcctcccctcccctggagcagatcagcatcttcatgacgcacctgtccaactatgggaatgaccgcctgggcctgtacaccttcaagcacctggtgcgcttcctgcactcctggacgaacctccggctgcagacactgccccctgtgcagttggcgcagaagtacttccagatcttctccgaggagaaggacccgctctggcaggtggggggctgggcagcctgggcaggttgctacagggatggaacgccaccactcacaggcacacactccagatatggactcaaggctcagccatcatgccttcacactctcgctcgaatgtaaactcaggtccccatctacttaccagcatgggtgcgttcactcctttgcacacatgcatgctcatacatgtacatacttccccacgcagacctacatgcatgcagtcatacatagccttggaaaaaacagtgttaaaaaaacgagtgggctggacgcagtggttcacccctataatcccaatactttaggaggccaaggtggctggattgcttgaacccaggagttcaagatcagcctgggcaatatggcgaaaccctgtctctacaaaaaatacaaaaattagccgggcatgatggtgcgcatctatagtcccagctactcgtgaggcagaggtgggaggatcagttgagcctagaggttgaggctgcagtgagctgtgatcacaccactgtactccagcctgggcaacagagtgagaccctgtttcaaaaacaaaaaacaactccaagtgaacacagtgcagacaaagtacagaaagtgaatgcgttgtcttggtcaggctcttagataatctcttgtatctcttctaactccagcaggctctgagtgggaaaagggattgatgggagggtttgggggccagtttttgggaaagtctgctcctacgggcttttaaaaagtggaagcagaagctggaattggtgacagtctcatagttcagaccaggagtccacaaaccgtgactcatgggccaaaaccagcctgagacctgtttttgtaaagaacgttttattggcagacagccacgctcattcttgtatctactgtctatagctgctttcatgctatgacggcagagtcgagtagttgcaatggaaacttccatgccccaaacctaaaatatttactaaacacttaccaaaagattaattaaactttataggaagcgtttcttgaccccctggttcagacgcagcttgtccagttaaattcaacaagtgcttatgagttcctgttacgtgctaaggggcattttgcgagctctttgggggacatgaaactgaccagaagtggagcctgcctgtcagtggctcagtgtctgggggtggggatgtgacaaggacacatgtagcatgtaggtatcatgcccattgggctgtaagggccacatatccatgtgcagtgggagtccactgactgggttctggggcgccccacacatcccttccactgttgttttaggacccctgcgaggacaaacgtcacaaagacatctggtccaaggagaagacgtgtgaccgcttcccaaagctcctcatcatcggcccccagaaaacaggcaggtctctctgctcttgaccgagcttccccaactgcctgctgtctcagccacagaattctgaggactgccttgccctggccccactcccggataatttgctccctctttcccaggaagtaggaatgaagttggggtgaacacaaattgcctgtcagtatggaggggaaagaggtggaggaggggcctggagttctcctatttatcctgaaccatagcctcagggagctctccctgcattatcctgggagtctccaagtccagtcagagaagcccagatcagttgctctgctagtttgagtaatgccaagcaaaactggtacaaagaggactgtgatcaattagctatgtctgccagaggtgcagtagggagaagcagtgacatgattgctaagcatttgtcatccatacaaccctgcaaggcacaaatgggcactcccattttgtagacagaaactcaaggttcagagaagtcaagtgacttcccttaacacattcagttaggcaatggcaattccaggcctgaactctgatctctgtgaccctgaaacatatactcttaattgccaaactctatagcctccttctcttctgggctctctcattatagcatgtaaaccatagacttataccacagaaagtgaatgaactcactgaggaggaggtagggcagggtgcatgagtgagcagagggtattgggaagaagagacataggaacaagatttcttagttctttaagaatttcacattaacagaactgcagggtgacaaactcccttttccctgagctcctaccaagtgccagaggacagaggcccagagctggaaaggaccagctcttctgggatgctgaggggacagcagtcagttaaacatggctaccagagtgcagtggtgaggcagattctgaggccacgtcctcgtttagtgaagagtgctgtgatagattagcgatgtccgtagtaggtacaggagttgcggtgttcacatgcatgccatatatttgccaccctggatttagtaattccttcattgcacagatgaagaagctaagaccagagaaaggcagagaccttcccaggagcccccagtgggtcgtggggagctaggcccagaacccagactctatcttttggctgggggctgggccctgggtctcaggtgtctaccctccccacaggcaccactgccctctacctgttcctgggcatgcaccctgacctaagcagcaactaccccagctctgagacctttgaggagatccagttttttaatggccacaactatcacaaaggcatcgactggtgagttggcctttctgtccacagcgggacgggaaggccatcctggggcctcccaggagtctgctgtggccacagcaggaagcagctggagcttgctcacacacagctgtcattcctgtaaacagggacaaagtgcagtgacccttgaatcatggtgtgacagcgttgtcatagacaggacactcgatgaggaggccctttgcccctttgctctaccgcctgtagtcagacgctgaggtcgaagtccacccctcccttgcttgcagagaaacatcctgagtcttggggaggagaagggtttgcccagggtcccaaggtcggaaatccaaatgttctggctctcctcactgcgtgtggctgactgtgaagcagaggtgttcttgtgggcccttcagggacaggtcgctggtctttgggcgtcacttggggaagtcattaagattgccacttcccaccagagcctgcagaggttacctttgtagaggttcccagcagagggtcctagtagaggttcccttaagggtgtgggggccagagcagagatggttttactctccaccttttcagttggcatctttctctatttgccttttttctttctttttaaaaaatgtttcatgtcaggtaggtaatgtgctgagatcataacaaggttcgaggtgggtacacctcacacgtgtgtgaacacccaatcatcacgtgcatggactgcaaagtttgcctttttaaaccttgtccatgtattaccattatttattatttttatgtcagtgggttccctgggtggagaggttatgggccttctgtctttcttttttttttttttgagatggaatctcgctctgtcacccaggctgcagtgcagtggcgcgatctcggcttactgcaacctctgcttcccgggttcaagtgattctcctgcttcagcctcccaagtagctgggactacaggtgcccgccaccatgcctggctaatttttgtatttttagtagagacgaggttttgccatgttggtcaggctggtcttgaactcctgacctcgtgatctgcccgcctcggcctcccaaagtgctgggattacggcgtgcgccactgcgcccggcccatctacctacatttctaacatctccacagtctcttgtctaaaatctagtgtggtcagatgaattattggaagtcaacatttttcaggttttagaaaggtaatgtggtgcgaaaccatatatttagtaacatcttcagcgacacctggggcagcaccctgttagcaaattcattaatatgtctgtagcaaagtatgtgaatatttacactaagtaagaggaataagtcaggttttgttgccaaatggctttgctacaaacctaggaaacaaagcctgtgttttcaaagctttctcaattgagatattgtaaacaaaggattgtggacatgcaaagaaaattcagaaagatgagagaagacgtaattccttggcccaattcccaagagcttgattttgtaggtaggtctaaagtggggtgcaggaatccagcaggcccccagaacgctctgatgaagcacatccttgggaccagcctggatcagccccacctcacaggataggatagggaccctgtacccttcatgagagtggactttgcttcccacaagccccagaagttggaccctgagtttgcataggtagattcccctgggagggtctggagtgttcctttggtttccagaggttccttcatccagaggtggccattgctctggtgggatatgggcattagtctggaaagccgtgctcacccacagcaggctggggaggggttgtgggtagcaggaggtcctggtccacagtgacggcctagaaggtgttcccccaggtcaggaaagaaagtccgccctctggaggccccctctgctctgtgccagcctccctggggcagtcctggagccactctgagccccagctcgccccctagaggcagagagagtgacagccctggcagttaagcctggagcagctgagggggcgggatcctagagtttaggattgaggggcattaccccctccccatgacctgcaactgccggcgcacccacaagtcttcagatcctcccaactccagagtcttctggaaaaggaacgaatttgaaacagggaggctgccaagaggccattcccctccagaatccccactggaggcaagtccttgtttggttgggagcaaagcttcccacttgctctctgaggacattctaccccagtgcctcgcccttgtgctgcattcccttagccccctcctcatgagttttgtctgtgagccgcctctctgggcttcctgcaggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccaggtgagtggggctggggtggagtccctgtgtcgggaacacagggctccgtctgacactcagttactcactcactcaacagatattattagtaagcacctactgtgtgccagccctgagccaggcgcctggagcgtggtgatggctgagaatagagtccttggtggaggagacaggcggaaatggaaagccagccaccagttgactgtccacctgcctagtgtcatgcggggtcctgcctctacttctgacactgacaagaggtggaggctggttacgcctagaggaagcttagatttggtgaacagcaatgcaggatcatactgactatagcttcctcgctggacacgggtgggagtgggagctcatggaaggacaagacacaagactgccattcacagtggagaaggcaggcacctgaccaagtgaggcagttacctgggctgtgatacatggagagggtgtggatccaagcccctatctggggcatgtatgaaccagagctgtcttttttttttttttttttttttttgagacagagtcttgctctgtagcccaggctggagtgcagtggcctgatctcaactcactgcaacatccgccttccagtttgaagtgattctcctgcctcagcctcccaagtagctggtattacaggtgtgcaccaccacgccaggctaatttttgtatttttagtagagacagggtttcaccatgttggccaggctggtctcaaactcctgacctcgtgatcttcccgcctcggcctctcaaagtgctggcattacaggcatgagccactgcgcccagctgaaccagagctctctttaatgcctatggcctgacttaatttcctgcctgccagcccactgagcctgcaggaatgcttttaggccttccctggtggggtaggcggagtccctcccctggctgccagcattcctgtgattatgccacacagccaagcactgtgattcagaagtggcgccccagcagaaagccaccctgttgtccaggccgaggtcctgagcatcctcgttaacccagcagaccaggcctgtgcttggtgttggggagggggtggggccctgggtcttagcccatggttgccagagaagtgtcccctgtcctggctgggacagcctcttcaggcctggccactgtcatagttcccaccctgctttgaggctcttttctcagatgtgacagtggctgtctcccgcctgggaccttgcggtctcccgcagggctggcacctgcctcctctttgctcccatggaagtctctcctcctgccactctctgaggctggtgaggaagccccttcttactcttgttctctagggcttctgtttatgccctgatgtctgctttcctgtggctttttctttaggagaagaaaaccgagaaacacttgtcaagtgtttctgttttctgccgtgctgtgtgcccccgcctcctggcgctgtgcagggaatgggcagtctgctttcatgggggaacgtagggtagagagagagccgccacaggttgggtcagtccctgttctgcactgacactgctgtacatctgcaccttactggagagtcacagctggtttctagaaggcagaggaggggtttcacgtttgtgtccccttctcaaagattagaaaaccaagtttcagcaagtttcatgtggtggcatttgaatccaagtcttctaaatctaagaccctattcctttttctgtccatgatcaagaggggtaagggatagaaggagaagggagactcattctccccaggaggacctgggaagatgttggaggagaggaagggtgggggcctgtctcagaaggaggtcgggacgaggaggacgctgctgtgcaccatattgccccagccctgggctgtgtgtgatcctcaggggagggggttggcggctgggggatagtgcctgtcgcacaggtgcctgagctctggctttctggacttagtgaattctgcagattcggacctcccatggcattattttaagtgattcagaccagccagtctcccttttatagttctttcccagtccttctgatttccataaaggagaaatgctcactttagtgcaagtggtcttacgtcctttctaacactgtcaacctctgctttcaacaaagagagcatgttcagggcctgttgcacacatttgtgtctggctggagtttgagaacattgtttttattgccatttgtgagtggttgccttctatatatgacaacagtgcagcagcgtgatcttggctcactgcaacctccaccccccgagtttaagcgattctcgtgcctcagccttccgagtagctgggaccacaggtgtgcaccaccatgccagctaatttttgtatttttagtagagacggggtttcgccacattggccagctggtctcgaactcctgacctcaagtgatccacccaccccagcctcccaaaattctgggattacaggcatgagccaccatgcctggcatcaggaaaccctgatttcgtccagttcccgtatttcaaagatggagaagttggggctctgggaccagtggcttcccttgacactggacacagtgagaggcagagccaggactcagacccagagctcctgggtccagctgaggatcttctggccaccttgcgggctgctgtccctctcaggccacttcctttgtgtcctccaagtggcatgctgaccctctttccttgcctgcagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccaggtagctgctgtccctgacccttgtgagggcagtcacagtactggcttgctgtggttagcggagagcctccaactctttctcaccagccgtggggacagatatgccctccttggagagctagacccttgggtctataaaaagattttattattattattattattttgagacagggtctcactctgttgcccaggctggagtgcagtggtgtgatctcagctcactatagcctcgatgtcccgagctcacgcaatccttccacctctgcctcctgagtagctgggactacaggtgtgagccactgtacccagctaattttatttttttaagaaataaggtcttactatgttgcccaggctggtctcaaactcctgggctcaagcagtcctcccttggtcttccaaagtgctgggattacaggcatgagccactgcacctggcctaaaaagactgtagacctgtttatcccaaggttgatacatgagaactccccaagcctgtgtcccatcaccacaggccctgtagccctaaagggacccagaaagccctgaggcaggcaggtgggagcaaggagactgggcgtggtgatggagggagagcctgatcataccaggctgtttatgtatttatttatttatttagagacggagtctcgctctgtctcccaggctggagtgcagtggcacgatcttggctcactgcaacctctgcctcccgggttcaagcgtttcttccacctcagcctcccaagtagctggaattacaggcatgcaccaccacgcccagataatttttgtatttttagtagagacgggatttcaccatgttggccaggctggtcttgaactcctgacctcaagtcctctgcccaccccagcatcccaaagtgctgagattacaggtgtgagccaccgtgcccggccatgcccagccataccaggccttttaggcaaacttgcggagtgtttgagcaggagagtgacatggactggaagctcagagagaggccagagagggatgtttgtagggacctgaggggcaggcagggtttggtgagagcttaaattctaggagaaatggcattgggcagcagaagctggtggaaagcaggcgtgagaccacagaggcctgagcttggggatacctgcccttcaacaggggaggaggagccagttctagagggtgcagggtcccatatttataagcaggcccattcctgctgccgtggctgttgcccttgtttgccaccgaagtcaaagcaggtcccgatcccctttctccctttccagattctggtcttggatggcaaactgcttcgcacagaacctgccaaagtgatggacatggtgcagaagttccttggggtgaccaacaccattgactaccacaaaaccttggcgtgagtgttgccttttcctttctgcaggttatttccctgataaggcacctgggccaacaaagccaaagtcttgaataattatgagagagagaagttagttagagtcagaaagtatggaaagttattaatatgacttaagtcatattaataaaggtatcaccttaaaaaaaagggagatgatgaatctgttctactctggtcagaccatcctggggtcttctctttggtctgggctgaacattttcagagtgttttatgtaagtaaattagatcagtaatgagcagccctaattcccacaagattttcttagcattagcttttttttttttttttagacagggtcactctgttgcccaggctggagtgcagtggtgtgattttggctcactgcaacctcaacctcccaggctcaagtgatcctcccacctcagcttcccgagtagcttgggaccgcagacatgtgccaccatgcctggctaatttttgtatgttttgtagagaaggggtttcaccatgttgctcagcctggtctcgaatgatctgcctgcttcagcgtcccaaagttctgggattacaggcatgaggcaccgcccccagccagcattagattttgacttacgatttcaggaaaaggaaacacaaatgttgttgacagttaataaccgtactcactcagaacctggtgcaagtgcgttgagaatgccctcccactatgagtaaaggcctgcccgcattgcatgggctcagggctaggaaaggctgctttcctgtgctatgtcacagataagtgacacactcagctggatgaggggaccccaagagaaggaggaatcaagtcaccctccttggctccattcttgggaaagttttgcaacaagaatattccgtcttcactgtcgtgggagttgaaggtggagaagggaagtcagtccttcaccttgagggagaaggggccacctgctgaggctgtgggccatggtgtcagagatgcctgggttagggccccacatccatctcttcagcctttcaagcctcgctttcctcatctgtaagttggggataaagataataatccctgcgtcctgaaggccactgaattgaatgaaagcttcatgtggggctcttagctgagagcttggcatgcactaagtgctaaataaacggtagctgctattgtccttgtcatcatcatcatcaccatcatcatcgtcatcgtctatacctatcctatgaccctttcagaaatctctgttctccttcgctattcatgggaattctgttttcttgatgccctcatgctcaagaatctcctcatagttcctcatccagggctaaattctgatgtcagtattcctcccttcccataacagcttcggatctcatatcccaaaaatgcctttgaagacaggatgatgttggcagtcttgctgtgtcatttctgaagtttactccaaaaaatgaaattctccagtgacaggcatgcttaagtgcagctgtggatactgcatgttttgataaagatgaaatttattaaaaagcaaaagaacctccactaaacacccctcttcccattgacgctgggaggggtaaagaaggcttcttgggtttaaaaaaaaaaaagagttactcagcattgagaatgctcagaaaagatttcccagaacactgaaggatgggaaactgttcatgttgtagattgctgaagcggctgtggctggtcgggctggaggagagaagactcagaatgtgcgagctgccctttgccggaagtaggacaggcacgtttagtgcagcctaggacacatttgatcccacagatggcacatagcttctgacagtccatgtgggttcaagagcagtagattccctggtctctgccattcctggggtccatgaacatggctttaaggtcggaagtgggtggctgagccagctcccatccaaagactttcccacctccacaggtttgatccaaagaaaggattttggtgccaactgcttgaaggaggaaaaaccaagtgtctgggcaaaagcaagggccggaaatatcccgagatggacttggatgtaagtggtggacacactacctgtagcacctgcataagggtaaggggtccctgtatggagttgagggggattctctttcctttaccatgcactcagcatgttcatggccttagcatttcttggacagtatttgtaagaggaggaaaatgggggctgggacatggtgggtcagacctgatttcgtcaaacaagtgttggttaccttctactaagggctgagtgctgtggggttttgaggatgagccagacatgttctctgccttcaaggaactcctggtcttggaggggtatgagtcccaacaccactaagtagaatacaggcagagagtgctgcgcgcagtcagagagggcacacaagtgctatgggaattcagaacaaggggatgtcacttgaacctgagaggggtaaaaaaggctccttaaaggagggatgggggtctctggagttgcgcctagaaggatgagatccattttgtaggatttggacatatggaatgggagggtaggtaagaacagcatgtgtaaaaccatagggggaaaaaagaaattttaaaaatatatagaaaaagggtcacagactgggggtcttgttacttcctccttttcctacttgcttctgtttttgttttgttttgttttgttttgtttttgagacagggtctcgttctgttgcctaggctggagtgcagtggcatgatcatggctcacagtagcctcgaccccctgggctcaatcgatcttcccgcctcagcctgccatagtgctggtattataggtgtgaaccaccgtgcctggccctggccctgcccgccttgggttttgattattaattctctctcctctccctatcagaagaattttgacttagtgagctatattttgatgctcctgccaactgggagttcactattggaggctaccatttagaaggagattgtggataaataagaggtgtatggggggtggtgccagcagcatggtgggttttttgtttttttgttttcttttgagacggagtttcgcttttgtcacccaggctggagtgcaatcgcgtgatcttggctcactgcaacctccgctttccgggttcaaaagattctcttgcctcagactcccgagtagctgggattactggcgcccaccacctcaccccgctaatttttgtatttttagtagggttttcccatgttggccaggctggtcttgaactcctgacctcaggtgatccacatgcctcggcctcccaaagtgctgggattacaggcatgagccaccgtgcccggccgagcatggcgatttttagaggaggtcactcttaagtcagtacacaaggtctgagctttccttcccgttacagtcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaaggggccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttatagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggttctgtttgtacaccttggtcctgtctgacctttttgcaaggcccgcagggaagggtggagtaggggtgtttgcatgcacggccaaagcccgcttgtccctgccacctcaggcatgcacacgtgcccacatgtatgcacacacctatacacatggtgacttggtcaacgcagatcattttcactgggttataaatggaagatttcccagatacagcagaggcctatcctagggcagccacagggggcatctcaggtgatagaagccctcagacaagctggattgctcagaagccctgggtgtcgggcactggaccgagaggagacttgggggctggaacaatttctgctactaatgtatattgtagctgggggcaagccacttttactgttttatcccatttccctcaccttttagacgcatggagggagttggactccatggcctcacttgaagaacttgcctaaaacatgcagattcccaggtctacttccagagattcagctccagcagatgtggggtggggcccaacatctttaaggagccctccagtacactgaggaatttataaggagccctccagtacactgaggcagcccagtgtaactctggctcagagtgggaaactctgactcagatccatggttcctatgggttctaattaatacggagagccccactgtccaggaaaacttagggtaaaacaaatgactgaagccctcacagcctaattgagggccagactcgagatttgcctggagaaggagagttcacaggtaggggcccaggccagtgtctgcaatgcaggtgatcagacatgctccttcagaatccccttgggaagctttaaacaatatacattcctgggctcccccaaaatctgctcactcagaacctctggggtgggacccagcactgtgtactttaacagactccttggtgttcagggaagtttgggaacactgaatcaggccaccatgtttgtcagagacggtacccagaaatgtgcacagcttctgagggacagaggaggggcatgctggggacacagctgggcagtcctgcttcccaggacccagtatgttcaaagtgaaataccacagtgccacctctgatggcacaagggcagcacctgcagagccctctttgcagttcgtcagctgggagcttggtttgggtcaggtggccctcaccagcaagaacacagctggaggctgcatggacaagagcagatccagaggcatggtgcagaaaggtgactgtgccaactgaggggtcagcctgcaacagggatttttgaatttacatacagctgagattctgttttgaaagaatcacttaattgaaaaccaggtaaaggtgggggtgctctgtggttggagtgggagtgaagctctggactcttcccagctcacctcctccctgtctctcaggctatcttggaaccctaagatttctcaaaacacattgtgaaaacccagcccagttgcttccagaggtcctaaaagtcctgcagttctaataggctgaatgagtagcagcccatcagcccctcctcaccccccacggggatgtccacccagtaaatctggtgccccaggagtggtttgggcttctagaggtggggagttaccttggagaagcctggatcatgcgtgtagggcagtgtgtttcacaataggaaaacgctgggaacaacctagatgtccatccacagggtctcagctaggtaacctccagtgtatccattcactgtaatgatgattcagttgaaagtaatgagctcagtctccaagccctgccagggaaatttctatgacagacttatacaatgtgaccatcatggaaagagaacactacagtttgtatttttcctggggttgtagatagacgtctcatatcaaactgatactaggggaggaaagactgagaaggggaactttcaaaggagacttcagccttggctgaaatatatataagacaaggataatgcatttgcatatcatttgtggaatgaaaaagtcttaatgaaaaatagaaatggacaaagcagaaagggggactccaagcagctagacttacatgacgatgcgatgaaggccaacactgctttacccagcccttaagctcctatggagttaggatctggaggaggcctaggtgccggtgatcaatttcttgcctggctgcatttatcctaagcattcgtgaagaccctgagctgaggatcctgactttcctgtgactgtaggccagtctcagctcctctctggccctgggagcttagcttccccaagctgacagacgggggagctagggttaacatcaccattgctggaacaaattgacaccatgtctcccgatatgatgcaatgggaaggacccagtgcaacacctgggaaattcctaacgaaaacacgggacatgaatccagccaaggggaacagacagacacatccgtattgagggacattttgcaaaataactggcttgaactccaacaatgtcaaggtgatgaaagatacagaaaagctgagaaatggttcaggattaaaggatactaaagagatgtggtaatcaaatgccatgtgtgaccctggaggggtcctggaccatgaaacaattagctataaaggataccatagggacacctagcagaatgtcaggatggaccgtgtggattagataatactattcaaccgatgttcaattttctggttttgattattttactgttatgtaagagtatctaatgaagtacatgtgagatattagttttttgaaattacttttgcaccaacctaatatttaggggtaaaaaggaagaaatggaactgaattttgactcctgttctttctctagtggtactagatggtaggtactcatcagatgcagtccaaaagatgtccaccagggggcactattatcctagcctctcacagtgtagtcagcgcgaatgcctcccgggaagactgggctggtggttaatggtggtggggcaataatattatcaatattaacatcaataaattaaataatataaataaaaagtatttcttatcctgtcaggcagaccctctgcttatcaagtgctatctttaaaattttttctttttgtgacagtgtctcactgtgtcacccaggttggaatgcagtgatctcggctcactgcagcctcaagctcctgggctcaagccattctcccacctcagccttctgagtagctgggattacaggcatgcaccaccacgccaggctaattattttgtattttttgtgaagatggggttttgccatgtggcccaggctggtcttgaactcctggcctcaaatgatcctcctgcctcagcctcccaaagtgcagggattacaggcatcggccaccttgcccggcctcttttaatcttcataacaatcctctgaggtaggtattatcattcccattgtatatttgaggaatttgagttcagagaggttaagtaactctgtcaggatcacagagctggtagtcattgatccatgagactccacagcctggagtccactaggctgtcctgccccctgggcctgaggctgggaatgtgtcctggcacagggaaatgccatgaccatgaggcagagtggggacaattccccgagcctggctctgcccttttcagggctggggactgggtgatcctgggaagctgttaaaggtgcctaacagtatgtgtacctacaaatctaaaacagaagtacaaacagggaatggtgtgagatgtatgtctccttccactccctgacctttgtcctccaactcacttcttcagaggaaaccaccattagcagtttctgtggatctttccagaaattgttttacatatacaaacagttgcgtgagcatgcacaccctgctggtgtgtaccctcaggctattctgcactgtgcttttccatgggggcctctggtcagtgggtggagggtatttactgctctgcatggcagcagagggctcctctgcatgggtaattggtggagggtgtctgttgctctgcatggcagcagatggagggctcctctgcatgggtacttggagaagctctgctctattacacctttcagggagtgggggtaaaaactggagcttgaattccttggcctttgccccattctggggtgttctcccttgggaaggaataggctgtgcagcacagtagtcaaaatatgcacagccgggtagatctggtttcaaatacaggctcagtgttggctgtgtgaccttggtcaagtaattcatgtctctgagcctcagtctttgcttttgtgaagtggggatagtcacaggactgaggtgacagagatgttgtgaggagtgaagagacagtgtctggaaagccctcagcaggagcctgctacacagtgagtgctcagtaaagtctctgccagttcctggtttcacacacatacagaccccatttctgagcctgagcctgggggtggcactgccacctttgtcctgaggcagatgaggatgggctgaggagtcaagtggcccactcaatgtggaaactcattacatttgattgttcttcctgggaccttgaaatggaagtggtgggtgatctgaggcgctgagaatgacccttcaaaacacacacacataacaccaacttcacaggaaaacaaggaacatgagagactgctataagcagctgcacgttaaaaaatcagatgctctagatgcaatggacaaattcctagagacacacaaactaccaaaactgactcaagaggaaatagaaaatctgaataggcctgtaacaagtcaggagattgaatcggtaatcaaaaaactcccagcaaagaaatgcctaccaccaggtggcatcattggtgaatcctacaaaacatttaaaggagaattaacatcaatccttctcttaaattcttaccaaaaatctaaagaggagagaacattcccaactcattctatgaggccaagcattaccttgatactgaaactaagactctacaagaaaagaaaattgcaggccaggcgtggtggctcacacctgtaatcccagcactttgggaggctgaggcaggtggatcacctgaggtcaggagttcaagaccagcctggccaacatggcaaaaccccatctctactaaaaatacaaaaattagccaggcatggcagcatgcacctgtaatcccagctactcgggaggctgagccaggagaatcgcttgaacccaggaggcggaggttgcagtgagccaagattgcgacagtgcagtccagcctgggtgataaggcgagactccatctcaaaaaacaaaacaaaacaaaaaaattatatgccatgatcaagtgggttttatcctaggaatgcaagggtggttcaacatatgaaaatcaaagtaatgtaccacattattagaatgaagggggaaaaaaccacatgatcatctcaattgatgcagaaaaagcatctgacaaaatccaacaccctttcatgatataaacgcttatcaaactagtactagaaaagaactctttcaacatgataaatgccatatgtgaaaaactcacagctaacataactttttttttgagacaggatctcactctgttgcccaggctggagtgcagtggcacagtcgtggcttactgcaacctcgacctcccaggctcaagcgatcctcccacctcagcctcccaaattgctgggactacaggcacgtgccacgcctggctaattttttatttttgttgtagagacagggtctcgccatgttgcccaggctggtctagaactcctgggctcaagtgacataattcttaatggtgaaaaactgaaagcatttcccctaggatgaggaacaagacaaggatgtctgttttcataacttctagttaagattagaaacttatactcaacacaatactggaagttctagccagagcaattaggcaagaaaaaaacaaaaggcatccaaattggaaagaaagaagtaatactatctctatttatagatgacatgatcttaatgcctagaaaacccaaaagaattcatacacatacacaaactattagagttaataagtgaattttgcaaaatttcaggatacaaaatcaatacacaaaatccattgaatttctatacactataatgaacaatccaaaaaggaagttaagaaaacaattctacttatgatagcatcaaaaagaataaaatataggctgggcgtggtggctgacacctgtaatcccggaactttgggaggccgaggcgggtggatcacccaaggtcaggagtttgagatcagcctggccaacatggtgaaaccccatccctactaacagtacaaaatgagccgggtgtggtggcacatgcctgtaatcccagctacttggggggctgaggcaggagaatcatctgaaccctgtaggtggaggttgtggtgagctgagatcatgctgctgcactccagcctaggcaacaagaggtaaactctctctcaaaataataataataataataataataataataataataataataataaatatataggaataatttaatcaaggtggtgagaaacttgaatacagaaaactataaaacatttcttgaagaaattaaagatctaaatgaatggaaagacatcccatgtttgattagaagacttaatattgttaaggaatatacagattttttgcaattcctatcaaaatccaataggtttttttccagaaatgaaaaaaaaaattcctaatatgaaaattcctaatattcatatggaatttcaagaaactcagaatagccaaaacaatcttgaaaaaaaatgacgcagttgtaggattcatgctttctgatttcagaacttactgcaggccaggcacggtggcttacacctgtaatcccaggactttgggaggccgaggtgggtggaccatctgagattgggagttcgagaccagcctggccaacatggcaaaaccccgtctctactaaaaatacaaaaatcagctggacgcgatggcgcgtgcctgtagtcccagctacttgggaggctgaggctggagaatcacttgaactcgggaggcagaggttacagtgagccgaggtcgcaccactgcactccagcctgggcaacagagtgagactctgtctcaaaaacaaaacacaacaaaacaaaaaaacaaaacttctgcaaatctacagtaattataacagtgtgctactggcataggatagacatatagaccctggggtagaattgagagcccagaaacaagccctcacatctattgccaattgatttttgacaagggtgctaagacctttcactggagaaagaatagtgctccaaaacctggatatcacatgcaaaagaatgaagttgaacccttaccacataccatatgccaagactaagtgagaattgatcaaagacttaaatttaagagctaaacttagaactattagaaacatcagtgcaaatatctatgaccttgaatttggtaatggtttcttaaatatgacacgaaaagcacaggcaacaaagaaaaaaaataaatttgtcttcattaaaatttaaaagacttttgtgtgtcaaaggacaccattaaggccaggcgccatggttcacacctgtaatcctggcactttgggagacctaggtgggtggatcacttaagaccagaagctcaagaccagcctgggcatcatggtgaaaccccatctctgcaaaaaatacaacaattagctgggcatggtggtgtgcctgtggtcccagctacttgggaggctgaggtgggatgaccccttcagcctgggaagtggaggttgcagtgaaccaagattgcatcattgcacttcagcctgggtgacagagcaagaccctgtctcaaaaaagaaagaaagaaaaaaggacactatgaagagagttaagagacaatccacataacgggagaaaatatttgcaaatcatatgtctcataagggcctaatatccaaaaaatataaagaacaactcaacaacaaaaagacaaacaatccaattaaaaaatgggaaaatgacttgaatggatgtttctccaaagaagacgtacaatggccaacacactcatgaaaaggtgctcaacacattagtcattagtgaaatgcaaatcaaaaccacttctcacctactaggatggctataatttttttgtttgtttgttttttgttttttgttttttttttgagacggagtcttgctctgtcacccaggctggagtgcagtggtgtgatctcggctcactgcaacctccacctcccgagttcaagcaattctcctgcctcagtctccaggcatccaccaccagacccggctaatttttgtatttgtagtagagatggggtttcaccatgttggccaggctgatctggaacccatgacctcagctgatctgcccacctggtcttcccaaaattctaggattacaggcataagccaccacatgtggccggctatatatatatatatatatatatatatatatatatatatatatatatattttttttttttttttaaggaaaataagttttgatgaggatgtggagaaattggaacccttatacattgctagtgggaatgtgaaatggtacagctactgtggaaaacagtttagtgtttcatcaaaaggttaaacagtattcacaataaccaaaagctggaaagagcacaggtgtccatcaatagatgaatgagaaaataaaatgtggtatataatacaatggaatattattccaccacaaaaaaggaaggaagaaattctgatacatggtacaacataaattagccttgaaaacattatgtgaaataaaataagccagacacacaaaaagacgaatattgtccgatttcctttatactaaatatctagaataggcaaattcacagagataagaagtaggctagaggttaccatggctgaggggagagggaggatgggagttattgcttaaggagcacaaagtttctccttgggtgatggagagtgttgacaatagatagtagcaatggttgtgtaacattgtgaatgtactaatgccactgaattgtgcactttaaaatggttaaaatggcaaattttatgttatatgtatttcaccacaataaaaatacatacatggcattcaaggcagctctgtttatgtaaattgaaatataatttacatacacaaaataataaagtgtataattcagtggtttttagcaaattgtgcaaccatcaccactatctaattccagaacatttcatcacctcaagaagaaacctcatagcagtaagtggtcattcctcattcttcccttctctcaggccctggcagacactgaaccactttctgtttcaatgaattgcatattcggaacatttcccataaatggaatccttcttccatatgtggccttttgtgcctggtttctttcactcaatgtgctttcaaggttcatccatgttgtagcttgtgttaatacttcatttttaatggctgactacgattccattattggtatgtttgtttatccattcattagttgatgtacatttaggttgtttccactttttggctattgtgaatagtgctgcaatgaatactcatgtacaattatctatttgaaattcctttaggtatagacgtaggagggaaatgctgggtcataaggtaattctatgtttaactttttcaggcaccagcaaactttttgccagagcagttgaatcattttgcatttccaccagcaatatacaagggttccaatttctccacatcctcaccaaaacttgttttttccactttattttatttatttttgagacagagtctcgttctgttgcccaggcgagagtgcagtgatgggattatggctcactgcaacctcctccccccgggctgaagggatcctcccaccttggcctcctgagtagctgggactacagttgtgcaccaccacacctggaaaatttttgtattttttatagagacagagttttgccatgttgcccaggctggtctcaaactcctgggctcaagagatctgcccacctcagcctcccaaagtgctgggattacaggtgtgagccaatgtgcctggcattattattattattattgttattattatttaagagatagcattttactctgttgcgcaggctggagtgcagtggtgtgatcattgctcactgcagcctctaactcctgggctcaagtgatcctcccctctcgggctctcaaagtgctgagattacaggtgtgagcctggcctcattttccttttttttttttttttaaattatagccatcctaatggatatgaagtggtaccacattgtggttattatttgcatttccctaatgactaatgatgttgattatctttttatgtatttggtggacatttgtatgtctctttggagaaatgtttgttcaagtcttttgcccatttttgaattggcttggggagatgtgacctggatcagggttgacttggcctcaggggcccctctggaaaaggagattctgatcttggggtcagagttggaactttccactctcccctgcccatgcctgcctcatgtgatcccagctgggggaactgggaaagtcacatggctgggcctggtggacagggagagtctcccccaggtaggtggggggagtcccaggcttgggcttttcctctgggacattgggccagctgcctatgacatgggagatgtgctctctggtcccctggcccaggctgttcagcacactgccttttcacagtgcccaacagaaagggcccctgacaaaccatatggccagaaaatggttcccatatgatttttacctctactgcctctgcacttctcgcttttgatcccatcattccctccaccttgtctgtttgttcctttcctgttccatcacctgaatcctccccatccttcagagtatcttctctagagccttctgtgctccccttcctagtcctgctttcagaggtttgcttttgctcctctgggctcctccagcatccaccctttgggctgtgccacctgagaagattccaacatccagcactgagctcagatgactgatatgggggtctggacccctcagtaggtgatgagcttctcaagggttcccagtcccatcaggccccaagcatagggtggcaccagctgcctggcaatgactataccctgtgttggttgatcagacacaggacaggatgtgaaaatcatgggtgttccttctgccctacatccaatccacagacactgggagctctgggccagaggttcccaaacacccacctgtaacagacttctagcctcagactccaccaggcaattagtaaaaattgaaatattcagacactactgtcctagattctgattcaggagccctgggaagggcccaagagtctgtattttaccaagttccccagtagtcctgttatgtaaccaggtttgggagcttctggggctggcaaatcttagtcacttcagtccagtgtgctttctccctgccctctcctgtgccagaatatttgtttctagggtggaagatggacatggatcccttccctggatgaccctcaacagccctataaatcccctcacactcatttccctcccttctcctccattagaacctttttggaggctcattccttttgcctgtcgaattcataggctttaagtctcccttctcccaggaggtcttcctggcttgcctccacatactctctgatcacagatatccagagatggtcattaaacatttagaaacataacattaaagaggctgatataaaacatataatatgtatgggttatggtacagataatttagttacaacatttgtttatgttatcgcatagtatatatttttattatattacagacagatacattataggcatttaggcctagtgcatagatttatgggtgggtcatgatgtagtagagctgagaaagcccatctagtctgttacttcttttcttccccattttcagataggtaaattgaggcccaggtgcataggtaatggggctcaggtgcctgagaatccttggcccccagactcctgctcacttgcatgtaatctcacttaggtttgtgcagaccctccaccctccagttctctaactagtggtgcccacccggctcctggcagctcatggcctaaggaggacaggcaaagggcaattcccagcccccatctgccccccagtgtggccagggcccatctgcacagctggagttggttacccagctgtttatgggtctctgcctctggtgtttatagttccgcctttgggtctgctttgcatccccactaatgagaacaatgccccaggaggcggcggcgggtggttgggggaccactggacgctgagcagtgggctgggcctgtgtcctggcttctgccttgcctggttctaacgaggatttcaggccctttacaaggacacaggaaggacagcaaggtggcccatacggaaacagacacgcctaggtgaggagcgaggaggcgagaaggctaagaatgagtttgccgtgacttaggcactcaaggcaggggagagttggggccaaatctttccttttaagaaaatgcatttttttctttcatcacaagagttataaatctctattgtggaaactttagaacatacagacacataagaagaaaatctaaatgtctgtatcccaccaccctggataatcatgtttcacattttaggacatttcctttctgtctgatatataaagttgtttttgcagaaaggagaatatgcatacactgtattttacaaacctcctttatttttatttttattttttgagacagagtcttgctctgtcacccaggctggagtgtagcgttgcaatcttggcttactgcaacctccacctcctgagttcaagtggttagattctcatgcctcagcctcccacgtagttgggactacaggtgtgtggcaccatgcctggctaatttttctatttttagtaaagagggggcttcacagccgggcacaatggctcctgcctgtaatcccagcactttgggaggctgaggtgggcggatcacaaggtcaggagtttgagaccagcctggccaacatagtgaaaccccttctctactaaaaatataaaaaattagccgagcatggtggcgggcacctgtaatcccagctactcaggaggctgaggcaggagaatcactcaaacctgaaaggtggaggttgcagtgagccaggattgcgccattacactccaacccgggcaacagtgcaagactccatctcgaaaaaaaaaaaaagaaaagaaaaagaaaaagaggggtttcaccatgttgaccaggctcatcttgaactcctggcctcaagtgatccacccgccttggccttccaaaatgcagggattataggcataagccaccacgcccagcctacaaactcttttaaatcataataaattgtcaacatatttatatgttattaaatatttctctactacatcaaattatgttatttctattttgattataatacaagattattgtgaaagaattgcaatcattagtgaagtgcacaaaatttaaggctcaaatgtccccctctttcctgtcccccagtaatacttctaaccctttggtggaaatctctcagatattctcctatgtacatgacaaactggtgtacatggtagagctgtgtcatagtttatttaaataattctgtcacagtgggcattgaggttaggtacacagctgtttgaagcccacaggcagccagtgtgaccagcaaagcctcctggttccaagagcagatcatagtttctcccaggaaatctcactagggcagcataataagcaatgtccttaacaacatgctggctattaacacaggaatgagttccattgggctgtttccttgtaaggtcatgtttgcttttactttttaagttaatacaattaataacattcatcgcagaaaaatttaaaaatacaaataggcgctgggcgcggtggctcacacctgtaatcccagcactttgggaggccgaggcgggtggatcacgaggtcaggagatgagaacatcctggctaacatggtgaaacactgtctctactaaaaatacaaaaaattagccgggcatggtggcgggcgcctgtagtcccagctactcaggaggctgaggcaggagaatggcgtgaacccaagaggcggagcttgcagtgagccgagattgcgccactgcactccagcctgggtgacagagcgagactccgtctcaaaaaaaaaaaaaaaaaaatacaaataggcaaatgtaagaaaatgaaaatcacccataatatggaattaagcccatacgtgatgtttataatgtctgttgcatgcttagtctgtatgtctgtcgcaggccacacacagtgtgctaagtggctagtatgtctgtatgtacaatatttttttttttttttttttgagacggagtctcgctctgtcgcccaggctggagtgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctaggattacaggcgtgagccaccgcgcccggcctgtatgtacaatattatcccaattgtacagatggccacctctagctttttaggtttggtgaatggcccaaagtcttttggctgcaagggggcagaggctgccggaggacccgggcctccagcttccaagtctgcaccctgaagcacccctcattctacacccctcagtttcgttcactgaactgcctggaggttttcctcttccaacataagatgttataatctgcttttttcacttacagataaattgtgaccatctctcggtgttgttaaataaccctctttatggaattccattttatggatgtatcgcactttatttaattgttgaatatgtgggttattctagatattttttagtatcataaacaaagctatgcggaacatttttgtggcttaacctttgagcgtgtttatagttatttccacagggctgtttccctaatggccctcgctgacccatcataccaaaggacaggggggtcagggagaccctgggtggggggagcacccaataagctgtgctcacctggttcttagctgggccaagtcagcttgagggggacatcctaatctatgtagaagacagcaggatgccttattctttaaacagtcctctagaaatggtctcagctgagttcagagaaccactgaaaggctgggagcatagcttgataagtgacacccatgtgggcatgtgagtgcagcccccgcggctctgcagatagttgaatttgaagaggaacgagagaaaaccagtctgcaaaggtgatgtccccatctccaacagaggaaagaggatgcagtccttcctctgcagaaatggattctgaaattggagcaactcccagaggtcccagagctctgctcccagaagtgctccaggggctgttctagggggtgggtggggaacggaggggcttcacacagtcatcctagtgcatggggctcggaccacaagttagccagggtggaaaaggagagggtcccaggcagggggaaagatgagcacggcctggagatgagagacagagccagcgccgcggaggagctgaaagccttagtctgcagggtggaggttaggggcaggggtgcagcaggggttacaggagtctgtactttaccccacatgacaggaccgccatgatggctcagtgaggagaggcgtgacaaggttagggccctcccttgatgttttctcactccctcccataatttctcagacacccaggagccaggcttggtgggtgctgggagagtggcagggaggaggacacgggtcctgggcccttgggatggggccttcggaggctctgtgggagggaagggaggctgagcagggttgccagtgagggagacagctccgtccactgaaggcccgaggagaaggcactctctgctcccccaggcaggctgcccagtgccacccacccctgtgggaaatggtgctccctctacaggacacagggtgggtggagttgaggcaacagcaggagctgttccatctgcagcgtcgcatcccagttctgcctctccctggctgtgtggccgtggcctggttgcctaccctttctgagtcatagttttgttctacataaatgaaaacaatcataaaaggaggattagatgagattatgcatgaaacacccaggtgcagcacctagtaactgctcaataaacattaattagtactgtctgaagctttgcctgccacagaaggaggcgaggtgggcccttcgaggagctgaggtctgcccctccagctctctttgtgaggccctttgaaaggtagagggagcagcggaggcccaggccctgaaactgcggaaaccagagtcagctgtagatgccacctctagcctctttggaggtcagccaccttgctccaaggtgagttctctccactcttctattaaatcaaattgtgagtcccctgcccctggccctgggctggcctctaggtacagagtgcatactatgtgtcaggcccacactatgcaccaagcaccctcagatgaaatcctcccagccccccgtaaggggctccggttatacgcagagttgggcccaggcttagagaggttccgtgagttgcccggacgcagactgtgggtggcagagccagaccccctgctctctgtctggccacagaccctggctcatgactgctgtgctgggccgtccctgcctgtccccctgacccccacatggggtcccctcacactcctccctccctgaggctgccccacctggcccatcctggccctgccatggaggtgagccctgcggcgctctcacaaggcgccattcatccaggcaggctgctgattaaaaccatgtgtggtgtggccagccaaggtggcggcagctccggaagccaggcctggcccggggcttgtgggccttgagagggttgggggagggatctggctgacccacaggcctggcaggctgggggtgctctggggcgggactgacctccccaagccatgtacacccaccaaggagactctgagctgtgattctgactcctaggcccaggctggggatgtggggggcagagaggccccctccaggtgaaggtagggaccgggcttggaatgtctaagacccttgcaaggcccttttcaaggctgcctgggaagggcaggccccgtctatggggtttggttaccgaggaaggcgtgtgtgtgtgtgtgtgtgtgtgtgtgcgcgcgcgcgcgcgcgcacacgcgcatccatgcatatgtgctgaaatccatgcaaggtgcctctgagtccttggactcatgatcacttcggggtttcctaaaggcaattttgtgcagtggttaagaccatgggctctggaggcacaagacctgggtttgagttccacttctgctgctcctgggctgtgtgaccaaaggcaagctgcccagcctctctgagcccctctcctcattcaccagatgatgatggaggcctggtcaatgtggttgagcgaaggtggggctacattggctgggtaggctttttgctcatggctggccttgaggatgggccatccccaacccgcagccccagggcccctaagtcatttggctgtcactcctgacctttgagttgtggcttgtcagggagctgggagggtgctaagtgtggagtgtctgggtttcctgaggccagttagtggaggtgagcaggggataggagaggtgatcaggggtaaacaggggagagcaggggagagccagggagagcaggggagagcaggggagtgtgggatctgcagccggtgtgaggtgtggctgaattagctgcccctgcccaggccaagaacagagtgaggcattgttccggggctgcctcccctggcaccgaggccctcacaggaaagggcgggcaggtgggccgcgccatggctgggactgaccacaggcttggctgtgttgggacccttcaggggcctgtctgtgaggaggcaccctggtttccccaggaacacaagttttactgggtgatgcaggccctctgggagggaggccatttgagggcatttggtcccaactgagcagcccccatgagataccctcagcaccttctcccaagggtgggagtagtcccaaaatatgagctccctggagccaggggtcctgagattctaccctgtgctccaaggccagggcccccgacctcaaacctggaagagctctgtccctctttacactgggcgatgctcaggcccggagggaggggtgcctgtatcacgcagagagctcctgggcagaaactcagcgttgtcctttggggtagactgcttagggaggggagcgagcataggctgttgtgaggaggggcctagagctgaagtggaacagcctccatctcccagccgtgtgactggggcagccacctgccctctctgagcctctgtgtcctccaaaagcaaagagagtcccaccacagggggcctctatgagggctgagaaggtgggttaggggttcagagcctcagagtggctcaggctgagctctggaggcaacctggcttctaacaccagcgctccccctggccagctgtgtcactttgggcaagacatgttctaaaaacatcttcccatgggatttttggggaaacaaatcagctgctatgtagtcatgggctcaccatcatactcagcaggtgttgtgatggtcagtggccaggctatggtcaccagatattcagtcagatgttgatctaggtgttctgtgaaggtatctcgtagatgtgattaaagtccataatcagttgactcttaagtaagggagaccatctgagatgatctggatgaacctgatttaagtggtttgaggccttaaaagcagagctgaagtttccctaaagaagagaagttgtggacaccagcttcagtgcctgagggttccaacctgcccttctggacaacctgccctgctgtgttagggttctcctgagaaacaggaccaatagaaggtgtgtgcatgcatgtgtgcacatgtgtgcatttgtgtgtgtgcacgtgtgtgcatgtgtgtgggtgcgtgcatgtgggtttgtgtgtgcatgcatttgtgcatgtgtgggggtgtgcacatgtgcatgcgcatttgtgtgtgtgcatgcttgtgcgagtgcatatgtgcacgtgtgtgcatgcgtgtgtgtgcatgtgcatgtgtatgcatgtgtgtgtgtacctgtgtgtgcgcacacatgtatttatatagatagatttgttataaggaattggatccccagattatggaggctgacccatcccaagaacagcagttggcaagctggagccccaggagaactgagaatgtaattcttgtcttgagtctgaaggcctgagaagcaagagagctatttcagttcaaatccaaaggtagaaaaagctaatgtctgagttccaaggccagcaggcaaaaataattctctcttactggagggaaggtcggcctttcattctcttcaacttacaggatgaggcccacccacattagcgagggccatctgcctttagtgattcccgtgtcaatctcacccagaaacatcctcataggagaacccagaataatgtttgaccacatttctgggcaccacatggcctagtcaagttgacacataaaattcaccatcacacttatgcatttcagacacacctagccagctcctacgatcgcgtaagccaagtctttgcagtaaatctcttactatacatctcttactagttgtgtttctctggctgaaccctgactgacacacatggtgagctgcgataagaataacaattgcaattatcgccttttctgggaagtccccagcagtaggtctgcatgtcgcaggcccttggcaagtgccaaggagtcccattttataagcggaacggaagtcacagcagtttcggccgggtgcggtggctcacgcctgtaatcccagcacttagggaggccgaggcaggcggatcatgaggtcaggagatcgagaccatcctggctaacacagtgaaacccagtctctactaaaaatacaaaaaattagccaggtgcggtggcaggtgcctgtagtcccagctacttgggaagctgaggcaggagaatcacttgaaccgggaagcagaggtggcagtgagccgagatcgtgccaccacactccagcctgggtgacagagcgagactccgtcttaaaaaaaaaaagaagtcgcagcagtttcttccatgactccaaagggctctaggcagcaaggacaagtcccatccgaagtcccagcacagacagcctcacggccccacctacactccatagcacgacagggctggcttctctgggtgccaagtatgcagaagagggacggctcgcatagttccattgcatgccaggccctttgccacaaacttcacctattaaccagtcatctaatcctcacaatagagcaccaaggtggctactgatggcggcagcggcccatctggagcagccgctgcagggacatcagctgcagtcggggaggcacatcagctgcagtgggggaggcactgccagggctgcgcgttctgcagagccagagggggccaagaacaggcaggagccccgcccctaccaagtcggccaggtgggagcccatgctgccaggcacagccacagctctggaccatggcatccctgtgtgctcaggggcctgggaagtccctctccccgcacaggctctgatgtacctgttcctgctccttggcctctccctgctcctggcacctgctctgattttggagcaaagttgtggctgagcccaggtgctgtcacaacccagctaggtgtgcacgcattcgaggtggcactgacacacctgcacccccaccaccttgacctcctctggactttgggcaccaataagcatgggaggaaggcaagggacggctgagggcagctcagcactggcctgctggcacttcttgccatgaacagcctggataccatggacagcatgttgatggcagaggcagacaggtccctgggcagaaaggggcaggtccctagtgaaaccccaccttcaagctagggatggcctgaagcctgggtgctgggctgcctgttctgggtgaagtccacagcccagcccagaatgataactaatggtgctttttccaggccacctacagctgcccatggatgaatcagcaagcactttctcccttctaagcccatagaaacccagattcagccagactcacacagatgtctggactaccagctgtgggaaggagctgcccactgcgggtcttctctccactgcgagatggacacttgtcaggatgacctgcctgcgggaaggagctgcccactgtgggtctcctctccactgaaagatggacatattgggacagcctgcctgcaggaaggagctacccactctgggtctcttgagggctgttctgtcacccaatgaagctcctctctgtcttgctcaccctccagttgtccacatacctcatacttcctggacacaggacaagaactcgggacctaccgaatggtgggactgaaagagctgtaacacaaacaggctgaaacatgccccccacttgccatgttgcgggtggtgaggagagaggagctgcggcccttcagggagtccagacctaggggctccctgagccagggctgtgacaccctctttgggactcgggtttctggtgtctctaagcttccaggagtcaccatgttcccgggtgcccacagtggaagctgcttgcagtacatctggttcaactgcagcttcacacagagccagcccctgtgccggtgcctagagctgcccaccccgccacagctggcacacctggctgtgtgcagtggccaccttcctgacagctctgagcctccgcttctaaagaggtttaagagcaatagtgacgggtttcttttatgtttccctcctttccaagatggtaatgtggatctactttgatctcagttcgaattccagctttcaaccttgagtttctgattcatctttgtatcttgggtacttggcatggagtaggtgtccaataaatttaattgtcacatctttttatctgggcctccattttctcaattatacagtggggatcctgatatagtcttggactttcatgtatctgacaaattggtttttttctttcttattttattcttgccacttcccttgtatagactctcttctctgctaacaccattcccacccctcattgggtggaggagaggaaaaggaaccataagaaaggaagggacgtagagaagaaaggggctaagatgaggatgcctgcctcttctactccacatgttctgggagttccagtcagcgtaattaggcaaggaaaagaaaaaggcatccagattggaaaggaagacataggctggacatggtggctcgtgcctataatcccagtgctttgggaggccgccaaggtgagaggattgctttaggcctggagtttgagaccagcctgggcaacaaagcaagacctcacttcaacaaaataaaaaaaaaataagccaggtgtgatggtgtgtacctgtcatcccaagctactcagaaggctgaggctggaggattgtgtaagcccaggagttcaaggctgcggtgagctgtgatcacaccactgcactccagcctgggtgacagagcaagaccctgtctctataaaaatatacataagtaaaagtaaaagaaaaaaagaaaggaagcagtaaagctatctctagtcacagatgatatgatcttacacatagaaaatcctaagaaattcactaaaaaactattggaactcataaataagttcagcaaggttgcaggatacaagattgatatacaaacataaattgtatctctacacattcaaaatcaacaatccagaaattaaattaacaattccactcacagtagcatcaaaaagaatgaaatacgtatacataaacttaacaaaataaatgcaaattttatactctgaaaactacaaaactgttgaaagaaagtaaagacttaaacaagtggaaaatactatatattcctggactggatgactcaattaacattgttaagatggcagtactcccaaaattgatctacagattcaacacaacccttgtcaaatagctgatataaattgtataaattgacattctaattctacaattcatatggaatttcaagggatccagaatagtcaaaacaatactgaaaaagaatacagcaggaggactcacacattgagattttaaagcaactgcaaagcaacagtaatcatgacagtgtggcacaagggtatgtatttatcaagtctagagtctagaaataaatccatacatctatggtcaactgacaagggttcaaagaaagaccattcagtgagggaaagaatagtcttttccacagaagaaaagaaagagcttgggcttgggaatttggcagattctgccattgtcttgctgtgtgactctgagcaagtggcttaacatctcagagctgaagttttctcatctgttaacatgaggatgagagtgttcatatcacaggcatagacacttgagatctcctatgtgagtgcttagcagagcaggcctcttgggcaagtgcacgaaggcagaggagtactgtgggaatctgctagtggccattaggtcgctccttccaggacccccaggaacccctttccccaggaacaggcagggtcggtggggcttgagtgtgcagacggggcttggcggggttctgcgggttggtaataaatgaacaggaaaggagattccattacgcaggaatgtctggggagggggtggggaaggagccggctcttctcccagcaccagccagctctgcggtcttgattgatgtgccttgcaccgcggcagcggcgggcctggtggaaagaggccccttcactcacccttcctggagctaggccagcagccagatgttcctggcctttggggagctggggtgggggcaggggaggccggcagcgggccagagggcagctgcccagacggcgaacctctctacctccttctcctcagcagctgggcccaggtggcgttggctgtactgctgacctttggccgatggctgtctctcctggactttggctctgttcagaattgggggtggggttctcacccaccctgtcctgctgggagaggcacacagctgcctaggaaagggctttcagctccaaaaaggaaagtatcccacctgcccaaggttcttgtgttaccctggccagagccacagggggaggtgtgactggcacctgaaccacccatggaggaggaaaatccaggttgaggcccctgagtgagtggtttgggagagggtctgaaagcagattctggacttctcagagaaagtccctccagcaggtgctaagatgaacccaaggcgcatttcctcatgagtgcctctcaagtacggtgattatagcagagggctgcaggccaccatctctagccctttcggtggttttattattattgttgtcatattttttttaagagacagggtctcaaactcctggcctcaagaaatcctcccacctcaacctcccaaagtgctgggattacaggcataaaccactgcacacagccaatgattttattgttaaacacataacagctagaagagaatataacaaaacagataactaaatatcaccccaaaattaccatgtaaaatgactgactgccaatatgttggtgtcatttctcctattatttctgtcctgggtctctgtagtatttatgtatgtttacttttcaggaaagtgggctcatcatactcatctagctttgtcactttccttcttctactcaacaccagtggtgcacacctggccacgtcaggaaatgcagatccactttgacctttttagggccgttccatcgtatagctgcctgatgttgtcgagcttttaggggattttcaaaatgtcccttgaatggacaatgcagcattgaatctcttggtacctgcaccttcgtacacatgtgaattatttccttgggataaatggcaagaagtaaaactgctcaaagggtaaacctatgaaccaactgaactcgcacacgcaggccctcattcttccctctgcttatgtccttccctcagagctgcccgcgatgtctactgtgcccccaccccaccttggaaggtggttagtggtactgcaaggcccttcacctgtggctgggggggcactctgaccagacaaggttggcctgggaggccagaaatatctcaccccattgatctctctctagagggcatctcacggtggggaagtcctggactggaacagaaaggaccttggctatgtcctgtctagtccacactttacccactgggagtgacgaggggccagtaccacagcctccttcagtttatacagtctgtgaatgacagcaggtcctctacaatatgcccactgcagggacttctgcgactcacgtggggactgtgaaaggcacaagggcaggatgttcatgtcatgggcactgccccaggcagaggcctgtgcagtgacagcccagcttcctaccaacagactggaaaccctggccagggcaagagcagctcagccctgcagtgagcaactaaagaagacttggctgcttctctttgaggacagggatgtgtgacaaagcggcatgagctgtgactgctcagagaaggctggagtagaatggacttgggggtgacctctcaaggcttcctggaacctgagaatcccaactgcatggaactagcacctttcttgacatttgcatgcagatgctcatttaactttgcacataaagtcagctactaccagcagcattctctaccctacacacacacacacacacacacacacacacacacacacacacacacacacactctccctctctaactaaagactgcaccttcattgcctcacactgcagatcacattcggacacacaataataataatgtagtaataattttaataacacctattgagcgtttactacatgccaggcccttcccaggcattgtccaagcctcctttcgttagcttcattgcaaggatgagagaaagtcacttgcctaaggtcacagagatgctgagcagaggagccccacccacagcacacactcctctcccaccactcagacacaacctggccccccaactccctgcacgctgccttcctgcccgggctgtggtagccgagtgttcaccacatgaaccccccacgcctcacccagcccttggtacacagtggaacagacctggcttgtccagattcaggcagctagagacacagtaactataataaacacaggctgtaaaccaccttcttggcttgtacagatgcggagttttccccagacctgcgcttctgaactggatggggggcagccccttgccccgtccctgaatcctttttctttccctctttttcctgtctgcctccccctgctgtctcctcctttgctctctcaagccactggaggacctacctgctgtgtgcctggcactgaggtcgccactggggctgtggtggggtgggtagctcaggttcccatcctttgggaaactgagagctcatcccatcatgtgaggcctagaaggagggggcttgctcaggtcacacgaggagggagcgtagagccaggcctcacggttgaggctccctgtgcccaggccagggcttttatttggggagacagcacaggccactgggagcactaatggtctaaggtggcatgtgttgcactccaaatacatggctcagacatggaatcctaagggagttcagagtggccctgacatgagttgtatcttccatgtgctgggtgcttgtgcgcaccaggtcctttatatacattctcttatttagtcttcctgataacccaacaagcagatactatgattatcatctttcccccattctacagacaaggaaaccaaggctcacagctgtcaagactcaaacctaggtctgttttctctaaaacctcagctctcccagcaggctgacctgccttggatgaggaagggactggggcaccgaatggataaaggctttgacgaggagctggggtttcagcagaccttgataaggatgggaggaaagagggggacatcctggaaagtgggcactgtttgagccaaggtatggaagccgaaacatacccattgagccctgggaccagcgaggtgacagcccgatcagagggaggcttttggctaagggagccatttgagctcttggcatcctgcagcttattccttggaggaagggctggcaggtgagcctagcccaggaacccaagtctggggagctcttggaggctctgccagggttggccccagaggaacttgggaggccctgagctgggcaaagttctccttggcgtcataaaccaggccccatggaaggaggagccaagaggttcctagtggctgtgccacccccagcgagggacactgccaggggccggcacaagtaccaggctctgaaggtcctcaggattcattggcatcaggttccctgctgtatggcgcagctgcaagccagcatgcaggactggcagaggtgagtgccaggcagaggctcccctcggccttggcagacctggtggggctggaaaatcgggaagggagaagggaaagctcatgcttgacagctgtctctctagggtgaggcagctgaggccactgctgtgataagctcgttaaaccacaaatcacagaggctagaatcaatcttccgctgcagtggagcttcctaaaatagaacacagcccgtgggctcacctgccacttcaatctccctctccttgtcaaatgccgtctcatctttcgggtcttagctctagctactcttcctcagggaagcccgccctgatacctaacccccaacccccactataaactggagatatggtcaaactccagaatagcacttcaaaaactgaggcttttcctatgctgggtaggtaggtggataaatagacagatggatacatggacgggtggatggaaggatggatggatggatggatggatggatggatggatggatgatgtctgggcagaactttggtttgttattatatattcatttgtggaattatttgattgatattgtgccccttctaactgcaagccctgaaaaggtagcagttgtgtcgatcatgttcaccagactatcctcaggccctggaatatagtaaaaacctgagaaatattagtagaacaagttgaatggatgcttgagtggatgtggatgggtagatgtatacatggatgcatggatggatatgtggatgcatggatgtgtatgtagatgcatgtatgtatatgtggattcatggatagttatatggaagcacggttggatatatggattcatggatggatatatggatgcacggatgagtatgtagatacatggatggatatatgggtgcatggatggatatatgaattcatggatggatatgtggatgcatatatgtatatgtggattcatggatgtatatatggatacatggatgaatatatggatacatggatgtatatatggatgcatggatgagtatttggatgtatggatggatataggggtacatgggtggatatatggatggatatgttaatggatggatggatggatggatatagggatgcatggatggatatgtggatggatggatggatatatggatgtgtggatggatatgtagattcatagatgaatatgtggatgatgcatgtatgtgtatgtgaatgctgcatgtaggtatatgtggatgcagggatgaagatgtggattcatggatagatatgtggattcatggatggatatgtggatgcatggatggatgggtgagtggcaggatgaacgagtggaagaatgtatagaagaatggatgctgggtaggtaggtggataaataggcggatggatacatggaggggtggatggaaggatggatggatggatgtctgggtggaacttcagaatgttagactgttagaatgttcataatcatgaaactctagaatgctaaagacaggtaccttttatttattacattgttaaaataaaacatagcattataattagaagggacaattaagagctcagttccctcttataggagatgagcagataggctctgagaagtgaaatcgatgtgtccaaggccacacagcaaattaggtgtccacaaatctgttttctcaccactgtgtgaaacagcctctggaaaaggggccagaaggctttgttccagtcctgtctcttctgaggtttctgtgtgacttgggacaagtcattgggactccattttctctttagaagaaaagattgggtctctcccaggggcaaaatctagctattcccttgcatttttgggaaggtcagccttactgagctgtgttggatatccctccccatacctttctcaaagcccaatagagttgtcaggatgaacgccaggcccctaggggtaaagtgaagtaattttacaatgagtcagtgtacagtatgaatttttttagtttcaaaaaagtgtgaaaacatggttccatattccatagaggatagtccaaaggcctcagcctgactttatggaccctgggagcttctgggacctcccattctggtctgaggaccaacctccaactccctcttgagccagcctggccaccggccatatctccatgcgtgactttccactctctggtgtgccccgggggtcgggggaagctgcgtgttataaaagggcccttagtgagtttctggtaccacataaccttcctggaactttgtcactaccctggacttctgcaaccccagcctctgaagctgggggtgtgtctgccagggggaacttcccctcccccagagccagcctcaggctgcctgtccccacccagaggaaaaggggctccacatgttgggaagggaaggacctctgcagcagccatggaagaaagtaggtcttgagcatctcagagccccagacacccaggattgtgggagtcagagagaaggggatctcagtctgtctaggagagtgggggagaaaaaccatcctatatggcagaggttaggggtggggtgcaggaagggggcaggggagagaagaggaggctggggcggtgctcccaggagctcccaggggccataaagtcagtctaatgaggcctttggactttatcctctgtggaatatggaacctttttttttaaaggtgttcacactttttgacataaaaaaatttgtattgcacagtcacttatttacaaaaaaaaggcagcaaacaatacaactgaattcttagtaaaaaataaattttccttcccctctcccaattccttcttgagaagcaaacccttttgacaggtcttgtatgtctttggagcaatattcgaggctatattgattcaatgcattccattgcttcctttttgtaagtggtaatgtactatacacaccattctctgttccagtgtatgctttatagatttttttttttttctggagacagagtctcgctgtgttgcctaggctggagtgcagtggtgtgatcttggctcactgcaacctccgcctcctgggttcaagcaattctcctgcctcagcctcccgagtagctgggactacaggtgtgcgccaccacacccagctaatttttttgtattttcagtagagacggggtttggctatgttggccaggctggtcttgaactcctgacctcaagtgatccacccacatcagcctcccaaagtgctaggattacaggcaagaaccaccacacccagccttacagataatttctgagcagcacatgtaggtgtatctcattggttttacccccacttactgtcctgccatatagacgctctgcacgtcattacccatccctacgaatggaccttgacatcatttctagccatttgcttccacaaacaaccctgcgatgaacatatcctcacgcattcacctttgagcatgtgggctggtgtgccagctggataacttcctagaagtggtattgctggtcaaaggatacatgcatttaattcagtatgtgtcaccacattgttgcctagaaggttttgagcaggggaatgacaggcccccgtggtctggtcagttgctgctaatgcatttggcaggaggtagaaagagcaaattattggattatgagccacacagtctccaggtctgagatggactaaagtatcttcaaatgagggtttattcagagtccctgtgagccctttcaaagcccccagctctgtgctctctgtagtgctctctggagcctgggagaaagggattccagtagacaagttcctttgctgtggggagaggtccccagttcaccagtcatgcaaggacccacatcccccgccaggggtggctgcaaacaacctagtggggagaggacaggctgccgacagctgcaaggaacgaagttcagccaaagcccgcgcagagggctgccaagagttttttcttttcatttttccaagccttgcgctttgggctggggcacagtgtcatcctcatgtttcctattattttacaaggctcccatcaaagcgccagccgcacaggctctttgatgtctgagctggagcctgcctctgccttggggagaagcatctttgctgaggatcaagaggtgaatgaggcctgagatggtccccatgcctctcccctacgtgctcccctggctcatctcctggctgggaccataggcccctggagggggagagagggaccgccacagccagccaagctgaaaagcctctaagatagctcagaaggggatgtggaggcccagagagggccaaggggctgctccaggccacacagcaacttggtagagcacttcagctctggtggtgatcagacgctgggtgagacagcagaggggatttctaccagagtcaaaccaagcctggcaggcagcctttgtctcttggtttctcagtttctccacctcacgtcctagaagtcttttggggctgatactgtgcatctgagggtggcgcttgtgtgggctctgtcccttctaaatacgtgaccttgagcaagttacttaacacaaccaagcctcagctttttcctctctaaaataagataatggcaattgtcagcttagagggtccctgtgtgggtgcaataagaagattcacagaaaatacttagcacggtgcctgacacgtgaagggtctcgaaaaggaagggctgttatcgttgttgctggtaatgacaataaagaagtgggaagggggcttctaaggagaagaggctggtgcagcatagacttgctgctatacctccccgtcctcagcccagtcctggtctaagaagggactggggccttctctgcaatccagggaattagctccttttctgcccccctcccagcccctacctctaattccaaggctgtcttctgagcctcagggttagagggggtggggaacagatgaggcaaaggtgccaggcctgggatgggggcactaatggtgtctgggccggaaggtctggtaggtgggggaggggtgtctggaggacatggcccgcagccctgactcccggaggcagccagagtggaagtgggggtgggtcttggcaaagctgaaaaggctgggatttgacttggaaacacattgagaagtccctggcggctgcctcctcagtaacagcccctctgaagctgagcccgggacggggaggctgttttgtataaaggggctctggggacctcagtgatggagaatggactgaaacctctcccccagaactgcagcatgcgcagctgagcccccagcacttcctgcaggcctgccccaggggctgcagaattccagccatcaagcctgtgtggacaagggacggggcaggggaggaagggaccctggagttcacagatgggaaagggcagaagcgccgtctcagatagccccaagccctggtctcttggccttcgccttcctgttttttgtcacaactgcattgaacctgtgatgttacttacgtaacagttttctttaaattgattcactttttaaaacctgaatacagttatttcaaagggaatttgatattgctactgtaaagggaagatagtaacactcaccgtacatagtaaccatgtaaataaaatacaataaaaacaaaacaatgttgttaaattttacctagagcctgagacttgttctctctctctctgataaaaaggaagattaacaagcgtcagagctatgttaaagacaggctagcacccaactaagactttcttcttgattatatctgccagataaaatacaagatgccctggctcactcctgtaatcccagcactttgggaggccgaggtgggtgaatcacctgaggtcaggagttcgagaccagcctgaccaacatggagaaaccccgtctctactaaaaatacaaaattggctgggcatggtggcgcatgcctataatcccagctactcgggaggctgaggtgggacaattgcttgaacccgggagacggaggttgcggtgagctgagattgctccattgcactccagcctgggcaacaagagtgaaactccgtctgaaaagaaaagaaaaagaagaagaagaagaagaagaaaagatacaagatgcccattaggtttgaatttcagataaacaatgaataattttttagtatatatcctaaatattgcggaggccctacttaccctggaaaaagttatttcttatttatctgaaattcaaattaactgggtctcctgtatttgtacttgctgaatctggcaaccccaccctcaatgaatgaaagagagtttttaaaggaacagctttctcactgctaagtgatattggatagttccatgtccctatgccaccaagaaaaaaaaatcttgagaaacactgttctgattcaaggtggaattagaccaacaaaacacgctagtgtgggaatctgcaagtaggttaagaacatcccaaatgggggaaattctgacggctccatgcaggagaaggaggcattggggctggacccataggccagctagtgtaagacagcaatcttggagcccgagcacccttcctcccattgagccatagcctggaagacagaggccactcctcagtgattaaggcttgacccttctttctgaagaccggggatcttgtgttcgagtgactgtggtttgtgagcttgagtgactgagtgtgtttgcccaaatcacaccctctcaagatggaaaagggcttttaagggtatctcctctaataccacctaccagtcctgcccaccccatgtgggcatctgaaccttgtgtccagtgatagggtgctcaccacctaccaaggtatgtctttccatcactgggcagcttaggaagctcttccttaggctgaacagaaacctgccttcctgttatgtctctgtagattaaccgctgccttctgaacaaagtgctcccctctgtcccgggacagtccttcagagctgtattggtagcccactggagtctgaatagacatacttctttgaattctacctgttatggcctggtctctggctttctcatttgcggagaaatggccttaggcccccagaccagggcatgcctggaggccctgacttgtgtgctatcttcaggcagggaataagaatgaggtttgtcctgggagccggggccagggcagagccaggacaaggaggaaagctcctttctgagcttttggatgctgagtctgcaggagttgcaggcagagccccggagacctgggttctgttccctacgcagtcccttatttgttgtgcagcttcaggcaacactcctttcccttctgagccttggctctattttatatattccagaagtggcttggcctatttctttttattttttttgagacagggtcttgctctgtcttccaggctggagtgcagtgatatgatctccgttcactgcaacctctgcctcccacactcaaaccatcctctcacctccgcctcccaagtacctgagactacaggcgttcaccaccacactggctaatttttgtgtttttgtagagatggggttttgcctcactgcccaggctggtcttgaacttctgggctcaagtagtccccctacttgggcctcccaaagttctgggattacaggcatgagccaccacgcccggggtgtggcctatttctaacaataaaaacatttgtgtctgttctggttggccagtgctggctggaactgtgataagaattcagaggcggtgtctgggtttggtgggtaaatgggcagtgtgtggtcagtagaatggcagtttgagagctatgtaggtaacagtcatggaagacttagggggctgccagctctggcagtgcttggttctggaataataaagccccacaaagtgaggtgataatgaagtcagacatggggcagggggtgtccctgctgggtggaggggcttaccctgcacggctgtgctgaccctggcgctgtccttcttcagcctgcagacgtgtgttagctcccaccctgccatccagatggccagaggacagaggcgctctgtggaatc

SEQ ID NO: 57 - DNA, 12872 bp, Homo sapiens
ccaccacccccagctaatttttaaatgttttttttgtagaaacagggtctcactttgttgcccaggctggtctgaaactcctgggctcaagtggtcatccttcctcagcctccccaaagtgctggttttacaggcatgagccaccacacctggcagcacccatatattttaaaatttagtatgaattagtcttttctttttgatgtggcataattgtattgactaatccattctttaccattgatttgaaataccacctttattatattaaatttgtgtgtgaatatgaatatcttttctgtgattgcaattaatttgtacttgtacagattgtgctgtaagagcttaacagtatatttcagtacttggtcatgtctcttgttcttgtttttcttttcttttcttttttttgttttgttttttgagacagagactcgctctgttgcccaggctggagtgcagtggcgcagtctcggctcactgcaagctctgcctcctgggttcatgccattctcccgcctcagcctcccaagtagctgggactacaggcgcctgccacgacgcccagctaatttttgttgtatttttagtagagacagggtttcaccgtattagtcaggatgatcttgatctcctgacctcgtgatccgcccgcctcggcctcccaaagtgctgggattacaggcttgagccactgcgcctggccttgttcttgtttttcaaaaatttctttggtattctcacaagtttattcttccaaattaacttcagaatcagcttaccattttaaataagcaccccccttctaaatctattataacatctcactactttctcttctattcatattagcttaacttaagctaccatcctctcttgagtaagactgttttctaacatacagcaacaagagggttctttttaaaacataaatcagattatgtcattcctttgcttaaattcgttcagtgcctttttcccctgtcttttggttatctattgctgtataataagctactccaaagccttgtagcctaaaaacaaccattttattgtgctcacaatttttgggggtcaggaattcatgacaggttcagctgggcagttcttctgttccatattgtgttgctgacactggagaatcccttccattatggcttcttcagtcacatgtctggctcctcagtgtttcttggcctctctctccacaatggcgtcccattcttcagaatctctgcatgtggcctcggcttctcacagcatgctgatctcagagtagtcccattttttacatgacaactggcttctaggaagagggaaataaaaactgtcagaccaattaaggactatggcctggaactacacagtgtgcctttaagccgtattttattggtcagaatagtcactggacctgctagatgaaaggaggtagaaaaataaatttcttttcctaatgagggagtggcaaaatcttattgcgggaaagcatgtgggatgagagatacttgacagttggaaaatataatccgtgacatcgtcaaattcaaaataaattcagagttcttaaaatggcctataaggcttttcatgatctgactcctgcttcttgaatctctgaccgcatcccctagattttcctcttcgttccctttgggttaaccacattggccctcttgctaggctttgaacatgccacacccaacatcagatccattttacttgcaactactgccgtgaatgctcttctttagatctttgcatgggtcttcccgttctcattcattcattcattttgagacagggtctcactctgttgcccagactggagtgcagtggcacgatctgggctcaatgcaacctccgcctcccgggttcaagcaattctcccacctcagcctcctgagtagctgggactgcacgcatgtaccaccatgcctggctaatttttgtatttttgggtttcacgaggtttccccatttggccaggctggtctcaaattcctgacctcatgtgatccgcccgcctcagcctcccaaagtgctgggattagaggtgtgaaccactaatcccatggctggtcttcccatttttttacttcatttaggtctctgctcaaatgtcacatcttcagagagcttcccctgaacaccttatctgataaattcttggttacttagaactccttaatcttgatttttttttccttttcatagaatttggtgctgttagtaggagcctggggggcctaagtaccacttttcttccttccctgcctggcttctgagcaagttgagaaatgagtaaaggtggaggccaaaatatattttaaaaattcttctgactaaagggagatgaagtaaagggaacaaaagaagtatcatgaagattctcagatgtccgacatgggaaactgggtagattgtggtactatttaccaagacaggaaacatggtaggaagattatgaattaagctttggaaatgttgagtttgaagtgcctacaagttatccatgtggagaaaccaaatggacatttggataacacatctgaagctcaggagagaagtttccattacagattcaggtttggtagttgttctagttttctattgctgtgtaacaaactaccacaaacagtagcctaaaacacacaaaattactatcttacaatttctgtgggtcggagtcaaggcattgcttagctgtgttctctgctcaggttctcatcagcctgaaatcaaggttttggttggggcctcagtcttatctgaggcttggggttctcttccaggctcattggttgttggcagacggttcaggaatctggggagacaagatttttgggagcgccaacccagatgtttccattccatgtgtcagagtcttgttctttcctagccaggcccctgatctggacgtaggagacctgctgcctttgggagttcaacctttgaagcccaacacatacagatttagatatctaatctgtctgtccatccatccatccatccatccatccatccatccatccatccatccatccaatctgtatatctctgagatatataagtgtaataaatgggcgataatcaagtgctggttttggtccttaggtttctctgccctcctgctgcaggagaggagaatctctgtgttttcagagaggttctctggctttcaaacttagttttcaattggaagttaatcagcttttttgtttttatcttttttctttgaaatcaacatctgggagtgaggagcactgggcaaatgcagtgcaggcccagcaccagctttggccaacccccacggggagcctggagcgagaatgggagcctgggacaagaatggctcttctgagttgcccagaattgcggtggctgatgtgtccaggccttcatattgccatatcaattagtcatttgatgtgggttatcttgggaaggatatgaccttgaacagggttgttccttgtaggtgaggcaatccctgaaggggctgactgacagcactcccagcatttaaggtaagtccttttttgaaggaggaactgggtagcacctcagtgtctaccacgatttctctgtatccaccaaatggccaatttgtttttgttttttattatcattattcattcatggatttaaacatatatttagcaaactttctgttaaattatgtgtatagaaaagggcacaaattgtaaatatacagctcagttaaatgttcacaaagtaaacacaccagtgtaaccagtatccagatcaagaaataaaacaatactgtgaatctaggagtcctcctcgtgtttcctttcagtcactgttttccagggatctatcctgacttctaaaatcatgggttgaatttagcatggttttgaaatttatgtaacatcatacaatatgtcttgttctgacttctgtctgtcagtattgtatttgtgaaattaagctcacaattgtaagtcattctcttgctgtatattttttcatggtatgactataccagtttttaaaaaccatttctgctattaacatttggattgttccagttgttgggaattataaaacatgctgctgtaaaacattgttgtgcatgtcttttggtgaacatatatacatttctgttgggtatatatctagtgaaattgctgaatgtgtgtgtgtgtgttcagttttagcagataatgccagtttccaaggtaagtactgagttacatgcctactagtagctcctaagatttccagttgctgtaatttgctcctgtttgtagaagacacagccttcgagggcttatcactgagaactgtatttactaaggtctccactagcagattctgaactcttttgtcctctcgaagctgcaaggctttcaaattctgctttgcttttcagaagtttttagtttagcctttttaccctcttccactcactgaggcatttgagattccctcacgtcttcagttttgccaatctagccctcagtgaacaccagaatctctgatggtttcttcttccattagaggtacattgcctgggaaaaaagccttatttctcaatctgttttcctgaccagaatctgcaaatgccccaggggaaaagcagctgcagaagatccccttacctcattatagctcactctttttggaatcttagtgttgctaatccctattccttcagtagctctctgaattcttcaaacaggtgatttttatatttcatcttttgttagaaattaagtttgtggtgggagctattgttttgcagtaaattattctatcctacatggaaacagtagtatggatttaaatatatttaatatgtttcaataaattgccatccttaagtgttcaaattattacacttttggccagtgggggcctctttaaaattcattcctaaccatttttggcttgaccgttattagtcagtgctgctatctggtatgacaagatgttccggggtcattatgtcttttttttttttttttcctccagacatagaagcagccatttcctaaaggagtccagattccttttactgggaaatggtcgttcaagattacaactgagtgaggattactatgggattggtcattagtcattactatgggattggtcattgtttctaggcattttcattggacagaaatagaaatatgttttttaaagtacaaaataaaatatcttgacttcatatagatacttctatttcaaattcaagactacatttctttactttaccattacttttatttcccatgctgaaagtcttgggtttttagaggcactaggagtcatagaattaaaataccacagaattatttagttcctctctttataccattaaataattagatacatttataccattaaagaattagatacagttttcagttgatttgtttatttttgatttctagacttcttaaaattttaattttatgtttatgtaagttacgtagttctaaaatgaaatctacaaaaacaatatgtattccatatagaatatggattctatccttttcacttctactttcttttcatttcctaaaggcaaccactaatttttttgagcatttcattcttctactgttttgttttgtttcttaatataagaaacatatatttctatctcctccctcttcttagatgaatggaacatactgtgtatattttctccatcttgttttttttttaacttaagatgtgtcctggagattattctatcatttaatgaatttggattcattttttggttttacgttacattttatacatgtcttttatttaagtgtcactgtgttcatgttatttgctctttcagcatatataaatatatacacttatatacatgtacacacacacacatacacacacacacacacacacacattttttgagacagagtcttgctctgttgcccaggctggagtgcagtggggcttagctcactgcagcctctgccccctgggttgaagcaattatcatgcctcagcctcccaagtagctgggattataggcacgcgccaccatggtcaactaatttttttgtattttagtagagatggagtttcagcatgttggccaggctggtctcgattgcctgccttggcctcagcatatatttttgtatttagaaagatttattcagaccagcgttcatactgtgtaatgataaggaatttattgtagaaattagattgtatacagttttgaggggactaagtgaggtgagtatctggaatggggaattggaggatcagaggagtccactaaccagatcgtccaaatcaatgacaatgggtagataagttggagctgttggggaaatctgagaagtcaaatatatccagccactgaagtgagattatgaaggaggagcttgaggagggcactgtgggaagctcttgccatgtaaggtttgtcttacaaagccctgtaggtttgcacccaagcatctggtggtaggtttgggctagtattggtcagcaaagtgaccactggtccaaagaaagagctggacatggagtgaaagagagagagagtaaaagctggaactttctgggtgcctctgtatctgtctctcattgtatgttactgtgaaaccttcagaataatagctgctgcttcgcttccacatttcaaacaaattttatacaggtcgagtatcccgtatctgaaatgcttgggaccagaagtgttttggatttcacatatttttgggttctagaatatttgccttttactcaccgtgatcatccctaatctgaaatgagcatttcctttgagagtcatgttgttgatcaacaagtttggattttagagtgttgtaggtttcagatttttcaattagggatagacagcctgtacaaattaccctttagaccaactctaaccagaaccatatagtgagtgggatctgggaaagtagttcccagcttaacagttaacacaccacgcaccaccagtacaatttgtgtttttgttctggtggttaccattatattaatacctttatatggtattctaatttccttctcttttggggtggaggggtattatgtgttggttttttactctgagcaatattgaaatgaactagaaacctcctttcctcatctcctttttccctagcattttactctcagttaataacaagacaatcaagaaacatattctactatttatatgctctcaccaccctccctctcctcattttgataattgtattgtatctatattatcaagtacataaagcagtcacctaatatactttctcccttattgccaccattctcagttcttttagaaaacacagtgatgctccggctgggcacggtggctcacgcctgtaatcccagcactttgggaggccgaggtgggtggattacctgaggtcaggagttcaagaccagcctgaccaacatggtgaaaccccgtctctactaaaaatacaaaaaaattagccaggcaatggtggtgcatgcctttaatcccagctactagggaggctgaggcaggggaatcgcttcaaccttggaagcagaggttatggtgagctgagattacgccactgcactccagcctgggtgacagagcaaggctctgtctcaaaaaaaaaataaataaataaataaaaatacagtgatgctccacataatgacattttggtcagtgatggactgcatatgtaatgggagtccctcagtattataatatggtatcattaccttttctatgtttagatacacaaacaccatgtgttcaagttgccaagagtattcagtacaataacatgctgtacagttttgtaccctgtataccatatagcctagaggtgtggcaggctatactatctaggattgtataagtacactctgtgatgttcacatgacagtggaatcatgtaaggacacatttctcagaacataccccatcactaaatatatttaatgattcctattaatgtggatgtctttccaattattctggtcatctgaagcatattctctagtatatcctccaggaaaaggaaaagggaacaaaatttccagggttcttgccgtttagcacagtttgtcattgctataaaattgtctctcagtatctgggacattggttccaggaacctccatggacggtgaaatctgtagatgctcaagtccctgatatgaaatggtgtggtatttgcatatagcctacacacatcctcctgtgtactttaaatcatcccttgattactgataatacttaatacaatgtaatactatataaatagttgttatacactattatttagggaataatgacgaaaagtctgtacctgttcagtacagacatactaaaatttattttttgatctgcagtttgttgaatgcatagatggagaactcatggattcagagggctgactgtatttgaattcagtttggctagatataaaatccttggtttatgttttcttctttttttaattatactttaagttctagggtacatgtgcacaatgtgcaggtttgttacatatgtatacatgtgccatgttggtgtgctgcacccattaactcgtcatttacattaggtatatctcctaatgctattcctcccccctccccctaccccacgacaggccccggtgtgtgatgttccccttcctgtgtggtttatgttttctttaaatatcttaaatttattttactttattgttttctgacataaaattttgtcaaagtctgatgagagtctaatttttgggttttttttgtataaataatgtcctctttctgcctgtaagttcaaaagattttttttttcttgttcacggaagttcaaaatatgttaaggtattggtcattctgggtcacttttccaggtgtgtggtatgcacattaaagatacagtttcaagtttttaaaaatttcaataataatttcagcaaagttttcttgaattctagtttctaatatccactttattccattggtttggtttctttctttggtgactcctgttatatgtatgttgaatcttctttttctatctttttttgtcactttattgtaaatttttattatctcgtatgtaatttcttttttatattacaactttcctccttagtccccccttttttttcaacatttgtttactcttaaagcattatcttctgtgttaatttactcttatgtatcttctggttagttttcatttctgaaatgatttatcttctaattctttcttgagttctgtcaacttatttctatctgtaattcttatttgtgttattccacatcttttgtcattttcttaatttctcttggctcactttgaaataataatttacagttttcatctgttggtggatatgtctttttggaaactttgattttctgttgtttagacccttatttttatgtttttctgtttcttactcctttttcttaataataactttacatattatttgaccatagaacttttctgttggcttatttttatgtgaaattaatttttctgaattggtaggagggatttgtaggccaggatagctttgtagctttatgtctctagagcttattctttttttactttcatgaaataaaaaaaaaatggtctcattctttcagagatctcttgttcatctctctctttttcatttttatttggacctttttccttttctccctttacccctgttttcagtttggagttcattctcagcagtttcttctcagtgtgggctagaactgtgctgtccagtcagatctaataattacatgtgtggctacttaaagctaaatttaaataaactttatttaataataacttaaataaactttaaacttttgatttcttgtctataccagctatgttacaagtggttaatagctacatgtgacgactagtggctgttgtattgggcattgcccatgtagagcactatcattaccacagcaaatcctattagacagtgatgcttttgagtgtgctccattctcttgagacttttatcataggcctttttcattcatctgcaaattgcaatgagcataactaccctctgttttggctaatattcctaaattgggctgctgtgctttttattaaggatgcagtacattgggaatctcctcttgtcagatccattagacattctccttccacctgctttctcttgcatagatgcttataccacattagtatttttgttttttgttttccagacacaggatctcgctctgttgcccaggctggagtgcagtggctagatcacagcaactttctgggctcaagcagtcctcctgcctcagcctcttgagtagctggattacaggcacacactaccaagcctagattttttttttttttttttaaagtaaagatgaggtctcactctgttgcccaggctggtcttgaactcctggactcaagcagtcctcctgcctcagcctctcaaagtgctgggattacaggcatgagccattgcgcatgtccccaaccagttttgtaactataaatggtttgtttctatttgttcacttctctgggtttgggaatgagggaccttgtcccttcattttcatgtagatattcatcagtttgtgtttttactagagaagttctagtttctttgattttttttttttttttttttttttttgagacagagtctctgttgcctaggctggagtgcagtggtgcgatctcagctcactgcagcctccacctgctgttcaagccattctcgtgcctcagcctccctagtagctgggattacaggcatgtgccaccacgctcggctaactttttgtatttttagtagagacagggtttcaccatgttggccaggctggtcttgaacttttgacctcaagtgatccacctgccttggtctcccaaagttctgggattacaaatgtgagccaccgcacctggccatttctctgatttttatgggatacttagggagattcaccagctgcattttatgaaaccctagttcaagaaacatactggaaaaggagatatggtcacaaagaataggagatgtttctaagggaaataataaattaaaatgaaagttacagtgacttgtgctcactgaatctaaaacccagctgattaaaaatttggcaaaataaaattaaaaaggttatctgtgctcgtaaacaaaagtcccatttttggcctttcaggtttttttcctccataatctttataattaacattacgaagttctgtagtttctgttctgccccctcctttacactctaaaaatgctgccccaccccgccaatttcatttagtatttccttttttttttttttttttttttatttgagatggagtctcgcccgatcgccaggctggagtgcagtggcgtaatctcggctcactgcaatctctgcctcctgggttcatgccattctcctgcctcagcctcccgagtagcttggattacaggcacgtggcactacacccagctaatttttgtatttttagtagagtctgggttcaccatgttggccaggttggtctcaatctcctgacctcgtggtctgcctgacttggcctccgaaagtgctgggatgagccaccgtgcccagcctatttagtatttctttactatcaaaataatcgtccattattaactgatttagcaaacttgggcatgcccctcggtctctttccacctttagttgtactatgttaaaaatgagaaagttatattcaggtttgtttttttcacagaggaacattgctaggtttctctgttagcattagcagggtttaatattaacagtaagtatgtccatgatgctttaaatacagaatgctatttttgagcagagtagagatgaacttctagacagtggaacttaactcattcacagagaaatgtaaatgtggtcttctcatagaatattttttctcatgggatttgtctgcttgtgttctgttatcccttcaattgtgtagctgagggtgcttatcttactgagtgagtcttactgttttttccccaggttttatagtttgttcttgcttctgaacaatcagcagttgtttgccattattgacaagaagtctagggcatagattttcttgatctgtttttcttttaatgtttgagttcaatggataagggaaacggttgtatgcattttattgcagacattctctgaaataatttttagccacaagcaaatagctctgtttctgtgagtcatcatttcttcttatatagtgctggataaagaattctattttgtagatagagatttatgacttccagaaagaaagctgcaaaaatggaagtttccaaagaatttaagatttgctataataaatgctatcatatattggtgtttgagatgcaaatgtacatatctgtgtatcatatattggaggttgattgaaaatcggagtttgagatgcaagtataggtatctgtggttgatgcagttttcctaaaacgtcatgattttcaatggcaagtaagttatttatggtcgtttttaaggataagctgttaacgtgttttttttttctttttttttcagcttccaataaaaacaggacagcagaacacacataccaaagtcagtactgagcacaacaaggaatgtctaatcaatatttccaaatacaagttttctttggttataagcggcctcactactattttaaagaatgttaacaatatggtgagtatttgggttactgtgttttggggaatttgctttcttttctttttgattaaaaagtttagaacagcatattttgaagtatggaaagtgattttctgtggactttggatataaccattaatcttattttgtttacgagcacagataaccttttaattt

SEQ ID NO: 58 - DNA, 8341 bp, Homo sapiens
ccaattacaacgacagagccaatgagatccgtcatcactggggaggcaatgtcctgggtcccaagcctgtggcttacattgccaagctcaaaaggcaaaagctaaagaacttgccaccaaactgggttaaatgtacactgttgagttttctgtacataaaaataatacaaatttcccttcaaaaaacatctgaggaattaactatgtctgtggcataaaactgaaaaaaaccgagatcagatacatagtctctgtgagtgagttccaagggctgaccaaaggaacaaaaattggaaggaagggaggggaggggagggggaaaaaagaagggaggaaggaagggggagggaaagcagggtgggagggagggaaagaagaaaggaaggggaatgaaaacgtgggagggaggaaatgatggagacactgcatggaactaaaaatacatactgatttgttcatagtaggaatataaaaaacacttgaagaattaaaaatacttcataagtacaccttcataagtacgatatatacacaaggtatatattgtctctgtcctttttttctctgttaaacttaaatcccagctaacaggctatgttcacagcagccaaatactgcataatgaggtcagtggatttttctttgagactgttccgcaagtttaagctcaggttgagagacacattaggcctggtgtactcctgtaatcatcattggcagtgattactgtttggtaatctaagcttcaactgaatccaacattcttgcctctgctgaaagataattcagaggtgaaagatgaattccataatgctgacacaaactggtggtattcatcatagtgcttattcactgaatgcccattctagcttgaattatatgtccacacactcagcagagccacaccaatattgtttacttaatttttttaagtctccattttaggagaagaaaatctaatgtctctttaatcgtatattttgaataatgtctattctccagtagtcacctgaaaaacacacacacacacacacacacacacttttcctggacctttttacagcagaataatttctcagcattattaattatgtttctgcgtaaaagacatttagggacttttatcctttgtttaattagttatcaaaataatcagtcacacagctatttaataatgggccactcttaacagacaggtgaaacagagtggttgtgttcaaaaaatatttctagttcactagtaacttactaactctctctctcttttttttttttttcttctttgagatggaatctcactctgccactcaggtgcagtggtatgatctcggctcactcgcaacctccgcctcccaaggttcaaacaatcctcccacctcggcctcttgagtatctaggaccacagatgcacctggctaatttttttgtatttttggtagagacagggtttcaccatgctgcccaggctggtctcaaactcctgagctcaagcaatcttcctgcctcggcctcgcaaactgctgggattacaggtgtgagccaagcacctggcccttactaacactcttaaaacttgagctaatttctttcctttcatgagattttatggtctgacactgctgacttattaccttttcttccttgagagtttccaaatactaaaacaacaatctgctcaacaaacagaagaattcgataaatgttgattgaccatctagtacctgcaaagagaccctatgctatcatatacagagttatgagattcagacaacatgctttacaaaaaaaaaaaaaaaaaaaaaaaaaacctaagggatggtttcagattttgcctgtgtcttagtttcagtcatgtttggtatatattgccaagtagctatattttatatccccaactagaatacaagtttttggagatcatgctctatgtcttactgactgcacaagacagtgcaacgcatataaaattgtcacctacaaatgaaaggattccagtgaggctaaatggtgattagctgtgtaaaaccccactattccatacattgtatgtgcttacaatgttagcttatcctcctcttagcagcaaatatcttctaggtgaacagtaataaaataatagtaaggctaacagtcattgagtatttgtttacatgtccaatactgttctcaatattacggtatccatagatttcgtccttgcgataacactaagggatgctattattattcccattttcagatgagaaaacttgcctaaggctatccaactaataactgaaaaagccaggaattaaacccaagccaaactgaccccagaatccaaactaaattactgtcttcccaaattagaggtgtcaccactggacagaaaaagagatacagtccaggtagaggttgcacctctgcaattacagggctccttagtcaattttttctaatttttgacacataccttcccaattttcctggcaaaagcctcccttgagtggaggccactgactgtggggagtttatgttgtggtttggtaatgtgtacaaactgggaggaggatgagaccagaaaaccccttttgcccatagcatgccacaaattgaggactaagtcagtgcatgctgctgacaggcaaagggccagctcggcatgagcagctccgtgcagggactgcatgtgacaccagacaccattttcaaagccactaccttcctccttccccacaaacctcttcatctcccaccaaagtcctgaagcttcaccacaggatcaagtaatccccctctaagccacatctcgtaaatgagagtctaatttctcccacgtgtcatttttcacatgaatgttactacggtcttggctgtacttaaccagagttcaaggtctgatggtttatctacagagacaacatgaccacagagaagagcccgtttccattgccacctgaaagacagatccaccaacacaatgttcaccactttctcacacagggctaaatgagactcaaggaaagagcccaaggtcaaacatttccttggttgaatttaggtggtgggttcccatacagagcacagcaccatcagattcacaaggccaaatgcctcagcatgatgacttgaaaagatgacaagctgcacacaatgttcaaaatctaaattcaaaggtcacttcccactccctaaatagttttataccccaaaagtcattttagaatcatctttccacttttattccatatttgtaatctgattttaatgacctcagggtaggccatttttttaaactccagacaggttctaattcatctatacaacaaagcaatacgtggtgttaaaaaaaagactaagagagtaaatcgatacgtgttcagtgtagtggcagtttagattttttttctttcaattggcaatccttccgacatcaaggttaaattgtactaaaaaagaaaaaaattacacctcattccaaatttgctaattcaagaagaactgaattattctcacgtctacttgtggcaaaacaagaaattactttatgtctcaaatgtgagtatgaattacgactaaattcataaaaacagacgtgacttaagtttttattttactactttgaagttgtaatgtgttcattttcctggtatttttacttaaaagagcttttttttttttttccttaaggactcttcacaagtacttttgatagagtggtataaaattatcctattccaatgaccataatatgaaaatcattttgccaaaaaacatcctggaagtttccctcattttaggtacttgggattattctcataaactgaggaccattcaacaatgttttgaagatatacagtattctattcagaggacaaagcatatattcaaaaaaatgcaaaaatattcatcttttctcaaacaactccagtattaaattcatctagacccactgattcactcagtcttttttttaagtttagtttccaatatgatattatttctgccctcatctcttccttgcaacaccccacccataagggaaaagaagaaacagtcagagatgaaagaacaacaaaaatgtacacaaaaatgaaatgttttctgataagtagcatgtcagagtaaacaagttatttttttccactatcactttcttacatgatctacagcaaaattatgttgcctctgtcttatgaatcatcaatacatcacagcccagcctttttcatatatagtgggaaaaatgctgcagattataactactgtttctgacatggagatatttttaattcatttttatgacatgcttatgttcttttcatcactgaataattgctcgtttccaatactaagctggtatttctttaaagttcacgtaattgcactactggtaactttaggatttggaaggaaaaggatcacaatcgataagcaaatgcaatgacgggcactgacaaagactcaacatttattagaaggcaattgctagagaatgtggctttaattgtgcatacatatttttattcattaagatgaataaccaataaaatcccacactatggtgtcccagcctcataacacattaataaagtttcttaaaggttttggcagggggccagcacagtccattaactctttgcaagttgtaaaaagaagtaaagtcatttcagtttgttttgtggttatgaatgaaacagcaggcagcctgtatggaaacgtcactttggatatggtattggtaatggacgctttgctgcgcaatcagaacagtgtggggagaagttaatgcatcctaccacaacccaagcccagacgcactgaaaagctaatttacttaaaagtggagggaaaagagcagaggactacaagtttggaagatctatttattttgctaataggctgtcacactgcctctgggtaaacttgcccactgtgaaacccaaaagtacaggatacattttaaatgactagaactgcttttcctgattatttttttttttcctaaaaaaaacctggttgcttaggcattcacttggtgagggctggatcataaattacaaaaatgctttttatttaatacaagaagcaaaattctatcctttctacgtttttgttttacatacttgaattaagtcatataaataactacaacaattggtagctatgtatttgtctccgactttgcctaacaatttgaattgaagcgctacacatctccccaaagctttacaatgccatctgttctcatttttcatgacactacaaacattttcctttggaaaaaggattctgtattttgcttcctttttagaatgaaaactggaaaacttgaatgaaactaaatatatagagaggcatccaagttgtacgtgtaaagtagtaaatgtagagggtatttaaaacattttttgtggttaagatctctacccttttcatctgttccactctagagataaaagttcttttttactttaagatttttgcaaaaaataattcaaaactttaaaaataacgaaaaatgaacttaaaaagtgattaaaacccttgagtttgagaacaccaaaaaaaacagaattgctttacaaattgtttttggcacttcacttacgaagaaaatacgctaaaatgtaagtatacatacacacatgtgcacactcacacaaacacacacccacacccctccattaatccctaaccaaatataaatagcatcgttagtcaattacttctgatggttaaaaccacaaattggttacaatgatctgtcactttatatggccaaataataaaacttcaagcagaagagatgattactataagtacaatagaaaacatcattcactgttttaatttgttttgaatttttactggaaaaaaacagaaagaaaatttttaactttcaaatgtaaacattcatcactgagtcctaaaaaaacttcccatttcaaatttcatttgtgtcagtgctaatatgtatcaaaatagccgcatctcttgtacactgtggattttctgggaagttactcacctttgattataggaaagtaaaggaaagtctaattaataggttgaaaccgtactgaatttctgcttctctgtatacatgatcatttttgtctctgtttggactgaaagccagatactcaacaatcattccctaaaaatttaaagtattaattacatacatgtatttgtacaatgttaagtatcactgcaacctggaaaaacttgcggtaaaattaaaatttttcatttcaaaacaacagtgctcttagcttaatcctctacaatattgtattcaaaaatagtttttctgtgtgattaacagtaatattacctgggctatttttaaaatctggaattagaattcaattttaaaaactgcactcaaaaaacatcctggattcagatatgaatggacctgggaagtttcttaaaagaaatacattttatcctagatcgatagtaagaaacagcaaggaaatgcacagaaacaggatatagggaatacataaattgggtctacactggttaagaaacaaagttaaaaaaataattctactcactttaaaatgacactgtgctgaaaaataatgagaatagataaaagctttgaccactcccattgtctaccttaaaaaaatactagtatagttactcaaggcacggaactggacaaactgcaatttgaatccagaagacagaatccagagccagggacaaaacaagtcaaaggagttggtgaccagggcaatggccagaagtttacccgtttatatcagattctgtgccatccaccctgcggggccgtctgagctgtgcttccccagctggtgggcccctccacgtcagccctctcgtagactccaaaaggaaatcagagttgaacagtatagcatattgttattaaaagtgatttgagttgtgacatgaatattgtactttcaataaaggaggtatacactttagaaagctcttcagcctctagaaagaatagacatttaaaagattaaagcgtttaaagaatgatctctccactgaccagaatacccacatcaaaataatgtaccactgggttttattggtagctgcaatttagcccatatgaaatggaatatggccttagtgttaatgcaaatacgttgccatttatcataaaataagtgtcatctctaaaggtaactggactttccttaaaaatgaaccattctaacatgaaagaggcataaattaataaatccctgagaaagcctagcctacggctgtaaggaacatctaactgcttaactgggcaaccaaaagactcatacaaataattagaatacttatttccaattgatgaaagcaaaactactccaattcacattaaggttgatgagtcacataaaccactcactgacttaattttacttagaaattgctcatgcacttttgttgctttcctggaaggttatacaaatgattatatactcatttaattattaaactgaatgatctccttaagggcaacattaaacatactaaagtacagtacaccatgtcacaatgtgcttaagtatccctactaaaaataaaaattaaaacaaggttagaaaacaactaacaactaggttaaattcaatccaaaatatagatttgggaatttctaataaaattgtccatattgtttgaatgggttcaccactgagtaatagtgtgaataatttaggtaatcatctcaaaaggttataattcctctgggaaaaaaaaaaaacatgtttaaaactctacacttacaatatttcacataatataattaataaatgtttgctagatgattggatttaagttatatgataaaaaaatactgctcacacttataatgctttaaatgctttacaacttacaaaacactttcacataagccaccttacgctaacaactgtgttaggtagatattactatccccatttcatagataaggaaattgaggctcacagagattaaatgttttacccaaggtcatagccctagtaaattcactgcttagagaataattagcttaagttaagataacagctacttcctgcttccccattccagtctcagagacacacaaacacaatatgcatcacatataaaatgtgataaaatcaaaaattatacatcaatcatgtttatgcactacattatttgcctatttccattcgtatttttgtaagcgctgtttctgaaaggtaatatagcatataattacacctttctttttaaaatgctatgataatcttctcactgcctgggaagtttccatggcagaaagactgggcacagtcaggtaactggtatttcttgattaccatccaccagtaggttgatcttt

SEQ ID NO: 59 - DNA, 16632 bp, Homo sapiens
ctggaaatgaaactcttgctaaacatgggctctacatgtggatatagagcaagtgcaagttgcaaatcattaactacattggctatgttcaaggaatagaagtgaaaatgctcagctgagtagccctgggctgggctgtggtggccacacagatcccttgcctagatccagagcctgctaaggatggtggcctagcagctctgtcatggactatgaccaaagaagtatttccaaaggatcaccatacactgaactcttcaggcatgacagcaagtgggcagcgtaccaccctcaaaaaggatacacactcgggagtgaggtggcagggaaggagggagatacagaaggaactgccatggagcctggaagaagaaagggggggtgaaggtattgggaagaaaggatgaaggatgcaggtgaggggtggggtggggagcgggggatgaacgcaacacacaggaagaccaagaaacccggaagaatcacgagtacagaataaaaccaataataagtccccctctcatgcaggggacatcattagagatgccacggtccagaggaaggacacatcggctgatacagctgaccacaggttggagcagtgcatctctggggaacatccatgaagaccaacagagaatgagaaggacagagcagcaaagggcacctgcagggatggaacagccaccaggagccagatgctttaactgaactgacttgagttgaaccctcacaacagacccgccatgcaggtacttattagataagagagccgaggaccaggaaggccaaatagctggcccaggttcccccaggtgccagcggtaggactgcaattctgctcgtcgaagccctctctcttccaactgtgacacttttctcttaatgctccaggcctgacggagggcagagatcacagggggtgtagaaaggagctttttgtgatgacatagaaaatacccacgcaccatgggggcagttggcaagagaggagaatgtcttggaaatgggctggacagcagggtgttgattggggccaatgtcaatgctgggcgtgatcaaaggaggggcagtgtcgcctccataagaagggagaacgaagggcatttagagggagtggaacagcagcttatttgagtattctattctgcttagtgtttttcctttaggttaactatttgatcaactactaaggtatgagagaaaagaaaagcaacaaggagacatgggggaagagagctggatggggagggacgcggctgcacccacacagatcctggctccctgtcgctctccttcctgccagcagctcctgggcctgccaggcatccagggaagcagctgtctgagcctaagcccagctggcaggaacccccactgacctggggaccagaggaggaggtgggctgtggtctctcctgtcaccctctgtctgcccaggctgacacctggagtgtctagagtggggccctcagctgcctgcgctgcggctcacagcacctgatggacacacaggtgtggcgcgtcctgctgggctcaaagacacctgctctgggcaccatgcccgtccccatcaacagttgtagatgaggctggagctgagaagaactgacaagcagacgtctgctgaggagctgggccccgccctgaaggaagacagcccagccctcccaaagcacatggttgccaggtgaaatttgcagtcaccagccgccagccatgtggtgacattggatttcaggcaatgaccttgggaacccacattgcatctgcagcaggtgtctgcattcacctcacatagcactctgaaaatgtttgccgctgtcagcaccacctgaaggggcttcccctgcagtcctcttttccatccaccctcccctaattcagaccatgccatttctctatcctgccgcacacctccacatttgagttttcctgcttggatctgcctggcctgatgtgtctggctgctcagagcccagagcctctcccagccctttcacagaagatgagagaatccctaacgcctctgccatttgaccaagacagctcctttcaacttcctcttcccctcgggcaaaatcagcagcagagacaggactaagctgagtggcctaagcccctcctttgattctcaggcccccagagccacccaggtgccagaaacctgctaagacgtatcaccagaccccttgctgatatcataagcattttttccccttctcagcaaaactgacaggacatggcttcctggaaaggaggtgaggggaggagtccccaagcctggtgagaacagagggagtgctggtcgatggcccctgtttctccactgccacctcaagaagccttccaaggagggcagactaatgcttgcactggcttggctaatggaagaagccaggggggctgtgtggaaagaatggaagagcccccagtgggcataacatacaccaaaaagagagggcaccgaccatctgtgttgacagagaaggacatccctcagtagccatcaccgaaaagcaggcacttcatgtctgccctgaaaccatcactatgaacaaagagctcatcaaagaaagggaatttttatagacaccctatagaggagtgattttgattcctaatctgtccattacggccccccgagaagtaggtataaaaagatgatatgcggccgggcgcggtgcctcctgcctgtaatcccagcactttgggaggctgaggcgggcggatcacaaggtcaggagattgagaccatcctggttaacacggtgaaaccccttctctactaaaaatacaaaaaattagccgggtgtggtgccaggtgcctgcagtcccagctactcgggaggctgaggcaggagcatggcatgaacctgggaggcagagattgcagtgagccaagatcgcaccactgcactccagcctgagcgacagagtgagactctgactcaaaaaaaaaaaaaaaaaaggtatgcagtgtggtccctgacagcaggtttgagctcccttgcaaggagaactccagcatttaatgcagaagaggcaagagtcaacttgggtgttcttccttcccagtcttagctctgagtgtagaaaatccaggtacattcctcccgaaatgctgttctggtgagtggatgcagagaggctgcccaccactgtgttatcacagatgccaccctggcatgagatgcaagggaagtagaggcagccatctggggatgggattactgggaagcccacaggcctcacaagccagaggcaccatggtttcttgacttggacgtggcctctcaaatgctggaggatgtccagcccacagcctttggtgatgctctcctggccttatttagaattcttaatgctggcaaacaacttttataaaattatccatttgtatttggatgcatacataaaaatatcctttatctgtatttggttaataaaactagtcttgctctgcctgtatttagcggtgccagctatcctggactctgtttgtgtgcctgtgtatgtgtgtgtgtgtttcattgtttctattccaatcatatcactaataaatgtctatgtataacaaactcatgcagaggagcagtgagcagattattatcctgcattctattgactccttatcacccctttccctgccctgctcaagcccctagatattgatgggtgtgactgagctaggccatcctctgctgttaggcaaaactgtgttcctgtgtgggcataccacgtcccaggagtcgacgactcacttttgccctgagggtccccagtgaggatgcacgtatgcctatggcaggcagggagagctgatgcctggttggcatgagcacctgaattagtgttggccacatatggatggccatgctggtgggcagaggcagaggtcagggggcacaagaagagtggaaaggagatcccagagaagaagcacatggagtgggaaaggcacgcttccaggttagggctggtctgcagacacacatgccccgtggttgggctggggagacgggttggggtggagagggaaatgggggtggggagtaacacgtgcaaaggtggaaatcatgaaccaggttttaagtcctttggctccgtgttatgtatacagaaggcacagagaaaagaatatgggaagttaagactgggctgtttgggtgggcaaggaaggagcttaccaaaaactgtcccaggagaccctctgagatggcccaagaccctcaaagaaagtggcccaccatcctcagctacctcttctctaactttcggtatcttacagctattcctgtatctccctaatctcaaatcacttcttgtgagagtttcctgccaatgatgtcagtaccgcttagatgtaggagcatatttctggacacagttccctgaataaagacttgggatagaaaattaatcctccccctaggagttcataaaactggggcaccgaggggactgatggctaaaaccaaagttgcagtgagcctggaagggaagcagccacttgggagggagccttaaactcgagtggggacggagacagtggccaaagatgttcacagccgtccttgaaagggatgaattaaagagaaggcatcaaggacagtaactcctttatcaaagcccatggctgggcctctctgatcagcccctgcctcctgacacacaaacacacacacatacacacactcacacacacagtctagaccacacctagccactgaagagtgctttaatccatgaaaacacactgagaaataactctggggaaacttgattgggaaggtaagcctgatgtgaaaaactgcaatcatgcatccaaagccaaaaagacatgatcttttgattatctgtgccactactctgattaatgattgttggccatcgcctctagattgacacctgcattatttttgtcccagcctggcttatctcctatcagtcaacgcatcacccacactcccaccagctgtactcaaggtggtcaggcacatgagaatgctttgggaaagatttacatcacgtgacctgtcatgtggcactacattagggctgcaggaccagctattgagcaaaggtatcaccccttccagcaatgagcttcaattttccaatccaaaagaagcagaaacaaatggctaaaaccaagtcagagatgataaccttgagtggctctgctgttttgatgtttacattttcccagaataaactgtataccattcagtatcaccacacagatcacacacgtggcgtggcctgggccctgtttactcaagcagtttcttcttcattgaaggagtccctcctgttcctttaggatttgtggatgacagtcctctgaaggaggtcaggtagatctatgcagatccttcctcccagtggcatcagctcagctactgcaccacagccttcaggcaggagtggaagcccccacaccaagcaacgtgtcctctctatcttcattacctccaaggtctgatgttactcaccctctcccacacctcacacactggaaaccagcatgatgcattagagagatgaagccttttagaatcaaacaaaatagaacaaaggttcaattctccagcacctagtagtgtctgacataaaataggtactgcataaacatcaatacaagatattctggctctgtcactcaccaacagtataattttgtgcaacatctggaagcctcaactttctcacctataaataaggaaagttgagaggcttaaagaagataatctttgtccgtgggttcagcagagggcctggcgtggagagcatggaagtgccttgaaaattggcatttctccagcatttattaacaaaaccataaaataatttaatgctatgccaactatataatgccaaacatttattacttactatgtgccaggcacttttctgagggcttaccatccattatcccttttaatcttcaaaatactatgtcgttggtaaatatcattattcccattttgcacgggcactaattccaagctttgagatggccagggcatgatgtggtcaggcagtagaagtaatgataaaaccagtagagcaggcaagacaagccctggctgcccatgagtctctagctgaacttcattgctaagttcacctttagccccagcaaccagggatgccaagtacacctttccccagaggactcagtcttgcaatgttctctccaaggtctggagaagtcaagaggaagggaaggaaaggaagaggcttccaggtcttagtgcctcatgccctaagattctatgattggtgccaggcctccgtagctctggatgtgcataggttagtgaaaccagcagagtggcagctggaaaggttcgattttgtgtgtctggccatcagctcctcctggactaagggctgtagatgtacacatttttctggcttgtcttattttccactggaaatccagatcccatcaatgctctaaagctggggagtctactgaagttactatgttcaaactttaaaacaaatacacttgaaacccctgggccttcactgtgaggaaacagctcttggatggtttggctactaatttttggctttttagcagtggctttaaataatgaggtgcccatggaaatgcaggggtggaggaggagcaatacagtgacaacaaaagagagaaatctgggaaaatgggaaactttcatgggagataagaaatcttaccgcccttattaggttttctgttctatcagggaggtctcctggctttaataaaatctcattttccctttaaactctcccatgtggtagggccttgtatttaatagggatatataagagaggattccaacctgaggctcaggtggccgggggctccccacactccagtccagcagctgggattgattgcagagctgccagtccagcaacacacaagttgctgcacatcagagagtaatcatgagccatttgatgctgacctgcacgaagtgaagatggcagcttggctcccgttcattcccatttggacagagaagctcatcctggtctttattaaaagtggaccaaaggagtaagtgatgagtcacaatatgtgattgattaggggcatctgcatttgaaagcctccgtggccttcatccatgcctaactccttaaggttcccattagcactgggagattgtgttcattaggagccgctgatgttgataaattcatctttcctgtcacatgcaattctatccagggtctggctctcagttctgaggggctgatccaccttgccttaataccacacgacaggctccttcacaaaacaagcagggtgtcaaaggctagctgttgggagatgccaggcctacaccagcaaaggctggagggaaggaaagggtgagcagctggtaattagaagctactggtgggtatcagaacgcatccatcagatgtctgcagagaggaacacacccagagtatctgtgggtcccaggagctggtgtaggttctgggctattctttcacgattgccaaagagtcaccacttgttgaaccctcgaatgctaacaacagtttctagctctaccaaactcctgttttgccagctttgcccccaagaaaacagaaaagtcatgactagcaaaatgaatcagtgtgaggcacttgcaccaacagagagcatataatttttatctagcaatttcactatcaactccaacaaattcactcttaaagccagaaaagcattccagctttctgcagggaaaatgtatgtgaggggtaagccacccagagtcagttacaactaccctgtctgctgtgggacaagctctctgtgtgttcttttcaaggtgtcagagaggtctgatggacaatgtgcacaagtctgtgtgtgagaagaccaagaaaggcgaggctgtccccgccctctgcattctcatcctggataacccaagctcatgttagtaaggcctctgaggctgatgtccccatttcatctatgtgcctttttccaagacagacactttagctgggattttgagtcctactagtagaggcttgggcaaggccagagtaggaaagaaacctggtggggcagagactgatcgggctttccaggcccacatggccagtgcttacacatcttccatgtcatcttggtccttccccttaactccatcccgcccccccccacgccccagccctcaaaacaatttgggacaacatcattaaattcacacaaacttcttccttaggatccagaaacccggttgtcccccaagaggtagaaaaggctcaagaataatgccacatggacttggctccccagccccagttccactcatcaaaagcaaataccatgtgcatgttctgtgtgtggcactggagacccaaagacaaactgttgatgttcctgccctaaagggtctcatgcagcactcagtaagaaagacaggcagttgattaaataaccacagcacagtgtgatccatgccaacatggacatgctagaggacccagtagcagtccaggaaagggagtgattctgtctacttggggaagaggaggacaggaaggacagatcaaaaaaggcttactgaaacaggtgacatctgatctgagaaagagctcctagagcagtcaaaatggtggggaagacactgtaggcagagctacatgtgttcagtcagcagggtgggaaacagcatggcatgtgggggaacaaagcacaagtggggactgccagcatgaagaactaagtgagggagagcttatgtggaatttagaaaggaaaaaggcaaataggagccaaggagagcaagaagcaatatttccttccactccagccagtcccttatgtgaacagaaaagagcagacagtagagtttgagtcccaacgccactggcatgaccttagaccaatgccttcacttcaagggtctcagcttccccatctgcaaatttggaacagccccacctgtagcatctgccccatggtgttgttgtgagaatcaaattttgataaggttcttgaagtgttgctactctgaagactgtggagagctttggcgatgtgaaaaggtctcatcaatcatcaccagggatcccagcattggccgagggactgtaccaactttgccgaaagtccttggagttcacatgctaaggggaaagcctctattgctccgcaaggcaaaggacccccagccgaggatacagggaagggaagaagaaatccatgtctctgctgctgctccatggaggagcaggatgctggggttcctgtgcccactgcatcccaattaagtatctgtttctcctcatttacacttggctcagctctccaaataccttcctttaaaggattgttttttaaaggcccttcaaactcagcaactataaacactgatgttaggcaaggcactttcagcaagaagcaaccataaggaaataaaattgctgctgttaaatctccactcccaggaagcgatttgctcagcaataaccatttctcaggagccctgatcaatcactgtttgggcaggagagaaggccttcccaggcctcctgatttctccaccctgcagtggaggcagcgcccaccacctttaattttatccagcaggccctgatggtggctttggcctggatttggaaccagaagaaattgtccctgtgactgtcctagaacggacacggggcagccatcactcctgcctggccccacctgcacccagtcctccttgatcctctctgtcttcccaggtcaaccttcggtgccaggcagggttaatcctctctctgcttttagcaggaggagccaaatcccacctatggcaatgtttgcttctggagaaacttatcttcctgcattgctctctcttcatcaaacatgaatgccagcaaaaactcctttcccaggctcacgaaatgtgtaaaaacaaagtacagaaaaagaaatcctacactagattccccagatgttttctatgaggcaattggatctctctttctctctgctagaaaaggctatttaggaaaagccagagaatacgagatgcttatgttatgaaatatcagcccagcagccttgtttactgggacccagttggaaaaaacccagattcccaagtaaataacttctctccttttcctagcaaaaattgctttaaatgatttcaatcctaaagataattttttccaagccaagtgacctttgcctcctttttatagcctcccctagaatggcctgtacagaatgtgtttccctgataagcccagagcttttccagacacagtcttctacaaactcaaatgaaaaagaaaaaaaaaaaaaaaagaaaacaaaacaaaacaaaagggagagctggaaggatcaactcctctgttcccctgtgcaggtaggaaaactgaggtgcaagatgtgacatcctctcccatctctgtggcacccacacatctgattgggcagcacagaagatggggtaccacagcctccccttctacaacatccctcatgggtccacaggagcccctctccccaccttgctgcttggagagaccatttgatttccttgtgcccctcagtggccaccagcaccaactcagtagataggttctgctgcctacttgcaaatccctttgctctccagaagatatctgtgagcaggaaggtatggccaggggtaacgagtgaaatgcagagacctggggctgaggagagaaaagagccaggatggatggcaggggagagtgctgtttctcacagcacagcctggcacaaaagaaaagaacagaaacacacacccacgttctactggaggccgcgagctgaaactgtggtatgggagaggcaatggatagggctttcaggagcaatcctccaacttctgctgacatagcactgttcccccaaatattggaagtgagggtaggaagagcaccctagaagttccatcacccaccccacccaaccatcacactctcctggtgaaaccatctatgctattccccaattatcttgtttctgtgagaaacacatatgttattctcaagagtcatgacggtacctggaagggagcactagctgtggcagcttggtgtttcatgctgcagaggtgattgttgctctgtgggccagaggtctagtgttctcaagtcgtggaaatagtgattcttcccgttgaaaacttaacacgtgctttagagaaaagagtaggagtatttaactcagagctccagcttctcaccacccctggcacatggctggcacatggtatgtcctgggtgattatttcttgagtcattggttgatgccaaagttctctactaggcaacaatccctagagattagaaaggcctaaagcaggctgtgtcctgggttgtcacctctcccctagcatgtcatagttctgaggattgtgcccatccctgaggtgttcttatgagctccttattccctaaaaactaccagacattccaagaagtttcatggatagcaggcatggcagatgattaacttcctcctgtcatttcacctaggtctgtgatctctcctgcgcaaaatgaggttcaaagaaagagaatgagaatgataatgattattgaaaagtccctcccacctctgatattctttgagctgctaagatttgaaatttcactcaatggtatcaggaggttctgctagttgagatttagtctacttcaaaccagtgacagccaagacaattctgaaatgggcactggatcttttttttttttttttttttgaaatggagtctcactctttgttgcccaggctggagtgcaatggcgcgatcttggctcactacaacctccgcctcccaggctcaagcattctcctgcctcagcctcctgagtagctgggattataggtgcacactaccacacccagctaatttttatattttttatggagatggggtttcaccatgttggccaaactggtctcgaactcctgacttcagatgatccgtccacctcagcctcccaaagtgctgggattacaggcatgagcaaccgtgctcggccagatcttttatttataacagatgccataacatttcatacaaaattccccatgattggagatattcaagtggaggcaggacaagtggctgggttgttgtgtgtgggcaagggtggctgtgtactatgggaatgggtacattagcatccaaagggtgattacaccaggcagtgtctcatgtccctcctcatgtgggagcctaccacgcaagggagaaccaggactaggttgatatgacctggcttttacaaaacccctggaggagggaaagaaatggaggcagcatgtcaaagccttgtctgagaagcattcctttctccaaagcatctgaggctctgccttacagatccccatggaccttgcattcctccatggaagcctttgttctctgtattgtgatctatttacaaataccttcctcctcagactgtgggctacttaagaacagggctgtgcttctactctttgattataatgtactctgagcaaccagcatagtggcaagagcatcatcaacatcagtcaaatgttgaaggaaagagtaaaagaatgaagaaataatcttgttcaaggttgcaaaccaccagggaagagccaatcttaaaacccaggattcccgaatctcacactatagctcttcacagtcactctgcaaatttcaaaaacaatgaaagataacatccaaactattaccctttttggtgtacacactgtctccagatttcaaggcttttgcagtagggaccagttatttaattatggtctggcctttactagtcaaaggtatgttcttgggcttcatatgttcttggacttgccaccaccgtcacccctcactgcccctgtacctcataatataacagtggcttaatataacagaggcagggctcaccacattttatatcagtgttggcttatttatggcttgagaattgcttgagatgctgaaactggccccatatgggattccaggagtagcagcagcccctccccttggggcttccgggaactacagataacttttttaatgaatcaaaataccaaagaactaaccctcccaacagttgttatccattgctcaactccctgtagagagcagcctgtggaatttgcagcattgtgatcgtgtgcaaagggcagcaccaggccctggtggtgataacaaggaggcatatttacccaacacttctcccccagggagactgtttttcctccactgcaatactgtggccctcttggctcaccctgcctggtccctgacatggctgtggaagcagatggatggaatcagagaacccgcccagacagaaggaccaaggcaccgagggagaagataatataatgtggcccttcatctcctggtgtgttcctaaagtatggatgattgccattctcaaagaatttcatgatcctgatttaaagaaacttgccaacattccaggaacccagaaaacagacagcagtcctccacagagaggcagaaaaagagacaggacgatttaaagtatcaggagcagggcctcacgggagtgagttcagattgtgcatggcaaagtcaaaacagatgatgctttagagcagtagtttccaaaccctatcacccaaagaacttgctaaagcaccgattgctggtccccaaaacagagcacctgcctcagtaactctgggtctatgtctatcaaattctcaggtgatactggtccaagagccacgccttagggggaaatggcattaatgccaactccagtaaattaggcaggataccaggaagaacttcccactgccaaggttaaacatgagaataagatcaggttactaaggacagttgtggaaatctcctgagctagagactcacgtttctgaaacggatctgaatctgttctgcttagctacaaggtaattttatctaccatggactataatcagtttcaatacaagattatggagtatctccaggattccaagcactctgctgggcactgttactggcaacaggtagcacttgcaaattgaggactggttggtttggttgtatccttgttatagatggggaaactgaggctcagagattcctgcaaggtctcacagctggcgtgaggcagagacaggactcaaactcacatctgcaatctgatcttgtcccttctagatatgaggtagggagcagaggtgcatagaacaatattttcctaaattgtacacttgagacagtgtcctacaagatataagataaaaaagaagtgattcaaaatgtcaaatggccaaataagtttgaagaaaacaaatgcaactgaagaatctgctagacttctcaggtattttaatatacttaagtgtgtagtgcatctctaagaggaggctatgtagtatttcttaaatttgaccagataatcttttatttaaaaacatctatttaaatttcaagtgacattccagttgcaaggaacacagtctggaaacatctggcatggatattaataaggcaaagaatttacacccctagcccgtgttctacttcacatacactcacacatttgggatgaatgcggagtgaatatcaggtgtgattcaaatcagattggaaaagaggattttccaagattctgcagcctttgcccagggctgaggctttaatggagagcgccaggagccccgagcagggtccagacaaagccaggtgccacagggcttggtgggcatcccctgcagcccacaatccctccagggcaggagccagaggcgtctggtcgtcatctgtgcacccccgcaggcttcctgatgtgagagacgattcccaccagaactgttagtcattccagtttctctcaatcaattattcacactcctgtttgcttgctttgagagagaggaggggggaaaacacagaaaaagccacagggcatgataaaatacaagggagaggggagaaaagaaagctggggacttttctgggctgagtatagggtagaccactagatgtgctttctaataggtcacctgcatttgtcctcttggacaaagcacacaggctgaggaggtctccttctttccctgaagcccagagaagaggaagcaggaagagggttaagagcacagccaattgcaggagtcagaaagacgcattccaggctccagcatgagcccttcatggttgtttgccttgcctgcttggataatatttgaccagctgaggggtgcagtgtagacacaaaaatcacagcccctgctgctgctgccttcaggctgtcatgcagcctactgaagtctcagtttctgccatggtaaaatgaggatggctgttcaagctcgcccggagggattcaagtgagatccaaatatgaggtccccgtggcagggacctcaaacctccaccagcctttcaccctaagcatgcacagtcaattttagtgaaaggatcaagatttttaaattgtcatgtgtagtattttgcaaatggctgctacatcatcagctcgttaataacagagagtactggcactggcatggtctgcaataattgttatcgctatcaaaatgatcagcaatgatacgctgccctttgtattcaaagacaatgctactaacacagtataacaagtgcttattttgcattgcacaattatatattgtctgagctaccaatatatttgagagagtatttgcagtatgtgtatgtgagtgcatatatatgtgtgggtgtgcatgtgtatatttatatatacatatataaacacacacaagtatatgcatacacaaatgtagttatatattatgttcatgaacttttttgcgtgtctatgtcttagtgtcttatccttatataggaatacaagttcttatgggcaacgattttcctttgtacttcttctgtatcatctttagttcaaagcagggtgcatcctttgtaggaaacccttaatacattcctgttggcagtcaggtttatcccagcagtggggaaaggctcatattgatccctccatccatgctccctctctctgaagcccactcatggcatgtgttgtgagatggccaagccaccaagcaaaccatacagcccacttgaaaaaagaccccctcgagaaaagaccccctcactgctgagttaattagctggctggctgcacacaccaggattggacatggatatttcaaagcatcttcaccctcagacttaaatgctacctaaagcattccctgggattctatttttcaaaatttattttttccaaagtaaaagtaataaatgctcattaaagaaaattaagaaaaaatgtaaataaatagaaaacaataaataaaccacacctcatcccattttccaagcacaactactgttagcattttgatggttctctttccagtttttattttattcattgtatcatgctttctaattgtctcatgctttttcactgaatgttatcacacaagaatcagttacaagattggcctttataaactaagttttcaatgactacataaatataccaaatctacctaaccattctcctataaatgagtgtatatatcaattccaatttttgatagactaaataaatgctgaaatgtgtatcttggtgattattacccttgaa

SEQ ID NO: 60 - DNA, 9205 bp, Homo sapiens
aatacaaaaattagccggggcttggtggcacaagcctgtaatcccagctactcctaaggctgaggcagaagaattgcttgaattcgggagacaggggttgcagtaagccgagaccgcgccactgcactccagcctggccgacagagcgagactctagctcaaaaaacagagatttaacccactaagccgcggtctgaaagcttttccaagtcccaaagttcttagttcacaataccacaagcaaaagaaattttgtaagcatggatcttagcaaacttttaactgttttttaaaaagtccttaacacctttaacgacaaaaaacaaaaaccaaaaactaaggcatgctgcaacttggtgcccccaaatggccttctcgtccaatccttctttcccaagtggcccccaagtacaaaacccaaccaattcggggtaaaggctgctgggattcaggccgccaccgggccccttcaggggatctgcccagcgtagagggccacatccctaaaccccacttcaggtgccccctgtccctccccagcactggagaaagcaccagcagagagagtgcttcagcggggacatttgggctcatcgctaactccattccacgtacaggaaaataaagacggggaaagggtacccgaagctccgcagctagtcaaggctcaggacccggaacagccaaatacatagaggctgtcttctacagccacgagtctggatacaggtccattccagaagcttcccgaacccaccccgtccggcaggaggctagtctcggagacccccaccaccagcccgcccagacgccgcgccacgtgctcgagttgccgggggaagactcgactcgagtccacgcttgccttggggttcaaccaggttcccgcacctacgtggggggcccacgagaggggtgtgcgcagcgctcaagcagtctcggactccgggcctcccccggctgcctcacgcatcacagcacccccacccgagcgcgggcgggccccggacaggaggaggaagaggcaacaggcaagaagggcgcgccgcgcctcactccgcaggggccgcactgcccacactcaccagtcccaacacaagtcgcagaaactaaccaccgacaccaggcaagaacaagacgcgcaagagctctccggggcgctgcctttatagccagtagggatctcgcgagagtcggaacggacgggggtgccggaggaggagagagaggagggggatgtggcccgagccccgcccggcgcgccccgccggaatgactcggcgctttccctcgttggggcgggtgcggaaaaatactaataccccaccctgttgcggatggctgaggttggagtgaggcgcccttgtggccgctcccgaacccgaacgcttaggttaatcctagatctctgcggaaaaccaggattctctttacttccaggaccactacgcactgtgccctcaatgcccaaactggagtaagcgtcttagctgctgcccacggaggaccacgtctaaccacaccaagccatgagaactgtctatccaaatatttcttaagttcgcagccttaaccccagcgcagatcctcagtaaccctcatggcttagatagcttccttcattgttctctttaattacagggttgctgctttctgttgtaaaggaaaataaaatatcaggactcctaaacttacgccagagggaaagttcatcttgggaggctgattcagttacacgaccatcctctccccggatgaataatttgactttacaatcttgagtcaaaacattacacattagccagacccacacggtaaggcaaaaggcctcagacatttcctgatgactaccccccacaaacacacatacacaaaatcataattaattatttgctcccctggaaacctttaaagtatgtagcctcccataaaacaaggacgtgtcaattgcaactagatctacaatataaagtctagttcctaaaactaaagtttgttctattccacatttttttgagacggagtctcactcaccctgtcgcccaggctgtagtgcagtggcacggtgttggcttactgcaacctccacctcccgggctcaagcgattctcccgcctcacctccggagtgtctgggactacaagcacgcaccaccacgcccagctaattttttgtatttttagtagagacgaggtttcatcatgttggctaggctggtctccaacgcctgacctcaggtgatccgcccgccttggcctcccaaagtgctaggaatgtaagcgcgagccaccgcacctggcctctattccacaaattccataaatgttcactactagattacctttctactagactactttctacctttctagtagtaccttactactagattaccctgagtccaccacataattgttttcttcctccattccctttttcttcaaacattcaccttatcttatgtaaaaatgtagatttaggccacctaggagggcggatcataaggtcaggagatcgagaccatcctggccaacatggtgaaaccctgtctctgctaaaatacaaaaacttagccgagtgtggtggcgcgcctgtagtcctagctacttgggaggctgaggcaggggaatcgcttgaacccggaggcagaggttgcagtgagccgagagcaccactgcactccagcctggcaacagagcaagactccgtctcaaaaaacaaaacgtagatttcctgagcattagctaaagtctttgcctcaatctttcccacccccacttttcaaggaaaatgtataaatactaaaaacctcctgagaacctcttgggaagaaacagccacaaaagtgtctgtgacatggtttagtcagtttagtcactcatttcaattaacactatctcttatccatcccttccactgcagctgaaggaaatctttctgaagtctgatcatgtcactgttattcgtggtttaaaagctggggaagaaacagccacaaaagtgtctgtgacatggtttagtcagtttagtcactcatttcaattaacactatctcttatccatcccttccactgcagctgaaggaaatctttctgaagtctgatcatgtcactgttattcgtggtttaaaagctggggctaaagaaagaaagaaagtaaaatttaaaaagaaaagaaaaataaaaaataaaataaaagctgaggctctgtagtcaatttactgagttaaaactcctcactgtcagggccgggcgcggtggttcatgtctgtaatcccagcactttgggaggctgaggagggcagatcacctgaggtcaggagttcgagaccagcctaacgtggagaaaccccatctctactaaaaatacaaaattagccacgtgtggtggcgcatgtctgtaatcccagctactctggaggctgaggcaggtgaatcgcttgaatcagggaggcagaggttgcagtgagctgagatagcgccattgcactccagcctgggcaacaagagcgaaactctgtctcaaaaaaaaacacacacacacaaacacaaaaactcctcactgtaattttaggtgtgaacttgggcaagtcttaaactcattaaaccttacttttctcaactgtaaaatgggaataatattaatactttattgtgattatctatgtagttcagtacagtacttagttcttattataaattagaaatgttagctgctattagtataactcttccatccttcacacttataacacccagaacacagtgtagttgtttcaagccttcagacttttttttttaagatggaatttcgcttttcttgcccaggcaggagtgcaatggcacgacttctgctcactgcaccctccacctccagcgttcaagcaattctcctgcctcagcctcccaagtagctgggattacaggcgcccaccaccacgcccggctaattttttgtatttttagtagagacggggtttcagtatgtcagccaggctggtctcaaactcctgacctcagttgatctacctgcctcagcctcccaaagtgctgggattacaggagtgagccactgagcccggccgccttcagacttttgtttgaacctggaaaactctttccctggagaaaacatgtctttcagcattactttctctccggctgtttcttacctttactcattcccaggatttacaattcccctcctttgtgtccaaacaatagcttgtatagccaaaaaaatcttttaagcaattttagttttacatttcttcctctgcctgctagagtgactttctggagagtaggatgtgggtgacatctgtctctgtgtccccaaagtcacaacaaagcatctgatataaaataggagctcagtcagtgagcattcaatcaatagtatcatgtttctgtctctgtccccagctccctcactaactcccttggcccttatagtgggataatgaatgaggaagtgctgtctcatgctcattgagcatctcaatttttgttatttatcatactactttgcatagacgtgatttatttgctttttccttctttgcctgaggctgaatagttagttggcattattcctttttttaatttttatgtaacttttattcttttttatcaggcagccacccgagccagcagccagcgtaggctcagagagactcccctttctttcttgcaggagcaagggcagcatgaaagttcagagcttaataatggatggttattggctatgggcaggctaaaccaatacacagtacatacagtcatacttcagcccaaagaaaattgccacctattgtattcaccatatgccaggcattgggctgggcacttgagtttatttttctaattcaagaacaaggccaggcacggtggctcatgcctgtaatcccagcactttgggaggctaaggcgggcagatcacaaggtcaggagtttgagaccagcctggccaacatggagaaatcccatctctactaaaaatacaaaaattagctgggtttcgtggtgtgcacctgtagtcccagctactcagggggctgaggcaggagaatctcttgaacccaggaggcggaggttgcagtgagccgagatcgcgccactgcactccagcctgagtgacagagtgagactccgtctaaaaaaaaagaacaaaagccgggcatggtggctcaagcctgtaatcccagcactttgggaggccaaggtgggcagatcatgaggtcagtagttccagaccagcctgaccaacatggtgaaaacctgtttctactaaaaatacaaaaattagctgggcgtggtggcaggcacttgcaatcccagctactcaggaggctgcagcaggagaatcacttgaacccgggaggcagaggttttagtgagctgagatcccgccactgcactccaacctgggcaacagagcaagactctgtctcaaaaaaaaaaaaaaagaaaaaagaaaaaaagaaaagaaaaaagaactaaaagagagtggagcacatttggcatgtgactatagtcccagctacttggtaggctgaggtgagaggatcacttgagccctggagtttgagcccagcctaggcagtgctgcaagaaccagtctctaaacaaacaaagaaaaaaaaacaggaaaaaaaaagagttatcctagcctagagaaatgttaacagtctatccccttaagatcataaaagtgaaataactggacagagtactgaaaaaagaagaaatctgttgaacaagtctaagtgatttgtagagtctctccaaaggacagtaaagatttcagaaccatggggaggaggctttcttgcagggtctgatgtatacctctagttctatttttagatatattccattgtgctctcttcatttgctcaccattagcatgggaattattccccttgttttatttatatttgtagtaacaagtctagcacagtaactggcatagaagtacttaataaatgttacaatgtgttgaagacttttgagatgtagaattaaattatttgaactacgtttcaggaagttgactctggaagctgtgtgatgaatgaatttagtgactaggagattaggcaaagagagcaattgggaggccacggcaatgatccagacaagagaagtctcagaactgtaatatgacattagcagcagggtagaaagaaggaaatacaaggtatatttcttcaggctttaggattaattggatttaggatgaaaggaaagagtaaattaaatccagtttcttggtgacatgagtgatgtcattaacctgtgacataggaaacactggaagaaaagcaggtttgaggtttaaaataatgttaaacaggccgggagcggtggctcacgcctgtaatcccaacattttgggaggccaaggcaggaggatcatctgaggtcaggagttcgatatcagcctggccaacatggtgaaaccccgtctccactaaaaacacaaaaatcagctgggcatggtggtgggcacctgtagtcccagctacttgggaggctgaggcaggacaagtgattgaacccgggaggcggaggttgcagtgagccaagatggcaccactgcactccagcctggatgacaagagcgagactccatctcaaaaaaaaaaaaaaaaatgccgggtgtggtggctcatgcctgtaatctcagcactttgggaggccgaggcaggtagattgtctgagctcaggagttcaagaccagcctgggcaacatggtgaaaccccgtctctgctaaaatacaaaaaaaaaaaaaaaaattaaccgggtgtggcagtgtgcccctgtaatcccagctacttgggaggctgaggcaggagaattgcttgaacccaggagcagaggttgcaatgagccaagatcgcaccactacactccagcctgggcaacagaacaagactccgtctcaaaaaaaaaaaaaagcagtagttacatcactgcactaatttgctgtgggagacagttacctgactcatcaacagccattgtctcttcttcacagccaactaaatgtaaaaggtaaggcaattcaatgtaagtataaagcccatgtcccaggacagcaatcattttaacagtaggacttgctaacctgatagcagcctgctataaacttataaaccattaaaattaaacctataaaccatgaaactaaatgctctcagataattgtaacaacaaatgcaaaataaaataatggacgccgggcatggtggtgcatgcctgtaaagccagcactttgggagaccgaggtgggcagatcacttgagcccaggaatttgagatcaacctggacaacatggcgaaactccatctgtgggggaaaagcaagagagatcagattgttactgtgtctgtgtagaaagaagtagacataggagactccattttgttctgtactaagaaaaattcttctgccttgagattctgttaatctatgaccttacccctaaccccgtgctctctggaacatgtgctgtgtcaaactcagggttaaatggattaagggctgtgcaagatgtgctttgttaaacagatgcttgaaggcagcatgctccttaagagtcatcaccactccctaatctcaagtacccagggacacaaacactgcggaaggctgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggcatgcctcttgcagttgagacaagaggaaggcatctgtctcctgcccgtccctgggcgatggaatgtctcggtataaaacccgattgtacgttccatctactgagatagggaaaaacctccttaaggctggaggtgggacatgcgggcagcaatgctgctttgtaaagcattgagatgtttatgtgtatgcatatctaaaagcacagcacttgattctttaccttgtctatgatgcaaagacctttgttcacgtgtttgtctgctgaccctctccccacaattgtcttgtgaccctgacacatccccctctccgagaaacacccacaaatgatcaataaatactaagggaactcagaggctggcgggatcctccatatgctgaacgctggtcccctgggtccccttatttctttctctatactttgtctctgtgtctttttcttttccaagtctctcgttccacctaacaagaaacacccacaggtgtggaggggcaacccaccccttcaccatctccacaaaaaataaaaaattagcccagtgtggtggtgtgtgcctgtggtcctaactagtccagaggctgaggtgggaggattgcttgagtcccagagctcgaggctgcagtgagccgagatggcaccactgtactccagcctgggtgacagagtgagcagagtgagaccctgtctcaaaaaataataaaataaaataatgggaacccaaatcacaagacagcactcatttttcttttatttattttattttttttgagacagagtcttgctctgctgcccagactggagtgcagcagcatggtttcggctcactgcaacctccacctcctgggttcaagtgattcttgtgcctcagcctcccaagtagctggaattacaggtatgtgccaccatgcctgactgatttttgtatttttaatagagacagggttacgccatgttgtccagtctggtttcgaactcctggtctcaagggattcacccatctcggcctctcaaagtactgggattacaggctgagtcaccactaccgggcttatttttcatacagatgatttagaatatgtttatgttaaatttttttagattatcactaaaagaaaacagttgaattcttcaatttacaaggattcaatttttaaaattatatttgaatgtacagaggcctacaaataccaatttcagaaacactgttatcaaggatatctatttgttaaaattgaatgcaactgaaagtaacagattaactgcaaataacaagcttaaccaaataggggattaatttttcccatttaacaaggagacagggccgggcacagtggctcacgcctgtaatcccagcactttgggaggtcgaggcgggtggatcacttga

SEQ ID NO: 61 - DNA, 18771 bp, Homo sapiens
atgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggagattatgcctcactactcaaagagtgtggctcaggaaccagtgtagcttggccatgccctggcagtatgttggaaatgcctgccccagaccagttgatgttactaagaacgcccaggggatgagaatggactttatttacagtttgggaagcactggtctaatatgctctcagggaagctgaggtttctactgctttttactttttacccttccactagatgtcctttgcagcagtgtttttctagttggcattacaggtgtctcctctgaggttccagttatttctatactaccaaaattaaaaagacccaagggctgggcatggtggttcacacctgtaatcccagcactttgggaggctgaggcaggcagattgcttgagctcaggagttcaagaccagcctgggcaacatagggagacccctgcctctacaaaaatacaaatgagccaggtgtggtagcccacacctgtggtcctagctacttggaaggctgaggcaggaggatcgcttgagcccaggagatccaggctgcagtaagccatgatcatgccactgcacttcagcctgggtgacagagactctgtttcaaaaaagggagggggggcaagtttttagggggatgagaaatattcttggtaaatcgggcatttctttttttgtttgtttttttttcttggagacagaatcttgctctgtcacccaggctggagtgcagtggcttgatctcagctcacggcaacctccgcctcccaagttcaagcgattctcccacctcagcctccagagtagctgggattacaggcaaccgccaccatgcccagctaatttttttgtatttttagcagagatggggtttcaccgtgttggccaggctggtctcaagctcctgatctcaaatgatccgcacgccttgacctcccaaagtgttgggattacaggcatgagccacagccttaattggtaatttttgaaaaaaaaactagagaaacattgtttcagagataaagcagcaattacacttgtactcccagtgatttaagatgcactattgtaatcaagatgatttgctttaatcaaaatattgttaaaaataggatttcaggacatttaaaaggtttcagcagaaatcttatgattatgtctgacttgcagtattttatttgcctctttgacggctttttttttttttttttttttgagacagagtctcacactgttgcctgggctggaatgcaatggcgcagtctcagctcactgcaaacctccggctcccgggttcaggcagttctcctgcctcagcctccctagtagctgggattataggcatgtgccaccacacccggctaatttttgtatttttagtagagacagggtttcgccatgttggtcaggctggtcttgaactcccaacctcaggtgatccgcccgcctcggcctcccaaagtgctgggattacaggcgtgagccactgcgcccaaccttaatggctttttggtattaaaaaccaggactctgaatgtgcatcaataattcaaataattttatatagttactctttctagtaatagatacccccctccatttttaagtaaagataaacattttttaattaggaaaattaggcacatttaattttagcaaatttagtttttcaacttttttttttttctttttttttttttttgagatggaggctcactctgttgccctggctggagtgcagtggccgcaacctcggctcactgcaacctccgcctcctgggttcaagtgattctcctgcctcagcctcccgagtagctgggattacaggcgtgtgccaccacacctggctaatttttgtatttttagtagagacggggtttcaccatgttggccaggctggtcttgaacgactggcctcaggtgatccgcccacctcggcctctcaaagtgctgggattacaggcatgagccaccatgcccagccagtttttcaacttttaaaaataaaagtggtagaatttttttttttctttttgagacagggtcttgctctgtcactcaggctagagtgcagtggtgggatctcagctcactgcagcctccgcctcccaggcttaagggatcctccctcctcagcctcccgagtagctgggaccacaggcatgcaccaccacgcctggctaatttttgtattttttgtagagatgggtgtctccccatgttgctcaggctgttcttgaacttctgagctcaggtgatctatctgcctcggccttccaaagtgctgggattacaggcatgatgagccactgcacctggccaaaagtggcagaaattttgatatggtttataatcagttttattgtggggaagatgggccattttaatgaatgattatttctattggctaaactaccgagtcacgacatgacaaatacacatgaagctttaatcacatgcagttatatacttctcacaaatcatcaaattatttatctggtcttcacactaagggatttacttagataagccatcgatgatttcagttgttaaaagtgtggctttttaaacagcatttattcagtgcatcctgatttatttcaaaatgaaaaattgttacctttttttctgaataaataaagcttacttttagtggcaaggtataagttataatggttgttcctggataactaaaaattcaggcaaagaggacctgtaaatatttcaaagccatctggtatgtaggctcctattgttagaatttaaactgcctcgagatagtattgcattttaagaacacattttgctttcactgtagacttctcaaattcaatgggttgtccttcataataaaagaccattctaacccacggtcaggagctctggtattccaaggctgttgtgggatttttccttcactgccacctgcccccaaggagtgacaatatatagtgatttttcttgttcttccctgataaccataatgaacagtgagtatgctttctgccagccagagctaaaactcagcgacgttaaccagctcctatgacctaataaatagagataatagatcaattcatcataatggaggttttgagtgactactcctacagtacccagtgtccaactgtaatcagcataatagcaataaagtgcataatgttctctgccattactgcacttagacaatgaaaaaatcctgatatagcaaaatgaccatgtcactcagcaattttaaactgtttcatggagatttactttagggtataagtggcatgtgagaactgagctaaataatatgccactatcaaaggagtgtggcacaagaacactgtattgatgccactaacaaaattgttgagtgttcattgttaattggagtaacagagtacatgcttgtgaaattgaggcatgaaaatagatactatttaaaatctggggccaggtgcggtggctcacgcctgtaatcccagcactttgggaggcggaggcgggtggatcacaaggtcaggagtttgagaccagtctggctaacacagtgaaaccccatctctactaaaaatacaaaaattagccgggtgtggtggtgtgcacctgcaatcccagctactcgggaggcttaggcaggagaatcacgtgaacccgggaggcagaggtcacagctgaggtcgcaccattacactccagcctgggtgacagtgtgagactccatctcaaaaaaaaaaaaaaatctggataacacacaaatgtaattaataaaaataggccaggcacagaggctcacacctgtaatccaaacactttgggataccaaggtgggcggatcacttgaacccaggagtttgagaccagcctgggcaacagggtgaaagcctttctcaattaaaaaaaaaaaaaaaagccaggcgtggtggcgggcacctggagtcccgctactcgggaggctgaggtgggaggatggcttgagcccaggaggaggagattgcagcgagccacaatcaggccactgcactccagcctgggcgacagagccagaccctgtctcaaacaaacaaataaataaataataatgagcttgtgatggatgtcttgatgtccacattaccatgcttttagaaatggactaaaccagtcaatctcctggcagcgggtagtcatcctcaagcgtggccgcacaataggacctcctggcaagtccaggtgctactgatgcccaggctcccctgcagagatactgatttatttggctggggatgtagcccttgagggtacagggttgtttgaaactctccaagactttgtaacagcagctaagattgagaaccacggggcccagggaaagagactcaagtggaaagtcaggagacttggtgaaaatactcagcctgacacactcaagcttctttatcagtacaatgaaagggttggactgcacgttttttaacaacctatgtctaaaatgtcatcctatttttaaagaggcctttgtaaaataaatactgttttagttctgttttcaaagtggggttttgttttttagttttctgaaatgtacaatatcttaggttctcacataaatatatgcatgtatctccactccatccacaaaccccactgaatgacagtaaaggaatgaaaagaaaagctatacattcatagtgacaaaaacagaagggtcagcaacagccaagtgataccaagaacattttcatgcttcagaagcctggaaatgctcaggaattctggaggtgcagtaactcggaaggctgaggaaaagttggtatcagggtgggcaatttgtggtctctgccacaatctacaactgaaaatcaagggcaagtggcgtaagcatattgttatgagacacagacacaaacagacaaaattgctaagttttaaatggctcctgagaagtgggaattggggatgtgaaatggcctttgcaaaaagtgtaacagtgacaaagttatggcagtgtgtagatctgacctaactgactccatcttgcttctgtgttcattcctgggcataggccaaactaactttgggaagaactttaactttgacataaagattgtaacagccctttcctgaaacaaaccccattcttgcatgggaaccacactgcctttgtaggactaacacatgagccacaatattatggtttagtgtcacagctgttttagaatttatctagcaggttttctggtctttactggaaagcccaagaaagtaaaaatagccgggtgcggtggctcacgcctgtaatcccagcactttgggaggctgaggcaggcagatcatgaggtcaggagatagagaccatcctggcttacacggtgaaaccccatctctactaaatatgcaaaaaaaaaaaaattagccgggcgtggtggcgggtgcctataatcccagctactcgggaggctgaggcaggagaatggcatgaacccaggaggcggaggttgcagtgagccaagatcgcgccactgcactccagcatgggcgacagagcgagactccgtccaaaaaaaaaaagaaaaagaaagtaaaaataataataataataataaaagaaaaatagcccgggcacggtggctcatgcctgtaatcccagcactttgggaggctgaggcaggcagatcacctgaggtcaggaattcaagaccagcccagccaacttggtgaaaccctgtctctactaaaaatacaaaaattagccagacatggtggcaggtgtctgtaatcccaactactcaggaggctgaggcaggagaatcgcttgaacctgggaggcagaggttgcagcgagccaaggtcgtgccactgcactccagcctgggcaacaagagcgaaactctgtctcaaaataaataaataaataaaaataaaaaataaaaaaataaagaaattatggttctggagtcttgcagctagaggccacaagattctaaacctcctcaattgctcctagggataacatcactacccactaccataaaacctaagattaggtgctgaagatatttttcagtccatggattagctggtgccacccagatcaataaactggctcatctggtgttgtggcccccacccaggaaccgactcattgctagagcacagcttcgactgacctcctaggatttcatctctgacccgaccaatcagcactccccactccttagccccatacccaccaaattatcctttaaaaacctcagtttccaaatcttcagggagactgatttcaggaatgtgaaacccaaaaatctgagacaggcctcagttaatttagaaactttattttgccaaggtcgaggatgtgtgcctgtgacacagcctcatgaggtcctgacaacatgtgcccaacgtggtcagagcacagcttggtttcatacattttagggagacatgagacaccaatcaacatatgtaagatgaacattggtgtggtccggaaaggcgggacaactggaagcaaaagcgcacaactcgaaaggggagagggctttcaggtcacaggtagatgagagacaaaccgttgcattgagtttctgattagcttttccaaaggaggcaatcagatatgcatttatctcagtgagcagagggatggctttgaatagaatgggaggcaagtttgccctgagcagttcccagcttgaattttccctttagcttagtgattttgggggcccaagatattttctattcacagtaataataaaactccggtctcctgttcagccagctctgtgtgtattaaactctattgcaattcccttgttttgataaatcggctccatctgggcagtgggcaaaatgaacccattgggtagttacaaagagagaagcactggtcaagggtctctgttgttttaaaagccttgtgtaatttgacttctaaaattaaggacatgcatcttttttttttttttttttttgaaacggagtcttgctctgtcgcccaggctggagtgcagtggtgcgatctcggctcactgcaacctccgcctccagggttcaagctattctcctgcctcagcctctcgagtagctgggattacaggcacctgccaccatgcccagctaatttttgtagatttcttttaatacctaattttgacacgggtatggggaaaaagcataaaaatactgtagatgggagtgtaaaattgttaaatctttccaaatggcagtcgggtaacaagcatcaaaatgttaaatgtgaggaacatttaacccgacatttctactcttggaatttatgctaaggaagcaattagacaagcaagactttgagtatacaatagaaaaattggcaggtacctatatgtcatacaccagaatcttgatttgaacaaatggtggttcatccacatgatggaattgtgtgcaaatattttaagtgatatattttatacccaccagatggtcaaaaatgtagaagtctgaaggctgggtgcagtggctcacgcctgtaatcctaagactttgggaggctgaggtgggcagattgcctgagctcaggagttgaagaccagcctgggcaacatgatgaaaccccatctctacgaaaatacaaaaattagctgggcatggtggtgcgcgcctgtagtcccagctgcttgggagactgtggtgggagaaccacttgaacctgggaggcaaaggttgcagtaagccgagatcgtgccactgcactccaacctgggtgacagagtagaccctatctcaaaaaaaaaaaaaaaaaaaaagtagaagtctgaaaatatcaagagttagtaagcatgtgaaacaacaggaacatcgacgtgctattggcgcaactatgcactggcacaatctctttggaagtaagccaaaactggcattacttcaatgaaaagttgaatatgtacttctctttgcccagcaagcagttcctctcctagggaataccaaatggtattaaccacttatgaaaataactaccattacttagtaaagtggaagataaaaacatcatatggcatgtgctagtaggtggcacatgcacgactgtcaataaaagtgatgttctagtgacctcaggctgcacccaacccaaatgtgcatcaacagtagaatggaattataatgacagtgtgataaccatagcaaagagccaagaacacgaaaaaataacagctgtgcacagtgctgtgagtgaatctatgaatctcataaatgtaatgttaaacagaaaatgcaagattggagagaagacctacgtaaactccaaatacaggtacaactatactacatatgtagtagaactaaaagaaacagctaccataaaagtcagatattacatagcataagagaaatcaagaaactacagctacataaaacaaggagaagacaggtcccaacattacacacctcaataaaacacccagttaaaactctactcactgggcctggtggctcatgcctataatcccagcaccttgggaggccaaggctagcagatcccttgagcccaggagttctataccagcctgagcaacatagtgagaccccatctctaataaaaatacaaaaaattcaccaggtatggtggcatgcacttgtagtcctagctactcgggaggctgagatgggaggatcacttgagcctgggaggtcaaggttgcagtgagctgtgattgcaccactgtactccagcctgggcgactgggcaactgtcttaaaaaacaaacaaacaaacaaaaacccaacaaagactgtctcaaaaaacaaacaaaaaacccccaacaaactctacttagttttatttttgcttaaatctttaataaaagggaaagccaggcacagtggctcatgcttgtatccccgctgtgggaggatcacttgagccgaggaatttgagaccagcctgaccaacaaagtgagacgctgtctcaaaaaaaaacaaataaaaaaaaacaaataattaaaatgtaaaaataaaaaactagctgggcatttaccattgtggcaagagggtggtctaagcccaggaggccgaggctacagcgagccatatttgtaccactacaatgcagtgtaggtagcagaacaagatcctgtctcataaaatagtaacagaattaaaaaaaaaaaaaaaacgactaactctattaatctaaaaacaagaaaaaacaacagcaagcttggaaaggcagttgccaggtaacagccacctctggtacactgagggtgaaattaagcccagctcaaatacatacagcacttctttcaggcgaatgtgtaaggaaaagtatcattcttcaaaacagcaggtttaaaggacacctacggcttttaacttgtaaatatattgcatgcagtgcaccatggttatgcaaatgaagctgagtcattgccctatagattaatgccgtagctcccaagcatggctgcagcctgcaaggtagggaaaaggcccagtccagagtccacccgggaaactcaaccaatttgttttgttcaccgatgccctgactgtgatttcttttggataaaggatttcttgaatgctttcaaaaatgacgtccaagcgctacatttgacataagagaaggttcacaatataatgttaaatgaaatataaaaggcaatttacaaaaatatttaatacgattacactttttcttccaaaaatgcccgtgtatgtgtgtgttgggcatgcttttgtgttaccggtggagggtgtccacgttcttggcgttttgaacaaagaattggacaaaacgcacaaagcaaggaaagaatgaagcaacaaaagcagagatttactgaaaacaaaagtacattccacaaggctggagcaggcctagtacaggggctcaagagccccagaattttctggaatttaaataccctctaggggtttcccattggttacatggtgtacaccctatgtaaatgaaatagcggcctgcaatcagtctgtttggttgtggaaagcaaccaatcagaggatgaagtgtagttacaaagttacactcactcctatgcaaacgtctgattggctacagaaagcaaccaatcaggctgggcgtggtggttcacgcctggaaccccggcactttgggaggccaaggcgggtggatcacctgaggtcaggagtttgagaccagtctggccaacatgaggaattatctctactaaaaataaaaaatttagctgggcgtggtggcacgtgcctgtaattccagctacttgagaggctgaggcacaaaaatcgcctgaacctgggaggcagagattgcagtgagccaagatcgtgccactgcactccagcctgggccacagaggtagacaacttccccacccccctaaaaaaaaaaaaaaaaaaaaaagaaagaaagaaaagaaggcaaccaatcagaaatgctttcaattttccatctgccgcacagaaaggtggggtgggggtggggtggatttgcaaagggagtagtttacaatccttttgttatttacctgtggaaagttgggatgttccttttgacttagttttttttttttttttttttgagacggacttcactcttattgcccaggctggagtgcaatggcacgatctcggctcaccgcaacctccgcctcccgggttcaagcgcttctcctgcctcagcctcctgagtagctgggattacaggtatgcgccaccatgcccggctaattttgtatttttagtagagacagggtttctccatattggtcaggctggtctcaaactcccgacctcaggtgatctgcctgcctcggcctcccaaagtgctgggattacaggcgtgagccaccgcgcccggccattgacttagttctagaaagccagcttgaatcggccttaggttccctgcctccggaccctattctcctgcctcatatgcatagaaaagactcgggaggcttacaccaaaatggcggctatatctttttttttttttttttttgagacggagtttcgctcttgttgcccaggttggagtgcaatggcgtgatctcggctctccgcaacctccgcctcccgggttcaagcgattctcctgcctcagcctcccaagtagctgagattacaggcatgtgccaccacaccgggccaattttgtatttttagtagagacggggtttctccatgttggtcaggctggtctcgaactcccgacctcaggtgatccgcccgccttggcctcccaaagtgctgggagtacagacgtgagccacccgcacttggccatcttttttttatatatttttttaactatttgtggttatgtttttgggaatttctgtgcttaacatagtaggaaaaataagaaaaatcggtaataatttacatttcctttcctcagacctggaagcaggcatttcttcaaggaatcttgattccttttgatgggaaaagctatttactcttcaagaattgtcagcctggcgtggtggctcacgcctgtaatcccagcactttgggatgccaaggcaggaggatcacctgatgtcaggagttcaagaccagcctgaacaacatggtgaaaccccgtctctactaagaatacaaaattagccaagcgtggtggtggtgcatgcctgtaatcccaactacttgggaggctgaggcaggagaattgcttgaccccaggaggcagaggttgcagtgagccaagatggggccattgcactccagcctgagcaacaagagtgaaactctgtctcaaaaaaaaaaaaaaaaagaattgtcctgcagactgggggcagtggctcacaccaatcccagcactttggaaggccaaggagggaggatcctttgagcccaggagttcaagaccagcctgggcaacatagtaacaccaagtctctaccaataaaatgaaataaataaataaaaattagccaggcatggtggtgcatgcctctagtcccagctatttgggaggctgaggtgggaggatcactttgctacccgggaagagtgtccaggttcttggcgtcttgagcaaagaattagacaaaacgcacaaagcaaggaaggaatgaagggatttattgaaaatgaaagtacactccacagggtttgagcaggcccaagcatagctcaaaggccctgtttcagaatttttgggagtttaaaaataacctctacttgaggtatgccctatgtaaatgaagaggataaagtaaagttacaatcatttacttggcctacgccctatggagaggctatttcctgtcatagctgaagtgtgaatcggccttatattccctacctccagatcctattttcctgcctcaacttgagccctggaggtagaggctgcagtgagctatgatcacaccactgcactccagccttggtgacagagcaagacttgtctcacaaattaataattaaataaaaagtaaataaaatatgacattgatcaaaacttcattagtagtattagaagacaaagttgagatcatctacaaagtacagatgtttcctgacttatgatggcgttatgttccaataaacccatcagaagttgaaaatatcataagtggaaaatgcatttaatacacttaacctggccgggcgtggtggctcatgcctgtaaccccagcactttgagaggccaaggcgggtggatcacctgaggtcaggagttcgagaccagcctggccaacatggtgaaaccccttctctactaaaaatacaaaattagccaggtgtagtggcacatgcctgtagtctcagctactcgggaggctgagatagaagaattgcttgaacctgggaggtggaggccacagtgagccaagatggtgacactgcactccagcttgggcaagacagagcaagactccatctcggaaaaaaaaaaaatacacttaacctaccaaacatcataacttagcctagcctaccttaatgtaagctcataatactttgtttttttgagacggagtcttgctctattgcccgggctggagtgcagtgagacgatctcggctcactgcaacctctgcctcccaggttcaagtgattcgcgtgcctcagcctcccaagtagctgggattacaggcgccagccaccacgcccggctaatttttgtattttagtagagatggggtttcaccatgttagccaggtgtgtctcgaactcctgacctcaggtgatctgcccacctcggcctcccaaagtactgggattacaggcgtaagccactactcctggccaagctcataatacttatattagcctacagttggtcaaaatcatcaaacacaaagctgttttataataaagtgttgaatatctcatgtgctttattgaatacttgtactgaaagtgaaaaacagaatggttgtatgggtactcaaagtcaaattcatacaactttggcaccatcgcaacatcaaaaattgtaaccctggaactgtctgtagcaaaacaggatataggaaaatagaagagaaaagataagaaacatggagcagggcaccgtggctcccactgaggtgggaggatcacttgagtccaggagtttgagaccagcctgggcaacagagcaagaccctatctcaattttaaaaaaagaaaaaagaaacataaaaaagaaattattaataggatactatacaactaggttgtgaataatatctacatgaaaataatgtaaaaaaaattaagatattaaattaacaaaatgaaaacaaccatttagagaggatgatgtgatgatgggaggaagtgagcatctgtgtgtgtgtgtgtgtgtgtgtgtgtgtgtgtgtgtgtgactgtgagtgaaaaagcatagaccctcttccctagaagcaaatctatatatatctttctgtgatttcagaatcagcttgatggcaagtgacagaaaaatccagaattacagtggtttaaactggatgctgatttctttctttttcttttttctttcttttttcttttttttttttttttttgagtctcactctgtcgcccaggatagagtgcagtggcacaatctcagctcactgcaacctctgcctcctgggttcaagggattctactgcctcagcctcccgagtagctgagattacaggcttccaccactatgcctggctaattttttgtatttttagtagagacggggtttcaccaggttggccaggatggttcccctttcttttctcttctcttttcttctcttctcttctcttttttctttttcttgagacggattcttgctctgtcggtggtgcgatctcagttcactgcaacctccacctcccaggttcaagcaattcccctgcctcagcctcccaagtagctgggattacaggcacgcgcccctacatccagttaattttttttttttttaagatggagtttcactcttattgcccaggttggagtgcaatggtgcgatctcagctgaccgcaatctccgcctcccgggttcaagcaattctcctgcctcagcggcccaagtagctgggattacaggcatgcgccaccacgactggctaattttgtattttttagtagaaacggggtttctccatgttggtcagcctggtcgtgaactcccaacctcaagtgatctgcccaccttggcctcccaaagtgctgggattacaggcatgaaccaccgtgcctggcctaatttttgtgttttctttttagtagagatgagatttcaccatgttggccaggctggtctcgaactactgacctcaggtgatccacctgccttggcctcccaaagtgctgggattacaggcgtgaaccaccgagcccagcccttttcttttctctctttttttttttttttttttgagacaaggtcttactctgtcgcccaatttgacgctgtagtgggctaggatgaaaaccactatactccagccagggtaacacagagaaagagattctgtttcttaaaacaaaatgaaacaaaaaaaaaaacttgaaaaaattgttcggctgggcgcagtggctcacacctgtgatcccagcactttgggatcacaaaatacaaaaattagctgggcgtggtggcttgcacctgtaatcccagctactcaggaggctgaggcaggagaatcacttgaacccgggaggcggaggttgcattgagccgagagcgtgccaactgcactctagcctgggtgacagagcaagactccgcctcaaaaaaaaaaattgttttaattgttttgagacagggtctcagtttgtcaaaacaaaaaattgttttaattgttttgagacagggtctcactttgcattctagcctaggtgacagagcgagactctgtctcaaaaaaaaaaattgttttgttttgagacagggtctcactctgtcacccaggctggaatgcactggcatgatcacagctcactgcagcctcaacctcctaggctcaaacgatcctcctgcctcagcctcccaagtagctgtgactacaggtgtgcaccaccacacttggctaaggctaattttttattttttgtagagatggggtctccctatgttgcccaggctggtcttgaactcctggcctcaagcaatccccctgcctcgaactcccaaagtgctgggattacagacatgtgctaccactcctggccccgagattttcaataaagcctaaacctatttgtagtttgtatttttcttttccattgtctctatacatgaacattgtttccatgtccttgaagtctataattataggcgagacttggggaagtatatcaaaacaaaatgaatgaatcccaatactctgaaatatgcaatatacgtattcgaatttttgaaacgcacatactctctcccaatagtccatacatgagaagagtttttattttaaaaatcctctttctgctagagctggcaccctggtgtgtgccaatctaatagtacactccatagcctgccatcagtatgcctgagtgatctgtgtataaagtataatcattttctaaatctttcagtgtctgccagaaatgtggacatctatagcaaatgcagaaactggccaaattcctacaaggactaaaatcagggttagctcagaaagatggtattgtgtaatcatattaaacaataagctttttgttctatgaagaggcaaacactctttttcactacctacaaccccaatagtatgcaacaaacatgaaattcaactcttttgatgaaacaatactcttggctgatttaaaagttagtaggagcttttctttctgtgaaagtactctgaggtggacaagtcagactagtgtggctaatttaacttctgttgaccctttagacacagctcagatgtcaccttaaaccatccttaaacctccccaccaccagtagaaaataaccctcaagaggttaccctgcaatacctccattttataaattactttattgtttgttgtacatgtgagtgttcagtgttggcctgggtaccccttattctaaatcaaggtatgcctggtgactaatacagtgctcct

SEQ ID NO: 62 - DNA, 18771 bp, Homo sapiens; identical to SEQ ID NO: 61

SEQ ID NO: 63 - DNA, 48984 bp, Homo sapiens
tggatttccaagctcatatctgggtgttccatttgttcaagcgattccagttgtttttgtcttctctgctccatctctgctttctgcctttgcctggatgccgtcgagcccactctgtctgcctggtcttgaaggtggagctgaagggagccctctgccagcgtgcccagtttgggggtctcttgtccagattcagtgctatacaataatgagtcctctttgttgataaatatacctgcctcgggagacaatgtttgacttccatttctaaacgtgggcttgaccgtgccctgatatttttggttctgggccttgcccatgaacgttttcaagtcggtcttggacgctgcctgctgcgcctcctcctctgctgggctcctgggttccccggcaggcagcatctctgggtctgccattttcttccctcttggggtcccagcgccacactcttgcatctctgagaaggcatgcccttccccaggtctctggtccatcctgggcttcagtgccaggtacaagcacaggtgttttttcagctttctgtttatattaaacaactcttcaaaggccaactccagctctttctgccacttgttcttctcccggagcgtgcactgagatgctggggacacggcttcccttctgcagctggaatcagctggccacagctgcccgaggtctctcagcttcccctccagactctgtccctgagagcgactggtcagggctggaacaaagcaaactgccccctttcccagttgcctcctccccgcccgagctgttcctttctctttttcctccacaagcccgatttctcccacagcagccacgagtgggtttgacctttctaggtccgcccctttgctcctccgaggatggatggcacagcggccacccccagacttggtcgaaggttctggccttccctttctcttctcaggcggggccaggtgagaattcatccgacccgtggcttttgtagtctgtggtttctctggactcgctgctgtcttccggggcctggagtgcctggggtgttgctggcccaactcttccctgcaactcctctcttcactaagggctgctctatgcttctccttggccctcgggggcctggctgatcttcgctggatgggcccctgcgagtcaggctcattttccctggcccgtcctcctccccagcccaacagacgtgctgactgcagcctgtccaggccaccgacgtgcaggtgctgtgcctcctgataccctctcctcaactcctcagccaagcgctggagctggtagtttttccacagcttggcatccgctcttctctgcagagcgagatcgcctttgccccgggcttgtagcaatttgtgctttttcctccaaagcaggtcttcgttatcaggacagaggctcagccacatggctccatccatgtttctgttcctgtctgcgaacccagcagatacagcttcccagggaaggtgcttggagccaagagtggagggttcaaggggcgcccccgggcctgaggagccacagaagccacaacgttccacagcaaacctacgaggaagggagcacaagtgcagctttccagatcgctcccaggagagtgagcaaagccctggagacaagcacacgggattctcactgtgaggacaggctgcaaaatgtgcccctccaagctctcttgacccgtgcccaccagggcccactctcagcctcccaatttctgtcctgtacacttttgacaagagcctgtagggcagctgttttgaacagagtgtggtgttgtttcccaggggacattggcaatgtctggaaacattttctattgtcacaaatgcagggaggaggtgctccgggcctgcagctgggtggaggcgagggaggctgctgaataccccacactgcacaggagggctgcccaagacagtgaataacctggccagagatgtcagtagtgccgagactgacaatcccacccaaagggcaagggttaggattcaggtagggatggaggggcacaaagggcagcccttggaaacaaatattgagaagagcaggtggaagtaaaagaggaagtctgggcctctggagggagaattgatcgtaaaggaaaggaggaagagacggggcagggaggagcctgccaagcatgtgtgtgtgcaggagtgtgtgcacgcgtgtgcaggggtgtgtgtgggtgtgtgcacatgcacatgtgtgtgcaggggtgtgtgtgcgtacatgtgtgtgcaggggtgtgtgtgcatacatgtgtgtgcaggggtgtgtgcaaggatgtgtgtgcatgtgtgtgcaggggtgtgtgtgcatgtgtgtgtaggagtgtgtgtgcaggggtgtgtgtgtaggggtgtgcgggcaagggtgtgtgtgcaggggtgtatgtgcaagggtgtgtgtgtctccatgcatgtgtgtgcaggggtgtgtgtgcaggggtgtgtaggagtgtgtgtgcaggggtgtgtatgcaggggtgtgtgtgcataggggtgtgtgtgcaggggtgtgtgcgtggggctgtgtgtgcaggggtgtgtgtgcatagcggtgtgtgtgcaggggtgtgtgcgcgcaggggtgtgtgcgtgtgcacatctgtttatgtttctgtgcacatgcctgcacatctgtgtgtacaggggggtgtacaggtgtgtgtatgtatgcatgtctgtgtgtgcctctgtgtgcatgtcggtgtgtgtatgtgtatgtgtccgtgtggggcatgcaggtatgtatgtgtgcatgcaagtctgatacttgaatccagtagaaaccagagaggaggagaagctggtgttagctctctcttcatgactcccagctctttccttttataatgatcagagaaggactcttccaggtctctttggcatcaggaagggacccatgctttggcaggccttcctaggaaaggaggggcatttacaccaaaacagtacgggattgtgtctgttgccacgggtagctgatgccagaaacagccagatctgtgagctgcaggaaaggctaagggacagccacagtcgatatggagtccccctccactgctccttcccttctttcatcttagtctatgtggaaccaggctaagcctttggagtcaaacgtagttgcagctgaagtcacatgtagttgcaggagtcagaaaatactgcatctacattacagctaacattaaccgtgcaggctcccctctgagcactgggcatgtatccgttcatcttttttacagtaatcctttgagatacgaagctcctaccccccccggttcacagacagggaaactgaggcaggcagagatgaagatgcttaacccagatcacacagctggtaagtggcagagacaggccctctgctgcttggacgaaccccagcacctttgaccaacctcaggtggtcacactgcagctggctttgacttaagtcttctagtgggaggtccttgcacctcttggtaaatcagatcacacaattagaatagtggttaatattatatttagccagatctgccaaccaccatgatgatcaagagagaaagggagagagaaagctgggcccttcaatgcaatgattgagatttttgacaaaggtgccacggcaatttaatgtggggaaagaatagtttttttgtttttcaacaaatgatgctggcacagttggatatccacaggcaaaaaatgggaattcacagccttatctcaccctatatacaaaaattaactcacaatggatcatagaccttcatctacaactataaacgcttagaagaaaacgtaggtgtatattcatgaccttgagtcaggcaaagatttcttagatacaacaccaaaagcacaaccaataaacaaagaaacggataagctgaacatcatcaaaattaaaagaaaaaaaaaacctttgtgcttcaaaaggtaccataagtaaagtgaaaatacaaggtacggactggaaggaaatatttgcaaatcatatatccaacagaagacttgaatccagaacatatgaacacctcttactacccagtaagatggcaaataatcccatttgaaaatcagcaaaagaaggacaggtgtggcagctcacacctgtaatcccagcacactgggaggctgaggcgggcggatcacttgaggtcaggagttcgaaagcagcctaaccaacatggtgaaaccccgtctctactaaaaatacaaaaattagccgggtgtggtggtacgcacctataatcccagctactcgggaagctaaggcaggagaattgcttgtatctgggaggcagaggttgcaatgagctgagattgcaccattgcactccagcctggatgacagagtgagattctgtctcaaaaataaataaataaaaataaaaatcagcaacagatttaaatagatatttcaccaaagaacatagatgtgtggctaatacagcacataaaaacatgttcaacggcagcggtctttagagaaatgcacactgaccctgcagtgtcctgccacctcacatccactccaacggctgtcgtcaaaaagacagacaatagcaactgtcagtgaggaaggagggggaggaattggaaccctgtgcacgctgctggtgggaatggaaaatggtgcagccactttggaaaacagtctggcagtttcttaaaaagggaaacacagacttaccctatgacccagagattccactcctaggtctataaccaagagaaggcctgagtccacaaaaagaaaccaaagctcagagaggttgaataactttcccagctcacatggaggagttggcctcagacaccaaagaccaccaggaacggccacagggatgtccaattaggtgtggtgaggtcggggctgctgtgaatgcccctctgtgtgtctcggaaggtgcctggaggccccaaggttcacagtctatttctgtgccaagagccgttggctcacaccccttgtcaaccaacaattagtaaaacctggacaagtcttccctgctctggaagtgcccccagcccgttcaatgacctcagtgcaccccgtgccagccccactggcgtgggcatcccaatgaagcagcgtcagttttcctggagacacgcaaacgggtaaaaacttaacacatttgggcagagatctttgggataagtctagaaaattgcagccagctccatccttcaggaatcgatccccgctctgacaccatcagatgcaacctcgtccccgctaccccagctctccttgctctcccctctgagaccctccccacttactaacttgaggcagagggcagggtctcacgtggacttgtgcaggcactggcagggaaagcaacagagccttagctgagcccaagatgaccaaggagaaacagccgttcacctgttgcacagcctgctgggatgcctgcctctgcctgtgatgcccaggctgatctccaggcagcccagtgtctctccagccctgccagacaggacgtcgggtgcccttggcaggacacttgccaatgaagacagccatggttccaatcagggccctcgctacagctcccctcccagaggcacctgccctctctggttgcttagaatattctagaaggggcaggggtcctggcgctcctctgtcctccacatcctctgagtgttctgagcatcctgggctgctttggtgttttctactcccctgctgccctctggtcctgccaccccgagctgacaagcctgccttctgctggctgccttcaaccactcagagaaaccacagctcccccctccgcagaagccgcgctcggagcagcagaaggaaggcgagtggacaccaatctggcctccggacggcaccagggcctcccacagagcggagtggacactgggcccattctcctctcttgctctctacagccccgtggccccagcgcaggagccagcccatggcagctccaccccagaccgatccgatcccagcacctgggcccaggaatgtgcttggccaccagattcccagcgattctcaccaaagtcaggcaacctctggcctacagcttgagaatgacgtccaagcagctcgcctttccctgggcggccgctcagacagcttttcagccaaggcagacctcacccagggaccctccacccaggcagcgtggaagtgccagggcccacagacagcacccccccgccccccgccggcctcctcaccccctccgaaggagactccaggcctgctgtgcactcctgtggcatcggggggcggggggcaagcatcacagtcatagggagtgtgaggcgcccagaatgggggctccacagtcaggcctgcaccccggctgcaggataccagatcctgtggttcactgtgagacctccgcctctctcgtctgcctcacgctgccccctcgcacccccaaggtatgacggcatttgaacaatgcacgtgcccatctagagccttggggtgggcctgtgagagagtggccgcccaccccagtccccaccaggtgcatagtcctgcggctaagtcagggcggttgtaacaaaggctcagaccctccaactaccaggctgtgttgtgacgaggctgctggagccccaggcaccatgacgggaatgggtgaatccacccacagtgggtgactctcaatgtgatactagcccggtacacttagacacccaaaaatcaacgcggcagacgttgtatccccaggagaaggacccccccgaacagacacgtgggacaatggcaagcatggccatccctgaggacaatggcaggacccagagtgcctctctcctcctcaaggcatgaactggcccctccagatacagggacaaccttttcttcccacctcggcctgtaacagacacgacacaggccatacccttggctagagtcactgcaacatgatccagagggtgactgtgaaaggagccagcggggctgctgtgtcggttttcctggagacacggaaatgggtacaaacttaaaacatctgggcagaggtctttgggataaagtccagaaaatcacagctggctccatcattcaggaattgatttcccccatgacaccatcggatgcaaccttgtccctgccgcctccagctctccttgatttcccctctgagctcacaaaaagaaacaaaagctcagagaggctgaataactttcccagcttacacggaggagctgggtttgaatccagacatcacactgatcagcacgcagacccgcagggtttcatactcttccggcatttcacgtacacctctctccatctcaccgcctcaccataggaggtgaggcctattcctatccgcacaatctgacagggaaattgagactcagagaggttaagtaacttgcctaaggccacatagctcgtaatcagggcagcagggattccgggccgagcaggcaggcccctgatccaggctcctagcctgctgcccagggaggtcagagctggaaaccacttccacagcacaaggagactctgcttggactgtgcttggcctcacgtgacctctgacctccctggccctcctgtgaccctgacaggtgtgctgagcttctgaagggtgggaaggcctgcaaggggcctgcgtgcattctgtgtgcatcgacccaggacaccacggttggtgcctctgagttcatcacgtcgatcatccccatcttctttctgctcaagtacttgatttgtcaacatgcacagaagggtgagacctggccatggtgctgcttgaatcttgttaacagttaggctctgattcaatagtctgggtggggcccaagactctgcatttctttttcttttcttttttcttttttgagacggagtcttgctctgttgcccaggctggagtgcagtggtgcaatctcagctcactgcaacctccccctcctgggttcatgcaattctcttgcctcagcctcccaagtagctgggactataggcacgcgccaccatgcctggctaatttttgtatttttagtagagatagggtttcaccatgccggccaggctggtctcaaactcctgacctcaagtgatctgcccgccttggcctcccaaagtgctgggattccaggcatgagcccccgcacccgccagactctgcatctctaaagtgctgggattccgggtgtgagcccccacgcccgccagactctgcatctctaaagcgctcccagggatgctgatgctgccatctgggggaccacgcttggagtactgcggccctggcaaaccatctcttccaggaagctgcatcttgctctgccttcctcccctgccagcagctcagccctgatcatctctcacctgaggcccttaaaagcctcccaatcagcctctctgcccccgacccccaggcctgcaccccgtcctctcccgcactgcagcccagcgctgtctaactgagagacctgggttacatttcagcatcccccatgtgattccctgctgtccacaccagcaagtctctgagtgcaacccgcagccacgtgcatcataatcagctgagctgctggtgaaggggtagattcctgggcctcacccctgacagatcctatcccagcccctgcgggaggggcccaggaatgcagccagttcaccagctgccctgccaaagcctggcaatctctgggcctagaggcttgagaacggtcaagcagctcgccctggctcccctgggagccaccctagcctggaacgctgcacaccagacaggggtggtagagctcctggccattcccaaatgccccacacccagcagcgcctggaatgtgctcatgcaggttcctcgtgacatggacacacccccttccccatcctacccgcatgtccccagcccaggcctcgttcccactcccccaggatgccccaaccctccaagggaacaaagagaatgctcttccctttctccagaagcccagcacccgggccacatagtcaagcgctttgtctttgaaacataaaaatagctatagaagggctccgttagctggcatcggccagagagagaacatttccatataattagagcttaccctttcatatggaaagttagacatttctctgtctaaggcgcctacgtagaatatgtaatttgaccttctttgggggaaattttggattgtctttgggatgataatataggaaatccctcgagggcttttaaaatgtaaagaacagaggtcccataaactaagtgaccccagaatgcaatttgggttttttaagtcgcctttttagagcttcctgtgtcctcccttccctggtcataactgtctgacagcagccacacaaacaagcttattaaaattgtggtttttttggccgggcgcggtggctcacgcctgtaatcccagcactttgggaggctgaggtggctggatcacctcacgacaggagttcgagaccagcctgaccaacgtggtgaaacctcgtctctactaaatacaaaaaattagccaggtgtggtggtatatgcctgtaatcccagctactcaggaggctgaggcaggagaatcacttgaacccaggaggcggaggttgcagtgagccaagatcgcaccactgtactctagcctaggcaacagagcaagactccatttcaaaaaaaaaaaaaaatgtgttttttaataaagtaagtagagtccgaggtggtggtgggctcttccacaggaccactgcctgagctttcacacctgaccttatcaattcaaagctgtgggcatccccggatacagataacccttgggggaggtggaaaattgttgctagactctagcctagaggtttttaacagcttgcacaactggccaaatcttacaagataaaaaaaggtaatgggaacacatctaaaacttatatgtgggtccctaaatccaactatgcaagtacagaggtgggtgtgtggagcagcacaggggacaaaagacgctgggccaccagaagggccaacgtgactgtcccctgagtgaacagaaacgcctctaacatgcgagcgaatggtgcagcccagccagcccgacctcacctggccatgctaggaggcagtgggcaagcggcaacgctgtggtgcccaggacgccggcaggcacagcgccacgtccacgggcaccgcccgttcccaccctgcaggacgccacagcatcagacgagacggcccgtgtgaagcgccgagaacagagtctggcttccgggagggctcaggaaatgccgagagctcggcagagacacccacgtggtgctggattccacgcacgaggaaccgacgggcagacgtggagctaaatgatggtcaacagctacgaagtgcctgtgctctagaaatggccaatttgatcatgtcacgggataaagtttcaaaatcaataaaaccgtgatgaaatgatcaggaataaacctgtccagaactgttcaagacctaaaggagatgcacgggctgaagaacaaggagcaaatctgaacgagggagaggtgtgtcttcctggacagttctcgggagaggaggagggcggtaaggacggggagaagaggccgcaggcttggagtccaggaggagaatgaactcctttggtcaggaggggcccactgaccaaaggtcctaggaagaaaagccaaaggaggtgaggtggggcaagggtgtttgcaaaggatagaaaagtctagaatggcagagtatggtgcttaagagtactatgtgacctaggccaagcgacttcactctgggtgcctcagtttgctctttaggatggggatgataacaacagcagcacccatctacagagatgccagtgcttgtcaccacgagaagcacctgaaatgcttggggaagaggggtggtacttactgtgtgtgtctccagatgactgagctagaccacccagaacacattacagggaggcagaagctgacaggagggcaggaagcactgtctccagggctgtcttgaaatcactgggctgactttgtaggtagtgagacgcccatcactggaggcatccgaaccaagcccagataaaacaaacatcagaaacatttttaactccgtttctctgagttctagcctctaaaaataccctccatgacacgctgtgtgctgccagaggcttggttttcgccctcttctccccaactcttagccacgtcccagtggtggcggggggacgggggtcccaagccactgcactgggttttggtttcactatgttgcccaggctggagtgcagtggtgcgatctcagcttactgcaacctccaccttccgggttcaagcaattctcctgtctcagccttcccaagtagctgggactacaggcgcacgccaccacacccagctaatttttgtatttttagtagagacggggattcaccatattggtcagactggttacaaactcctgacctcaggtgatccactcgcctcggcctcccaaagtgctgggattccaggcatgagccaccatgcccagcctgcactgggttttggactggctgtgttagcatcacctggggcaggggtgggtcacgttagaatgagtcctggctaggcccacagcaggcttttccacccgaatactggggccacagctcatgaatctgtgtgtatccatatcctgggctgggtcagctctccagggtggagatggttgggcaggcagcctctgggggcaagctcgggctcaggcctccccttgaccagcttcacagagacagacactgaggcagactgacctccaaactcccagctgagacgccagctccccacgtggggggcttacagctgatgcaaccggtggctcactaaacatacctcgacagcgtccattaccgcttccctgcaaacctcaagatcctaagcacccagcctaggtcaggggtccccaatcccagcaggtgttcctgcttcctgaagaccccccagcccaactcctccaacaaccatattcatctccaacccagtcccaccagcttccctcactctccttcccatcacactgcctgtggggagccccgtggtgcagggactttgccgctggccttgcgaacccacggcttggagcccctccttggcccactctccggggccctcttgggagcctcgctaaacagctgggcatggaaagaaccccaccctcaccacagatgggaacagacacagagagcctcagccccgcagtggtctcaggggcccactgaccaaaggtggccggaatcgcttccccgcctccacctgcagcccggcctctgccctggctggctactcatagcaggctgttgccatgggaacagcagagctgttgagctgtgacatcatggcaggggtgaggtcagggacagctgtgagccagccagggggcaagcgtgtaggttaggggatcaatcataaagatttggctcaagcagccgggagccatgggggcacctgaaggcactgtttaaggaggtgtgggtgaacaaggacagtgcaatgtacaaatgctcgtggccataccaggcagaggacatctttttgtccccagctggctgcatggagacctcccagggtgtcattctctctgagctgtcaggccattaaggaggtacacttcaaggtcagggttcctgacaacgcctgccatcccttctcctgtagggacagcatctgttcacgcttctaaacagctccagaaagccatcgttaaactgaaacccactggaggcgggggaagaaagaatcccgtcaaccacctgcccacacaggaggagaagccacacgtacttggcctcgtttgagggctagttccccacagacagtttgatcagaaggatgggcgagggaagctggcagggcgaggctggggatgaacatgggacactgggggagtctggccggtgcagggggtttccaggaagcaggagtagctgctggaaatgggggcccctgacctagtctgggtggttggcatcttaaggtctgtggtaaagtgatgactggcattgtcaagatatgttttttgtttgttttttagacagtcttgctctgttgcccaggctggagtacggtggcgcaatctcggctcactgcaacctctgcctcccgggttcagggattctagtgcctcagctttctgagtagctgggactacaggtgcatgccaccatgcccagctaatttatgtgtgtgtgtgtgtgttttagcagagacggggttttaccatgttggctaggcgggtcttgaactcctgacctcaagcgattcccctgcctcgacctcccaaagtgctaggattataggcacgagccaccgcccccagcccaagatatgttttagtaagccgccagttggatcatctgtaagcaactcactagaagcttccagcatcctccacaaatttgacaactgagaaatgtggctgggaaatcatgatttgggtccgaagaagtgaaagcaacaatcctcaggttgttgtttcttgagagaagaaggtaaacagcaggaattcggctgaggtgtccaaatctcggggaggatgaattctcaggagagctgaacctgagacaaagccctttgtcctgggctggaaggaccctggaaaggttatctggtccctgactcagggaagggaggcattctccctgcaggaatgttctcgatcacagtccaccaccacccccctacccccgcccacttttggagtccatcttcgcagcccttgatgattcattttatgtcagcttgacgggctaagggatgctcagatagctgggaaaacgtgatttctgggtggctctgggaagagactggcatctgaaccgggggactgagtaagaagatccctcctcgccaggtggggcaccatcactcaatctgttgaaagcccggacagaacaaagagacagaggcagaggcaggcaaaccctccctctgcaagagctgggacatccaggctgggcgcggtggctcacgcctgtaatcccagcactttgggaggccgaggcaggtggatcacctgagctcaagagtttgagaccaggccaacatggtgaaaccccatctctactaaaaatacaaaaatgacccgggcgtggtggcgcacacctacagtcccagctactcaggaggctaaggcaggagaatcgcttgaaccagggaagtgaaggttgcagtgagccgaaatcgcaccactgaactccaacctgagcaacaaagtgagactccatctcaaaaaaaaaaagagagagagctgggacatccaccttctttctgccttggacctcagagctcctgggcctcaggcctttgggctccaggacttaccccagtggccaccccgcttctcaggctttgagactcaggctgcattactgcaccagtgaccctgctgctccagctcacagacagcagattccaggacctcccagccttcatacttgcatgagtcaattcccacataaatcccatcttacgcagctggatggagcctattggttctgtttctctgggaaaccctaatacggacccatagatacaaaatcttctatatgcttcttcctcggagaagatccctacatcttttatcctctcagcgtggccttgacgcccattctaaagcaaggggagaggttctagtgaggaggaaatagcatggggaccaacaggatggcacgctaggccttcgatggcccttgcagaatgtccagcacgactgccaagtgctcgtcaggtcttttctggactgaggacatctctctcaagcctgggctctcctgacgctgccttggcaagctctagaaggcagccccatcctctggattaatccgccctgctaaatgttctctctggcatgggattcactactggcctaaggccaactcagccttgagagtctgggtccatactattgttgactgcaattagaaccacatattagcaaatgctagcttttaaaaattacaggtacaggcagacctcagacatactgcgggttgagttcccacagaatcataataaagtgaatattgaaataaagtgagtcacatgactcttttggtttcccaaaccaatatatattcccaaatataaatgttatgtttacattgtacagtagcccagtaagtgtgcaataacattatgtcttatcaatgcacataccttaatttacaaatactttattggccggggcagtggctcacgcctgtcatcccagcactttaggaagccaaggcaggtagatggcttgaccccaggagtttcagaccagccaggcaacacagtgagatcctacctctataaaaaactaaaaatagccaggcatagtggtgcgtacctgcagtcccagctactcaggaggctgaggcaggaggatggcttaagcccagaagttcgaggctgcagtgagctaagatcatgccactgcactccagcctgagtgacagagcaaggtcctgcctcaaaaaaaagaaaaacccaaaacttgaagaaataaaaataaaaataaaaatattttattgcttgaaaatgctaacaatcatctcgacctagtgagtccagtctttttgctggtggagggtcttgcctccatgttgatggctgctgactgatcagggtggtggttgctgaagattggggttggctgtggcaatttcttttttttccttttcttttttatttttattattttttttgagacagagtctcgctctgttgcccaggctggagtacagtggtgcgatctcggctcactgcaacctccatctcccgggttcacgcgattcttgtgcctcagcctcccgagtagctgggattacaggcctgcgccaccacacctggctaatttttgtatttttggtagagacggggttttaccatgttggccaggctggtcttgaactcctgacctcaggtgatccccccgcctcagcctcccaaagtgctgggattacaggcgtgagccaccgtgtctggccggcaggcccactttcttattatttgtgtgatcacctggagtagcattttttaatttccttcacattcacaacttggctgtttggcacaaaaggcctagctgtcagcctaccttggctttcaacacgccttcctcactaagcttaatcactcctagcttttgatttaaagtaagagacgtctcgctctgtctgtcaagcttgaatgcaatggtgtgatctcggctcactgcagcctagaactctcaggctcaagtgatcctcccgcctcagcctcctgagtagctaggactacaggcatgtgccaccacacccagctaagttctttaattttttgtggagatggggtcttgtcgtgttgcccaggctggtctcgaactcctggcctcaaggtgatcctcccgcctcagcctcccaaagtgctggaattacaggcatgagtccccacgcccagtcccattatagggtaattaattggcctaatttcaatattgttgtgtctcaggaaagagggaggcctaggcagagagagagagaccagaagccgccagtcggccagttggtggagtcgtctgaacacagacaacatggatcaattaactttgccatctcatgtgggcacagttcatggtgccccaaaacaattacaacagtaacgccaaagaccactgatcacagatcaccataacaggtatgataataatgaaaaagtttgaaatattgcaagaattattaaaatgggacacaaacacatgaagtgaacacgtgatgtgagaaaaaaatggcaccgatagactcagagttgagccagccgtgatattcaattcatgaaaacgcagtatctgcagagcacaatatagcgaagtccagtaaaacaggtgcacccatggaattcatgttcattctagagcaactggaaaatacacccttgccaaagaaagtctaatgtcccctcatgtgtccaaacgttctggccaggtgtggtggctcacgtctgtagtcccggcactctgggaggccgaggtgggaggatcacttgagctcaggagtttgagaccggcctgaacaacatggcgaaaccccatctgtactaaaaatacaaaaacttagctgggcatagtggtgtgtgtctgtggtcccagctacttgggaggctgaggtgggaggattgcttcagcccagggagcagaggttgcagcgagtggagatcgcaccactgcactccagcctgggtgacaaagcgagacactgtctcaaaaacaaaaaagaaaagaaaaagctataccatgtgatgtctgcagagcatctgatgctgtgatttatttaaccacgcccctgctactgtatatataggtgtttctaacgtttccgtaagataagcaagacggagatgaatatccttcagctaaatacttccatgtgtcctaaattatttctctcagaaaaactccaagatatagggctgcctgatcaaagggaagacttatttttaaagtccttgatcactgctgccaaaatgcccttccatgcctctaaactactcaaattaaggcaaaatatacctgtcaccaaggccttctgaggacaacatgcctcttggccaaaaggagcaaagtgatgttaaatccaaagctgtgaaatctaatcttcttcccagagactcgagccaggatcattccccttggattcctggcactgccactctgtgggtgaccttgggcaagtcatcggctgctccccatccaaacacctgcctcacctcccccgcagagcctttgtaaataaggaagatgtgaagtcctttgtgctgaaaagccctcgacagtatttttatgcatttgcctggttgttttatccctgctttccagaactagtgcacagaagggaagaccaccacagactgttcctttattccctgccctggagccaactgggccaagtggacaagacctcacaagggagagtcaggccagcaatgctcatcccagctccaccctgaccccattcctcttggcatactcagtttctgcctgggctgggcaggctggtccttggcttctggggtcagctcaggattgaggatgaaatgagaggagcacccccagaagagaaagtgctgaaccagaagcccaggagagtcatgtgtgtgcgtgtccatctaagcctttgccccaaaacagtaggtaggtcaggtgcagtggctcatgcctgaaatcttagcactttgggaggctgagatgagaggatcacttgaacccaggagttcgagaccagactgggcaacatagcaagatctggtttctaaacacaaaagtaattttaaaaattagccaagcgtggtggcacacacctgcaatcccagctactcgggaggctgaagtgggaggactgcttgagcccaggtggttaaagctacagtgagctaggatcacgccactgcactccagcctgggcgacagagcaagaccctcatctctttaaaaaaaaaaaagataaatcaaggagcccacctgtccccagagctctcctgccacagtgtcagcacatgccttctgagcataataatccccccggacctgaagcccacgaatgacccccccacccagtcctttctccctcatgtcacgtcaagtgctgtgtcactgaagcaccccgtaccccatcacctggtgccagaggcctggccatggtgcagctggacccccagctgcccgtgtgaccgtgggcaaacggattatgtcaccttcccagtgttagagagacccagtggtgacaaacgtcctctgtacctagggtcaccgtaaggctcgggtctcatcgggtttctgtacatgctctagacgtgcagcgtcatgctaccgacactccaagtagccggccttgctggcactcctggctttctcccttattccaccccccgccccccacaacattacgggacccaggccgggcactgtgacccaggcagtgtggattctcaactagctggagcaaacagggaactagggcacagaaaaggcagagtcacacaaccggaggcggagtgtccgtctagtactgggacccggtgtgatgctttaaggaacacacctgccgtccttatgtgagctgggctgggcctttatttttaatggacacataattgtaatatttatggcatatatagtgatgtttagatacatacaatgtatagtgatcagatcagggtaattagcacagccatcatctcaagcatttctttctttgtggtaggaacattcaatgtcctccgagctatctgaaactatacaatatacttttgttaatttctttttcttttttttttttttgagacacggagtctcgctctgtagcccaggctagagtgtggtggcgtgatctcggctcgctgcaacctccacctcccgggttcaagcgattctcctgcctcagcctcctgagtaactgggatcacaggtacacaccaccaggcctggctaatttttatatttttagtagagacaaggtttcaccattttggccaggctggtctcaaactcctggcctcaggtgatccgcccaccttggcctcccaaagtgttgggattaaaggtgtgggccaccgcctggcctattgttaattacattaatccaacagtgacatggaacactataactcattcctcctatctagctgtaattttgtatcctttaacaaatctctccctctctcctcccccaacccttcccagactctagtattctctgttctacttttgacttcgatgagatcaacttttcttttttttagctttcccatatgagtgagaacatgccatgtttaactttctgttcctggcttatttcacttaacgtcttccagttccattcatgttgctgcaaatgacaagatttcattctgttttatggctgagtagtatttcattgtgtagatgtaccaacatccacaatgaaatactatttcattctttagccattcatctgttgttggacactgaggttgattccatatcttggctattgtgaacagtgctgccaggaccatgggggtgcaggtgtctctctgatgcactgattccctttcctttggataaatgcccagtcgtgggactgctggatcatatggccgttctatttgtagttttttgaggaacctccaccatagtgactgtactactttccattcccacccaccgcatatacgagttcccttttctccccttccttgcctgagctgggcctttctgatcatctgtccccgtcccttgaactcttgatctggactgagggaagaatggtggcagaggcgagctggggagcagggaggaaccaggctgtcgcaggagaaacagaatattgcgagccagccgtgtggaatggaaaggggaagctggtcttcctgccccacactcctgcctttcttccttaagggctccttggacagagactgcaggtttctcagaagcactgtccaggatctcaacattctagaagggtctaggacaaactaactaactattgagcccctccagtgcttttgttgtttttgttttttgttttttgttttttgagacagagtctcactctgtcacccacgctggagtgcagtggcgtgatctcagctcactgcaacctccgcctgggttcaagtgattctcctgcctcagcctcccgagtagctgggattacaggtacccgccaccatgcccagctaattttaaaaatatttttagtagagatggggtttcgccatgttggccaggcttgtttcaaattcctgacctcaagtgatccgcccaccttggcctccaaaagtgctgagattacaggcatgagccaccccacctggcctccatttgactcactcatcaaaaatttaatcttggcagggtgtggtggctcacgcctataatcccaatactttgggaggccatggcgggtggatcacttgaggtcaggagttcaagaccagccaggccaacatggtgaaaccctatctctactaaaaacacaccaaaaaaaaaaaaaaaaaaattgaactgggcatggtggcacacgcctgaaatcccagctactggggaggctgaggcaggagaattgcttgaagccgggagacagaggatgcagtgagccaagattgtgccactgcactccagcctggacaacagagtgagactctgtctcaaaaaaaaaatatgaatctcccatggcaccacactgaagagtctgatcttgcttttacagaagaggaaaccaaggctcagagaggcacacagtcgggattcagaaccagtcccacttgactccaaagcccaggctcttttctccaatacttttcatgtcgcctcttttctctgaaatgtccatttcctcattctgtccttggttaagcagcagctgttggcgggtgctctgtccaggcctccgctaccatgacgagccttggcaaagcctgccccactgccagtttgctttgccacgtctgtgtcaggaaagctcaatcaatctctcccgattacagatcagaaagggccaaataaactctcaacccaagccagattctgtccctgaagatgcagtaagggggtctcggtacccacagaacatcccaccacagaaagccaggctccagcctgaaagtccatcttccctgctctagcccacccgtgcgatgaagagcacagaagaggcgggtgaaggcattgcatcttcagcatcggcttggagaatgacaccctgcaggttccacttcttcccaggccacctgcttgcttctggaaagcagggaacaggcaatccggggagagaggagccagccacacaaggactgggaagcccagacctgtgccatcagcctgcgatgacttaggctggggatccgaaaaggtttctatgaacagccagctggtaagtaatttagactttgaggcccatacagtccttgatcaccgccattcaactctgttgttatagcacaaaagccacgtgggtttggccttaccagtgggcgtggctgtgttccaataaaactttatttgcactaggccaggcaccgtggcacaagcctgtaatcccagtactttgggaggccgaggcgggcagatcacctgaggttgggagttccagaccagcctggccaacatagtgaaaccctgtctctactaaaaatacaaaaattagccgggtgtggtggcaaaaagaaaaaaaaatatttacaacaacaggccatcagcccagcagtgggtctagtttgccaaccgctggaaaaagccaacaacattttgggaggccgactgccggctacaggacctcgccataccaacaagggctgagacccgcggctctgcagggctctaacaacagcgtttgacctgagtctatctggggaaacatcacgtgaacccacgttgaggccctactctggaagctgcaaaattagagatgatggctgtgcggctctgtgaatgtactcaaaccgctgaactgtgcactttagaggagtgacctcatggtatgtgaattacatctcaataaagcagctcaaaagcaggctgggtgcagtggttcacgcttgtaatcccagtgctttgggaggccgaggtgggaagacggcttgagcccaggcgttcaagaccagactgggcaacgtggcaaaacctcgtctcgacaaaaaatgtaaaaattagctgggtgtgctggtatggtcccatagttccagctacttgagaagctgaggtaggaggactgcttaagcccaggaggctgaggctgcagtgagccatgatcatgccactttactccagcctgggtgacagagcaagaacctgtctcagaaaaacaacaacaaaaaaaaacaaaaaacataggccgggcacagtggctcacacctgtaatcccagctactctggaggctgaggcaggagaattgcttaaacccaggaggcggaggttgcagcgaaccaagattgcaccactgcactccagcctgggccacggagcgaaactctgtctcggggaaaaaaaaaaaaaaaaaaaaattctaggcaatggatacaatcaggatgatttttcttgctttttgcttaagtgtcttttccatgattaacacatatagttgtgtaattattttaaagttagaaggcatttgggacgtgaatggagagacagagaagttttctttatgatggagagaggcggaagggacggcttcctctgcgagggtgcaagggctgacctgggagagcaggcagctgcgactaacgctggctggggcctgcctgacttccccttgagtcctcagaggcacaggttataacccaatgttttattgcttcttgagaacattattggcattcatctgccttcgaaattttggctattcatttatttatttatttatttatttatttatttatttgagatggagtctcgctctgtctcccaggctggatggagtacggtggcccgatctcggctcactgcaacctccacctcctgggttcaagtgattctcctgcctcagcctcttgaatagctgggattacaggcacccgccaccatgcccggctaatttttgtatttttagtagagatggggtttcatgatgttggccaggctggtctcgaactcctgacctcaggtgatccacccaccttggcctcccaaagcactgggattacagggatgagctactgcacccagccaagctgttttttttttctttatagacagagtcttgctctgtcccccaggctggtacaaccatagctcactgcagcctcaaactcctgggctccagtgatcctctcacttcagcctcccgagtaggtgggactacaggcacgtgccaccacccctggctaatttttaaaattttaatttattttatgtagagatgaggtcttgctatgttgcctaggctgatctggaactcctgggctcaagtgatcctcccgcctcagcctcccaaagtgctgggattacaggtgtaagccaccgcgcctggccagtctgggctttttctttttttttttttgagacggagtcttgctctgttgcccaggctggcatgcagtggcacgatctcggctcactgcaacctccgcctcccgggttcaagtgattctcctgcctcagcctactgagtagctgggattacaggtgcccgccaccacgcccagctaatttttgtatttttagtagagatggggtttcatgatgttggccaggctggtctcaaactcctgacctcaggtgatccacccacctcagcctcccaaagtgctgggattacaggcgtgagtcactgcaaccggcccagtctgggcttttgaaagtactgtgctctgaacatttttctaggtcataaacacaaatctgtaatatcatttgaaatgtctgctcactctgttgcggcagggagaaagattaattgatttagcttatctccagcagacaggcaaacctcatgaacaaggccagcctcaggagctcctctccctcctcagtggctccatccgtcacctgtagagcttcagcccagctccacagcctagaccattcatccccaagccagtatcagtctgaatcagcaccattctgttgatgtacctccttttaaaagccgtctctctctctttttttcttctttttttttttgagacagagtctcactctgtcacccaggcaggagtgcagtggtgcgatgtcggctcactgcaacctctgcttcccaggttcaagcgattctcatgcctcagcctcccgagtagctgggattacaggcgtgcaccaccacgcccagctaatttttttatttttagtagacatggagtttcaccatgttggcaaggctggtcttgaactcccgacctcaggcgatccacatgcctcggcctccccaagtgctgggattccaggcatgattccaccgtgcccggcctaaaaaccatctcttcttttactctgctatttcctagccagctaaccctgagcaggttccttagtgggcctgtgcctccgttggatcgtctgtacaatggggatgaggatagggaaggaaatgggttgacactagtgaagagcaagaacatacctccaagcccttggcacctctgccagctgttattgttgccatagtcattatcaccatgtcatgattcacctccctggctgctcccaggcctccctcagggcggggtggggaggaacaagaacacaaagacagggagagccagggtttgatgcagaaagagctggtgtcccccactagctccgagagcttcctgggaggcaggaaattcgcctctcctttttggaggtgtggaagtgggggcagagagaggccacctgtcccggatcgctctgctggactcaatctggggccagcatttgacccccgctcaccctgtttgctatgaatgtcagttcccctcgctactgctggctcccttccccctcaatgctccgtttcctgttccctccaaggccccgttacacaatttccactgtctgctgaagttctagctcaaatccctctcgccgagactttctggtcaccagattccagcagaactcaacagagacctctacccgcctgagctcctgaccaggttagagggcatctggctcccaggcactgggtcaagctccagaggcatctcctgtgtctgcccgcgacccatggccccgctcagggcctgccttccatctcctgggtcttccccagtgcaggtgggagctctgctcccctggtaactgcgagcctctcaacaccaccttcctcctcagtgtcatccccctcctgtctgccccctctcccccagtgcaggggccataaagccttccccggagtcccactgccaggtcccactgccgggcctccaggctttgctgctccacctgggctcaagcctggccatactttgttctaatgactctgtccccctgtggtacactctctaccacagccaccctgggctccccatacccaccccaggacctttcctcggggcttatcttagctctgataagatccacccctcagggcccacaatctcaacagtgtcctaacctcggtaagagtctctagcaagaggtgcagcctgcaagatgatcttcgcattcctgcgctcacttccttgaagatgggcaccatggctttggagtttgagaccagcctggccgacagggtgaaaccccgtctctactaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaaaaaatacaaaaattagctgggcatggcagcacacacctgtaatcccagctactcgggaggctgaggcaggagaattgcttgaacccgggaggcggaggttgcagtgagccaagatcgcaccactgcattccagcctgggcgacagagcaaaactccgtctcagaaaactaaataattccttgacacacttgccatagtatttctgtgtacggtaggcacccaaattctattgtaaaacaaaatataaaaacacttaagtgaataaattctgtaagaagcaggtatctaagacatagacaccaggcccttcctaactggtgaggtctggagttccctcaggccatgtgtggtccagctgtgatcagagtttgagatcaaagagcagctgccgtctaccaaggacgtcttccccatggaagacaaccacagaacctcccaggtctttggagccatccctgagaccagctaggaggccaaaggacactgatggcatcctttccccagagctggttacaggtctgcctcggactcccctcgtggtggtagtgtctgagcggatcctggctgcccagggcggccgagtgcagaatgagggtggaagaggagagaaaggcaagatcgttaccatcgctcagctccgagactaggcagatactcacaagaaacagaagactcgaaacctataaaaagactccttttaaatggcagtgacttgacgtttggagggccacaggcacctttgagaagttggcggctgccactgtccacaaaaaaaacacgtacgcgtgcacacacaaacacacacacacacacacacacacacacacacacaacttcacttacagtttccgggcttgtgaccacccccaaacccgccaggcctatctctggctgggtgttcacacactctgggttaggacccctcttttataaagactgttcctcaatttgcttcttagcgtaaacacactctcaacctgacttgctggggctccggaagctttccctgggctccagtctgacctggctgactggggagtagctcagccctcagttgtaaggtgggaatcatcggggcggggtctctgtgcccttccctctgccgctgcacagccacgtcccagcaaatgcacgagggcaccagggcgtcagggcacaggctgcaggggtccaggcaggtgggccctgggaggtcctggggacaccagcttcatcctgcctgccactctgagacatccatgctcctgaccatctctccattgggaagtctgggtctgcccgccttccctcctcccagcaatctcagggcagctcatctgcctgcttactccaccccccgacactgaggtggtcagcctccacactttctgttcagacccacgggcaacaaaaacaaaaccttggccaagcactcacaatatcagatattcattaaaaaagtatatataggccgggcaccgtggctcacatctgtaatcccagcactttgggaggccaaggtgggcagatcacttgagctcaggagttcgagaccagcctgggcaacatggcgaaaccccatctctacaaaaaattaaaaaaattagctgggcgtggtggctgcttgggagactgaggtgggagaatcgcttgggccaggaaattgaagctgcagtgatctgtgattgcaccactgcactccagcctgggtgacacagcaagactccgtctcaaaaaaaaaaaaaaaaattatatttggagtacaactctgaatccatatgctaactattcataacattcttagcaccgaggctgtactgggcacccctccggagacgactggtctatgccaactttggcgggcggcagcagcacctggagagtcctgaaactccagtgccacccccaggcccgctccagcacgcggagttaggcggctgccttctaccaggctccctgggcaacgcccgctgtcattccacagccagaacatctttggtggctgcgtgggtcccgggatggaatgcagatgtcacatgacaagccagagccgtgacatttggccccaatctccttgtgggtccccctgaatccccaggctcctctttggcctactctgtacccagaactctcacctttcctggggcagttggtcccttggcttagaacacctgtgcacaccccaccctgctgccgctaaatgaccaggggttacggtccccagtgccgtcctccagatgcggcttcttcaccctcccttaccttgatttcttcactctgccctcccctcttgaaaaagaccatctgctgggtgcggtggctcaagcctgtaatctcaacactttgggaggccgaggtgggcggatcacgaggtcaggagatcgagaccatcccggctaacacggtgaaaccccgtctctaataaaaattcaaaaaaattagccgggcatggtggcgggcacctgtagtcccagctactcgggaggctgaggcaggagaatggcgtgaacccgggaggcggagcttgcagtgagccaagatagcgccactgcactccagcctggagacagagtgagactccatctcgaaaaaaaagaaaaagaaaagaagaccatcctagccatgcagccacttgccctccgtccctggtttgtgagcctgtgcgtgcaccgggggacagagagagtgtccagggcatgcacccctcctgcccctgccactgccacgtctgcctgtctttgcttccttcttatctcctcctccctgctgttgcatccctcctcgcagctgcctgggaagcctcgggcagacctctttgttgtttccgaacccaagacgttcacccctacacacgacccccactgcatcgagtcagtggttctgcatcaggactggagacggctgcccgcgcctctcagtctcccaggagtcatctatgccctgttctccatgtgctcagatgtcgccacagagtctgaacctctcagcccacaccagtggcatctacctagcaacctggctgcgacagcagggaggagggaggcagtacccaagcccacctgcagctcacaaacgacaggccaggactgcgtacgtggctctgcacccccagaagggtgcaaataggggaggcccgagaggctctgaggctggcactgtcctcagatcccagatagggagaaacgtgtgttgtccagagagctccttccagcacctgccatacctccaggctgtgcacagctctccctgctcttccagtccccctgccttgggagctgccagtaattcaggggtcagtgactcccctgacagatcctgtccctccaaggacgctgttcaaaaccaagccgaagagcctcagttctccccacagctccctcctcaacctaccatggggccttctatcctcacatcttgcaaatgcatttcacattgtcacatgattactcctgaattttggttatttcgaaagtttatctgttgttaattatttaccgaaaccacactgagtggactgactttataccacacctgggcagttgaggaggggaggcctgctcaccacgccgggcagcaggaacccccttccacaccgcctggtgccaagatgtaccaccccctgcatcccccaccacagggacaatgtcttgcttctcccttacatccccgggggcagaggcagccactccataattgcttgttgaaacacagacaagcccaatatgaaaatcaagatgaacaaaactgacaatacagatcgatcacatacttcgcacaacgagttgccaacagtttctttaaaaagcgccacgccgccccctcgcatggaaggcctgacccagctcacatgaatctgatgctgtgttgcttttcctgagcacgtgtcctgaagacagagccatttttgactgcgtgctgtgtgttttctggggtggcccctactatctgtctggtccctgtcactgtgtcccccaggaaccaggtcacccttggctgttcaccccagaaaatagcagttgttccccctcttggttgtggacccctctctagctggagctggagctcctcgggggatttgcagaggacagtttctggaggtgggaacatgtgaggaagatgtcatcgcagaggtcttctaggataatgtgtggccttaggtactgccacccaagccagaggagaggttttattctctgcatccagagagctcctggctttacccttgagtccagaaacgggcccaagcagcccgagtctgccaagtagctcagctggctaagtggctccaggcatgggactgcctgaatggtgagcccaaagctaatttccagccagatccctgtagctgtgcaggctggcagtagatgtgaaggatttcactgggtgagagggagccgggccagcagcgcatttgaacagtactgtaactgagacacaaaatgcttcccgtttgtgctggccttgctggaaaggacaaggacctggggccttccaggaagaaatcaggtcacctcttaccatcccttatcctaaacatcaccacctcatcatgaattatctttgccgaccacagttccggtcctaccaactgcaagagctgctagggagatacctcccagaaatcctcagccgggcagacagaaatctgactgtttcttaagccaattgcctcttgtagacaccaagccatttaacaaggctgcatgcagccaagagtaaaaggagccagcttgccacataacaagccagcctttattaacctccactgtaccccctttctgagacccctgggtcacagccctggttaaatcacctgtgggccttttaaaactgcaaaagccgaagtctgagcaagaccctctgtatctgcaaagggacctagacctgagcaatctttaagaatcttccaggcaattctgctctgagccagaatggggaaccattgctgagaaagtcacaaacctgcatcgcttcgaggagaatcgaacactggagaatagacaggccgctgtcgtccctgtgggatttgttccgggaccctaccctgggatgtcctgggttgtttatcccaagttggttgagcacggaaagggtgactgggaataagagaaggcagcctggtgtatgggctgaattacgtcccccctcaaatgcacatctagtcagatcctatgaatatgaccttatttggaaatagagtatttgttgatctatcaagatgaagtcatactggattagggtgggccctaaatccaatggctgctgtccttagaagaacagggcaatttggccgggcgcggtggctcacgcctataatcccagcactttgggaggctgaggcaggcggatcacctgaggccaggagttcgagaccagcctggccaacatggcgaattcctgtctctactaaaaatacaaaaaattagccgggtgtggtggcaggtgcctgtaaccccagctacttgggaggctgaggcaggagaattgctcgaacccaggaggcggaggctgcagcgagccgagattgcgccattgcactccagcctgctctccaaaaaaaaagaacagggaaatttggacacagagacacacgagagaaggccatgtgaagacaggcggaaatggaagtgatgtgttccttgaaaatggaaccaagcaacatcaaggagagaggcctggaagagattctccctcacagcccccagaaggaactggctctgtggacaccttttcagacttctggcctcctgagctacagagaatcgattcctgttcttttaagccctcccatttgtggtagtttgtcacagcggccacaggaagcgaatgccctgagctctgcagtgcaactctggcatctgactgggcctctgagccgggatggggtgaaaagttttagctacaggatgattttgatgcaaagatttagacacaaatgccaggcaacccagaagaggagagtgctgcgctgagcatgaaggaggcgggaggcacgcactgcagccctccaccctctgccatcctggatccacaccccacgcagaaacagctcccagctcagtggccgccttaacttatgccaagcaaggacagagtggctgcctggacattctcccacacagctgaggagtgtgtgtgtggggcggggtgggggggggggcgggagggggaggggtcccaaggcccaactcctacaaatccaactcccaggtccttttatccacagcctccttctgggccttggctacatcctgccccagcacgtgctggtgagccaaggagcctggacaggcctgcactcctcgtggacccccagagaaaggcccattatggctccctcatcaaaggaacctctccttcacccacaaatcttgctgagcaccaaggctaaactggagaaaagacctcatttcccccaaactgggttttgtggaaactgacacaggcacacaccaagccttccgcccaggtggcctgagccacctgagacctgtgatctcaatagattggtgcaactgaaaacttccccagctgggcacgcagctcctagggctaaccggggtggggcaagaagccgtgggcggggtatgggaagggcgtggctgacagcaggagaaacagaaagtcccacctccactctgggcaggtgagggggcccccgccttgctccatctgccctggacaggtcactcgactgagactcagacataagaaggaaggagggcagggggctccgagaccacctgccgtgtagccagacttgccccaggaaaaccatgctgaccagcaccagggctgcagaggcttgaggtgcaggaccagggtggaaacttcgagccagcgggttcctcccatttctgctggtcctccccctccatggatcagaacaaataactgggcccctcctgcctccctccatggcgcctgtcttttgggggctaggagtccggaggtcatgggtatttgctggggaatctgagcagcagcacagtcccacgtgccgggtccggtcaccaaagtctccagcttttgtggacgtcccgaaaaagcggaacattcgggggtcccggtccctgcccagccagtttgcagggcctcctgggcagggcgcaagcaaggagccacgccaggagacgccaccggctttttcacctgcccctctgggcctgtggaacctgcctcgggtagggcgggcttccatcccaccctggcttgatcggggagcccccaaatggggctggtgggagaagccccagcagagaagcccttccccacccagccccaagcccagagaagcccaactcccaccttatctgcgaaagtttcttcctggggtccccagtcctccagccccccgcccccacgccgtgtcccccacgctccccgcccccagcgctggcatcccagggcgcgccgcctgccaaaagccaaactggctccctttcctggggctggagctgcggcggaatttcggtggaattttgaggttgagacgcatctcggcaaagagagggaaagaaagggagaggagggaggggggaaagaaagtcggctctgggcgtccacttgcaggattcgagaaggcgccgagggaccaggaggcgggcgctggggtccctcggccagcggcgggcgggcggggcgtctgcgaaccctcggggtcgcgggggaggtggggccccgcgcgggggctggggtcgccgctccttacctacatctgcattgcaaaacgcctgttgcgggtgcaccggggagcagctgcaggcgtcggccgggcgaagcagcgtcgccagcagcaggaggccgagcgccagccgcagggtgcgggccgcggcgcccatggcgggccggggggctgggcgggcgggggccgccgctggggggtccgggcgctgctcgcggcggcgggctgggggcgcgggcgggggctgagccggggccgaggcgggcccctcccgcgcggctcaccctcctcacctgccccgctcggccgcgcaaactttctctcctctttgtctcgggggcgcgaggggaggggcgcggggcgcaattcgccgggcggggcggcggggtggggggcggcgggcgagcggcgctgcggttctcggcggccgcgctgccttctacggatgtgtttgctgcgggcttgggccgggccgcagttttattgcgctcggaggattttctgctcctcctcccggtggctggcggccaatgcaggctctgggcgctcccagcagccccctcctccccctccgcccgcgcctccccccagcccgcgcttttgttgtgcccggcctggcacgtcgggggcttcccgcaccacctggcgcccgcgacccgcacccgcgcgggggtccccggacgcccccagccccccgaccccggtccccgctgcgtggccttctgcgcccggggtccctgactcagcgcgggggactcgcgccccgttcttccaggacaccaggcgacccacccgctaccctttccccttcagctcgactctggagggctacgctgctccgtcccccgccaccccggggtcccttcgagcccagcctcggggcgagccaaggggtgtcctttggagcaggggccgttccctgtcgccacctccccgtttctgtgggcgggtggcctattgagaaactgacaggatccctttttcaaatggaggccttagaattttaagtgcgcctggccagtttagttggggggtggggggtgtggttactgtgaacaaaacaggattttatataaactggccatatttttgaccagccaacaagagacgggggtgggcccaggcgcccaggagccagtaggatcgcagcagaggcattggctgggttccgctcacagtttcctctcttagtccacaaatgtgggagccgaaggacttttcccaaaacagttttgtgttccaggaaagacccaggcatatgaagggatgaacatgtgtagggtggtgaggcgggcttcctggctgtgaacctgcctgtgcccggctgtgggcacccaccctgtacatttggtgtgtgccccgtggggctccatggacactgctgcactcaggtcagcactccagccctcaggtcagcattccagagtgtttgcagtccagctagggagagggaagcccaggaaaatgacacaggaagaatcagggcgggcacggtggcttgcgcctgtaatcccagcactttgggaggccgagacaggaggatcacttgaggccaggagtttgagaccagcctggctagcatttagtagagacagtgaaaccccgtctctactaaaaatacaaaaaattagccgggcttggtggtgggcgcctgtagtcccagctactcgggaggctgaggcaggagaatggcatgaacccaggaggcggagcttgcagtgagccgagatcatgccactgcactccagcctgggggacagagcgagactccatctcaaaagaaaaaaaaaaaaaaaaaaagcccgggtgcagtggctcatgcctgtaatcccagcactttgggaggctgaggtgggcgaatcacgaggtcaggagttcgagaccagcctggcggctaacacggtgaaaccccgtctctattaaaaacacaagaaattagccgggcgtggtggcgcgcgcctgtagtcccagctactcaggaggctgaggcaggagaatcgcttgaacccgagaggcggaggttgcagtgagccgagattgcgccactgcactccagcctgggcgacagagaaagactcttgtttttttttgttttttttttttttttttttaaaaagaattgcccactaaattgtgcggtgctgacttgaggtatgaaactttggaaaatagtgaaagaatggaaaaacagcttctttctgtttgtgtatgttttgtaacagacagttctgagaaaagttaaataagcaatgccgttatttttagcaccctgacaaatccaaagtcacttttttggtttttgttagcgtgaaatagagttgggtcgttcacaaaatgatgtttgaagctaacgtttaaaagtacagttaattcagaaaattgttatgtgctggctgccttcagccatttcatcgttttctttccttctttttggttacagggggaacaaaatgctgttgaacttgtgtttcaatttgtcagttcatgatagaaacaggtagcataggggctctcggtcttttagacaagctctacatataagtgatcaggtacatgttagggtgataaataccttagagcagttgtggtgctgacagccaagggggtggggccaatgtgggatgtacctgggaggaaaggggggcctgggctccagggttggggggcgtgagactggaacttccaacccaaggcctcgcacctgtatcctggactgccctccccgaagtcatccccaccagcacacaaacaggctggaattgctcccaggaaaagtgaagcagaaatcttgccaggtgcagtggctcacgcttgtaatcccaacactttgggaaactaaggtgggaggatcacttgaggccaggagtttgagaccagcctgaggaacatactgagaccccatctctacaaaaaaaaaattagctgggcgtgatggctcacacttgtagtcccagctacagggaagctgcggtgggaggatcgcttgagcctggggaagttgagtctgcagtgagccgagatcacaccactgcactccagccttggtgacagagtgagaccctgtctcaaaaaaaaaaaaaaaaatctctcccctcaattcccccaccagagagtactctacttttctgttccctctaccattatctcctccaaacaggtctctaaaccagaagtttccagctttcttttcctcccttttctcttggttctctctctctccctcctccctccatccatcaacaaatactcatttgagtatctgctgtagcctggacaccgtcctaagagtgagacattcagcgtctacagaacagaggaacatccctggaacagcaggtggaaacacgcaaggccccaaggttggacgatgctggacctggtggagcccatggtgtggcgaggagtgagaggaaggagggctgaggcaggaggccaggagcaggggctgggaggggacacggcggagggcagccaggctaccgggaggatgtgcattttgttctgagtgaggtgggagcctttggagggttctgagcagaggggcaggatcggacgcatcccctggaaggatgggactctggtgggtggcctgggtgggggcagggagcccagtgaaagggcaggtgctggagatgcagagactccagagtcacaaaacccctttctggtgcagtgccgtgaatggctgacctgcggctgcaaagtcagatgaagaggggactgaggtctgagggcccaaatgactctcccaagggcacagcagggaggggagaggacagtcccagcagccaggcctccctcgcagcccacagcccccagcttgctgacccagtcatctccctgctgcttggggccctcagggtcttggctcctgagccagcttctgtctcattaaccaccctccaccttctcttccagttagggtcctcacacttcaaaatcaaggaaactgaggcctcagaccaggaacctactgaagacagggagtagactggaatctggctcatggcagcacaaacccactttttctttcttttttcttttttttctttgtttgagagccggggtctcactctgtcacccagcctggagtgcagtggcttgatctcagctcactgcaacctctgcctcccgggctccagtgatcctcccacctcagcctcctttgtagctgggaccacaggtatgcgccaccacacctggctattttttgtattttttgtagagacacagcttctgcaagctgctccttctccttgtccttctctgtgctttgtggccaagagggcttgaccttgcaagcaaacttgaacatggggagggggctgccacccataagggaagtgacagggtccgcatgccccatgcccagggcaagagaggaaggaggaaggcagaccccgggctgggagctccctccactgcttcactgctttttttttgagacagagttttactctgtctcccgctggagtgcaatggcaccatctcggctcactgcaacctctgcctcctgagctcaagcaattctcatgtctcagcctcctgagtagctgggattacaggtgcccaccatcacacccggctaatttttgtattttaagtagagacagggtttcaccatgttgcccaggctggtctggaactcctgagctcaggtgatccgcccgcctcggcctcccacagtgctgggattacaggcgtgagccaccgcgcccaacccatggcttcactcctaaccagcccccttcacttctcatcttgatattggtgggtggactaccatagggaccataagcgacacccagcccagatgcagcctgggggaccctggcttggatcagcttaagagcagaggctctcagcctctcaggacagacaggagcacgagggagccctgtgaagtatgggggtgatttcagggccctcagaccacgctccaggggccaccgcttcccacgaggaacatcgtcttgctcccccaccccctcaaagagaccttcctggcagagagcacagcagagctgtcaggcgtgtgtgcaccctcgcctgaacacaccaggcgaacacctcccaggctggacctgatgaatcctgtccggggccggaggaagtgccaaggcctcctccctgtcgctcccgtctcaggccaccaggcaggacgccctccctgctgcgccgggctggcgggaggatgctgctcttctcggtggcctcgccctcccagtctggatgagagccatcttcccctgagcaggtcacgttctctctgtggagacagcttgaacggacccgaagcccccacgttctttctggcaggttcctagagagccagatgttctcatccagagacagcatggacgttggccccacacacccgggaaattgaccccctgccgatggctggaactccggccctcaggggagtgtccagggcagtctcaggggcagggagccggcagctgtagaggaaggtggggaccgtgtctgagtctggctgtctgggaggtgacacttcagtcaggtgacacgtggctgtcaagagtctgaggcccggctggatgggcaggcagcccatctgtgcctccccatccagccgggtctcagactcttggtcacaatgggcacccagcccacgtgtccgtccccaacatccactggtggggctgttcaccacaggacatcctgaagatgacaagaaggtgagtcaagagtgatggctgggcgtggtggctcacgcctgtaatcctaacactttgggaggccgaggtgggcagatcacttgaggtcaggagtttgagaccagcctggccaacatggtgacaccccatctttactaaaaatataaaaattagccggaattcacttgaaccagggaggcagaggttgcagtgagccaagatcctgccactgcactccagcctggtcaacagagcaagactcaatctcaaaaaaaaaaaatagagtgactgggacccactgtgcttgagacaagatacacaggcagcatgagcggctcatcgtgttctatggtggacgtgctgaagggcatttcaacatggatttcattagccatcttctttaggggccgggcttctccgccttggcacagttgacatttgggccagatccctctttgtggggggctgtcatgggcactgtagggtgttcagcaccatccctggccggacccactggatgccagcaccctctccaattgcaaccatcaaaaatgtctcaagacattgcaaaacggtcctggttggaaaccactaacaaaccaataaaagtctttggtcctgagcaaagcaaggtgcagagacataggaacaaacaggttctatagagaacaagaatgcagatgggagagtgaaggtccccacagcctggagaccaagacatgcaccatgctgccgacaccgattgtcaggggagagaggccaggcacagaatagaattttttttttcttttttgagacagagtctcgctctgtcgcctaagctggagtacagtggcacaatcttagctcactgcaacctccacctcccgggttcaagcaattctcctgcctcgccttccaagtagctggtattagaggttcccaccaccacgcccggctaatttttgtgtttttagtggtgacggggttttaccatgctggttgggctgatctcgaactcctacctcaagtgatctgcctgcctcggcctccctaaatgctgggcttacaggcatgagccaccgcacctggccgaaaaagattttttataagtgtccatggtatggacacagtgtcttgcacctgtaatctcagaactttgggaggctgaggcaggaggatcacctgacaccaggagtttgagaccagcctgggcaacacagtgagaccccatctcgacaaagaattaaagaaattaggtggtcaaggccaggtgcagtggctcatgcctgtaatcccagcactttgggaggccaaggaagctggatcacttgaggccaggagttccagagcagcctggccaacatagcgaaatcctgtctctactaaaaatacaaaaaattagctgggcatggtagcatgcctgtagtcccagctacccgggaggctgaggcacaagaattacttgaacccaggaggctgagtttgcagtgagccgagatcgtgcctgtacactccagcctgggcgacagagcgatactctgccaaaaaagaaaaggaaaagaaaaagaaagaaagaaattagctgtgcatggtggcatgtgcctgtagtctcagctttttgggaggctgaggcaggaggatcacttgaacccaagagttcaaggctttagtgagctctgattgggtcactgcactccagcctgggcaacagaacaagagcctgactcttaaaaaaaaaatttccataataaacagcatgtataatacttcatatatgtgaagtcaaatatgtgagtggatctagaaagaagtatacaggccaggcacggtggttcacgcctgtaatcctagcacttctggaggccacggcaggaggatcgcttgagcccaggagtttgagaccagccaggacaacatggcgaagccccatctctacaaaaaatacaaaaattagccgggcatgctggcacacgcctgcagttccagctacttggcaggctgaggcaggaggatcactcgaacccaggaggtggaggttgcagtgagccgagatcgtgccagtgcactccagcctgggcgacagagtgagaccctgtctcaaaaaaataaaaaataaaaaaaaagaagcatacaaaggtgttcacagaaaggttagtgggtgcgcctgggcaatgggaactcaggtaggtgggtgtcttctgtcctgttccgtgtggagcaggtaatgtaatattccgatgagggtccggccctgaaatgggcaggcctgggggaaggagcacagatgtttcccaccctttctgtataacactattaaagccttcttggccacagccatcagggtttactttttaaagatcctgctccaccttccagccactcttggttcacgcctccctttggttttcttgtttgcttgtttttgttttgttttttgagacagagtctccctctgttgcccaggctggagtgcagtggcacaatctcggctcactgcaacctctgcctcccaggttcaggcaattctccggcttcggcctcccaagtagctgggactacaagcatgcaccaccacgcccggccttccctttgggttttgtttggcagagtctgttgatctatttcatgccatcccacaggccatctttgagaaggtgggactttggcctctctccgtcacttccatctcctgtcaccccaacctaccgcccctccgcagacaggcacccctcagggcaaaagcagccatgagccagggcacctccctttagcaaacctgcttggattccagcctctgcacaccccttgtgcccggcacaaccttcacagccccaggcagcagccccaaagccagccctgttgccctggtcaagtctctagtgacaccagaaagaaaggaggagaggcagagaggttgtcctggtggtaagcaagaagcccatgacatcactggctctacagactgccacgggtaaacagcttagaccagatgactcaggctgaaagcatatgaacccttcctgcagggaggccgcccggatgcaacagtggtttcacccctgagccgggcagccttggcagaccttgcttcacgtgggctgaaatggcagtgtctctcctctttgtggccaggttttgcctcctctttgactcggaagcatctcctatcctgcaaggacagtttgagcagggcccccgggccctccttccaagaggcttctgcagctgtggacccccaagagtttatgccgctgagctctgctgtctctccccacctgctccccacctgtctgcccccacacctgcgactctggctctcctggatcctcctgtagactggttcctataagcacaaggaggaacatgcgagatgctgggattggatgctctgggcctggggctggtgtttcctcatgcccgggctatttccttttggccctgggcatgcagtcatgtgcttcctttcatgggcgggttggggaccagggccagcgagcagagacggtccccagggcttctccatcactggctctccccaggaagcagcctcagctggcgtgctggggaccggagctggccatgagggaggggtggacagtggaggaaccggctgcccagctcagcagggatttgtggaggctgacttgcatggtttcgggtttgccttgcctggaagcctggccaggggaggctcaggtttctcgccagctggccttcctcctcctcctccgtgtgagtgacgccccatggccatgatgtcatcacctcgtacaaacagaagggagactggcttggcggagctggcggctgtcccatgctgagtgcagcagtaaatttcatttcaaggctatgattaggtctgtgcccaagaatgtcccctctctcctcccctctccccaggcctgtttttctctctctgttcctgtcccgcctgcttttcctccttgccctcccctctggtccttcctctctctcctctggggatgcttcagtttctctgtgatatggaccctgtggccagcagcagcatcaggcccgagccagactctcattacctccagtttcaaactcagcctcacgtcctctggaaccggcttcctgaagcctgggacaggtctgagtccctggattcctcctggggaggatgggttggggtgaggggcagagttcctgaaggtcctcattcaaccttgagctggagtgctggacagcaggaagagcaggcttgggggtggctgtggtcactaccaccgagatcagaggcagtgaggcaggagaaaggtgagaaggagccaagcttcttggaaagcgattcagatccttctcgccattcccagctggtttctggagatttgagtctgactcgttaactcactttttggcatggccacccttcctctcagcccccagagggcccctaggctctgtggacacctgtgacagccctgtcacccatcacactctgccttgcctcttgcgtgactggctaccctggttctgtcctggtgctctccggcccaggaacaaggctgacggctcgtcacccctcagcgtcccctgcattcaccggcccctgcttgcctcccctcgaaggtgccacccagccagagccgtgttgctgtggatgcccatgaggaaggctccgatgtctgggcaggtggtgtcccaccgcacctgcactgggctgggctccctgctggggtagagggtgctctgggtcgctgtcggtgctgcctgtcctgtgggactgtggttctgaccccttgaaggaggtagcagaacgccctagatgtggcctcgttgatgagagagcccacagtcactcccagccccatcagacactgcctgccccgcattcagccatccttcctcattaagaccggcctggcctccaacccctgctcaccaggcaacagccagctgagagtgaggcgatgcgctgcagccccggggaggggcccagctggggcggggcggagatgcagtcgtcctagcaaccggcagaggtggaccccgcatttctgtggctcatcaccctgacttcatccagactccctgtattttatctcatagatttctcattctgatgtctgtctcccctactgactgtaacctcttaaggctatagttcatgtattcattcaactggtatttactgggcaccagccatgggctgtgcagacgtcagggaaatggatggggagtgacccctccttcctgcagcgcaaaccatcctttaatatgaaagagacagagaccattgcaaagagtgtgctgggtgcggtgactgtggtgcgacccaggacaatggacgggcgccagcagggttggggtggtctgggggggctgtctgggatgtctcgagtgggacctggaggttgagtcagggtgatccaggtggaggaggcaggcactgcttcagaccagggagctagcggcgctgggaggcccacaggccggaggacacccaggactccagggggtcaggctggctgagccagagccgggtgggggcagagcctgggctgtcggcacagggggctgaaggtgagtgcagggagatggagacagcggcagctgttggtggtgactcactgctactccgatgattggaaacacatgttcccgccgagaggcgcgtttattactcacagccgagggttcttggacgacatggacgtcaacagggagaggggtggggagggagagtggtcggcggtggggtggtggggaggggctccagggtcccttacttgtcgctgctcaccgactctgccccttagagtctgcgacaggatgctctggccatattcctacttgctacttaaaaaaaaaaaaaaaaacaaaaaacttatggccaggcgccatggctcacgcctgtaatcccagcactttgggaggctgaggtgggcagattgcctgaggccaggagttcgaggccagcctgaccaacatggtgaaaccccatctctactaagaatacaaaaaattagctgggcctggtggtggaggcctgtaatcccagctactcgggaggctgaggctgaagaatcactcgaacccgggaggcagaggttgcagtgagctaagatcgcaccactgcactccagcctgagcgacagggtgagactctgtctcaaaaacaaacaaacaaaagtattatgaaaaatttcagaattgcaaggacagaggccagtaccaggctgaccatggaccaacacccacgttggaaactgatcgactcatccgggtttgtttcatcaacatccacccaagaggattatttcgaagccgatcccagacattgtagttcacaggcaaatattggaagaactttttttgttgtttttacaattttatttcttatttctttttaaatgattaccttctcttcttctggatagagaagcatgtcaactttatatggcagcggcttatcttagcacaagacatttctcttaagggcaaaaccagcttcccagcatccttgccttggaatcctcaccctctgtgaaaacacacaacttttcacccatccttgcaaatatgccctggggatgccttcaggcctgaacattttaatttggcaggtggccaagcaatatgctttatttctccttcctaattcttgaggatgctgagaggctctgcccgaggcatcggctataggtaaaggcttgtcattttttttgagatggagttctgctcttgttgcccaggctggagtgcaatggcacaacctcggctcactgcaacctccgcctcccaggttcaagcaattctccggcctcagcctcccgagtacctgggattacaggcacgcgctaccacgcccagctaatttttgtattttaagtagagaccatgttggccaggttggtcttgaactcctgacctcaagtgatccactcaccttggccttccaaagtgctgggattacaggcgttgagccaccgcgccaggccaaggcttgtgatttctcaggagactggaggtttctacgtgggtgaagggacatttgaaatatgattattacttaccatgttgggatgcctatgacatgccacttccaagccatgatctgatctgattctcctcccaccgtgcagtgcggaaggagagtttaatacagcagctcaactgggcttgagaatcagataagccggagttcgcctcctaccgccagctgggtgacctgagcatgcgtgcttcatgggctccacctctccttcattatttggaaaatgggatcgtgctagtacctgtctgaaggagctcacggaacagcgtggagcacatggcaagttgttgtgatgttggctatgaaggagccaagaaacaaaagcaggatcgtacagctgggaggttgctggagccaggattcaaacccccccgccaaaagctgtcagaccctgaacgctgtcccccttttccaccagcaggcacccctgagctccctttgttagtgtccactgaccgacccggaccagtgacttttggtcctgatctgaaaggtctctctgctgggacccatcccatgggcaccagggttaggggagatgtccagggaagcattttccttaagagatcaagagccttgggaaccagtagcaaggggggcctttcagccaatgtggaagtggagaggaaccagaagagagccattcctttcccccggaggcaggtggaggccgctcctcccacctgcggacaggtcgccttagtgtgacccagtccagatctttggcagttttgttttgtttttgagacagggtctcactctgtcacccagactggagtgcagtggtgcgatcttggctcactgcagcctcaacctccagggctcaagagatcctcccgtctcagcctcccaagtagctgggaccacaggtgtgcaccgccacacccagctaatttttgtacattttgtagagagagggggtcccccatgttacccaggatggtcttgaactcctaaccttaagtgatccgcccacctcggcttcccaaagtgctgggattacaggcacagagccaccacacccagttgatatctttagattgtaaggaatagacccccagatgagacagctcagtcgaaggggcttcattcaaatgatacaaggaatgccctgtgacctacgggcagaaaacacagctggcgggcaggggactgcagtgtcctgggggccaccctccccttcttgctcctcgtgctcccggcacctcacctccactgctgccctctctgcctctactctccccactggctcactctctctctctttttttttttttttttttttttttttgagacagactctcgctctgtcgcccaggctggagtgcagtggcgtgatctgcactcactgcaatgtctgcctcccgggttcaagtgattctcgtgcttcagcctcccgagtagctgggattacaggtgtgcttcatcatgaccggctaatttttgtatttttagtagagatggggtttcactgtgttggccaggctggtcttgaactcctgacctcaggcaatccgcctgccttagcctcccatgatactgggattacaggcatgagccatggcacctggcccccaccggctctctgcatctccatggcccagtgtgacggctgtcacccactctgcaccattttagttcagatgctcccgtctcattcattcttctcccagcgtccccctcttggtagtaaggacctgactgagccagcaggggccagttgtggccactgacaccaaccgggtggtcagggcctgggagtctgaaggacagggctggtctagatgggagagggatggacagctcttggagggagggcagtgcccccacaaaaagactcatggcagagcaggtacagttgggcccttgactggcctcctgtgaggcccttctaccctcagaacctttcagcaacagaaggcagtcaggggctgggcctctggagggtctgccacaccgctcgctgtgacagccaggtgcccatcagcttgggagaggttgtgttggccagaaggctcctgtggggccccatccctcaggcagcaatctctctggccttgatgggggagggggaagaaccctatttaaggcagatgagttcagaatactggccttgtccactgtgtctcctgggcagctgtggagggcagcggccactccaggcttggccatcgcccgggagagatgtctggggctgccaccctcatattggctgccaaagaaaatatttttttgcaggtttcctgtgagctgagaatgaaactcaacacccag

SEQ ID NO: 64 - DNA, 19024 bp, Homo sapiens
aaaccaagataaattttttcctacttctataacaatatttttagaattacaaaagaaatatgtggctagggccaggcacggtggctcacagtactttgggaggcccaggcgggtgggtcatttgtggtcaggagtttgagaccagcctggacaacatggtgaaaccctgtctctagtaaaaatacaaaaattaactgggtggtagtggtgtgtgcctgtaatcccagatacttgagaggctgaggcaggagaatcacttgaacctgggaggcagaggttggggtgagctgagatcgcgccattgcactccagcctgggcgacagagtgagaccctgtctccccggcccccgcctccaaaaaaaagaaagaaatatggtggcttacacttgtaatcctagcactttggaaggctgaggcgtgtggattgcttgagcctagcagtttgtgactagcctgggcaacagggcagaacactgtctctactaaaagtacaacaacaacaaaattaactgggcatggtggcatgagcctgtagtctcagctactggggaggctgaggtgggagtatctcgtgagcctaggaggtggagactgtggtgagccgtgattgtgccactgcactctagccgtgtctcaaaaaacaaaacaaaacaaaaaagaacgaaagaaatatgcggttattgacgaaaactggaagaacattaaaacaacaacaggccgggcgtggtggctcatgcctgtaatcctagcactttgggaggcagaggcgagtggatcacttgaggccaggagtttgagaccaaccggggaaacatgtcaaaaccatgtctctacaaaaaatacaaaaactagccgggcatgatggcgtgcgcctgtagtctcagctacttgggtggctgaggcacaagaatcgcttgaacctgggagacgagacagaggttgcagtgagtcgagatcgtgccactgcactccagcctgggcaatggagggagactctatctcaaaaagaaaagaaggtagtttctacctggagagccagatgataaaaacggaaaattaaagtttgctgaggcaactacacaggaggctgaggcaggagaatcacttgaacctgggaggcggacgttgcagtgagccgagatcacgccactgcactcaagcctgacgactggcgacagagcgagactccgtctcaaaaataaaataaaataagataaaaataaattaaagtttgcatttgggacaagaagtgttcctgttttgttccagtggatgtaactgttttatatcatgggcagcagtttgctaaagggaaaagaaaatactgcaagacaattcttgcattcttgattctgagttatgacctctctaattcgaaactaaagacttgtatttcttctttatctttagtccattcagaactcgagttctcagtatgcagaactaactgtaagtgaacagtcattttctgtgtaatttgcttggttatattcctcactatcctgaaattcctgggttcagaccagtgtaactaagagacaaaccctggtgtatgttctgacaagcataatctagctttacacccatcaaactatctaattagagggtaggggactgaattactcattttatttccaaagaactttgaagtttttgcccagagagagccactttaagttaaactctttgagactccatttctcatcagggataatgatacctcttctgcagatggttgctacgaagattccatgaaaagcgaaggcactttattagatataatttactacatgaaattaggggcttgttactgtcagttctttttatgcctgtctctagggtggtggttgaggaccatgtcttgttcatttatattctgggcatttggtacaattcctggactaggagtgctcaatacatatttgtcaaaagaaggaaaggaaagaaggtagtaagtctgaagaggtgctgtgggtctctctggcaggccaatctcggcctttgtaaccctcatcaataagaggatccaatgggcacaagtagaaccagattcagccctcagaggaagacgtggagcttctgccattggacaacagggggagcacccaagcaacaaagatgcactctatctcttgttcacatctctgcttttacatttcttcttttttgaagcctgttgcccacgctggtcttgaactcctggcctcaagggatcctcctgcctcagcctcttaaagcgctgggattacaagcatgagccagcttgcctggccacattgcttcttttaacatatattcttcataggcttaacaactgacatattaacatactatctaaacattctgatgaccagtatggaatatgctcagtaggtgaaagtgggttcaacccgctcccatttgtgcttctgcccaacagttggtatcctgaaacagttgcaatgaattggagatatcctgtgtgatgaagaggaaagaaacttgagttggaagtcaggaaatctgtgtgcatggtggtggctagagtttcttcctatcatttacctcttcagacaaatggacgccacctgcccatcaaccagattgaggagaggagtggataagaggagaggcatccacaccacattcattccttcaaccaaacatggaacttctaccaggctctgctaggcctcgttcacagttacggtacaagatgtagcccccgctctcagggaactctggctggtggaaatacagcatcaaatattctgaaataagttgggggagggccgggtgcggtggctcacgcctgtaattccagtacttgggaggccgaggcgggtggatcacccgaggtcaggagttcgagaccagcctggccaaaatggcaaaaccccaactctactaaaaatacaaaaattagccaggcgtggtggcaggcagctgtaatcccagctactcaggaggctgaggcataagaatcgcttgaactcgggaggcggaggttgcagtcagctgagattgtgccactgcgcttcagcctgggggatagagagagactctgtctaaaaaaaaaaaaaaaaaaaaagaaaaaagaaaaaaaaggaagttgggggagtgcaaacaataaacttcacaaataccacagggtcacttttccatatgtccctaccatctcaaaatgatgctatgtcacttctgtctataggttctcatggcacacaaacagtaaacctgcagtagttgtccatgaggatagatcttgcttggattcaaagatggtttagccagagttgggagtggagaatgatcatgtaatatcttggacacctgccacttctcattaaaacactcagctctcaaagctgccacttccaggtttttgctcagttctatgtcccctaccctgccactatgaaagggggagaaagcccagggccttgggaattcctgccccaccagtatttcccagtttcctttttttttttttgagacaaggtcttgctctgtcgcccatgctggagtgcagcggctcgatcacagctcactgcagcttccaactccggggctcaatcgatcctcccacttcagcctcccaagtagctgggaccacaggtgtccaccaccatgccaggctcatttttgtattttttgtagagatggggtttcaccatgttgcccaggctggtctcgaacacctgggctcaagtgattcccccacctcggcctcccaaagtgctgggattacagacaggcatgagccatcgcgcccagcccgtttccttaagaaacgttttgagcgtctgttaggtgtcatacgctctgacgggggaaacaaaaacgaatataaaacattgactatggttcacaatctgcgtggtggcagacacaaacttctaattttatttctcctctcatacagccgaaaacctggtttaacatacactgtttcatttatgccccaaaacagtcctgtgaggtcaaaacgtcattcacttacgcacggcgggtgacagttcacaaggcacatgacatccctcatcttgatctcccggtatccgcgcattttaggaagaaacatgctcaaagggatgaagggtccgctctcaagcattttagctagcgaagttacagtcacatccggcaaactcgcacactgcagatctaggactaccccgcgcggccccgcccactttcccagcagcgggacgctgtcaccccgactcaggagctcctgggcccgcgggctcccggaagctgccgaccacgtgattcgctggctcagctcacgtgacaaagctcccggaggtgggagccctgggccaaaatggcggcctacctgcagtggcggcgcttcgttttcttcgacaaggagctggtgaaggagccgctgagcaatgatggggccgctcccggggccacacctgcttctggatccgctgcttccaagttcctttgcctccctcctggcatcactgtctgcgactcaggccgagggagcctggtctttggagatatccttcgtttggagctgtcttttccctcccgggatcccgaagagatcgagttaggatgaaatctgtttgtcggaggggtccgtgccgcgcgcctctttggtttagctggtcatccagagttgttctgtggtctacgggaagaaagaaggaagtccatctcctaacttgttatcaactgagcaatcctgggcaagtcatttaacctctctgggttttaatttccttatctgtaggagatgtgtgcatgccaatttgacgaggttaatttgagatcaataagaaaaagaatgcaagttggctttaaaagatgaatatgtaaagtgacatgatttcccctgccctaatattatcgttggcgaggaggtaaatgagcctagcggtttgttgctttcatcttcatgttgctgctactaaattctggcctttttacctttttttttttttttttttttttgatacggagtcttactctgttgcccaggctggagtgcagtggcgggatctgggctcactgtaaccgtctcttgagttcaagcgattctcctgccacagcctcccgagtagctgggactacaggcgcttgccaccacacccggctaattttttacattttcagtagagacggggtttcaccatattggccaggctggtctcgaactcctgacctcgtgatccacccgcctcggcctcccaaagtgctgggattacaggagtgagccatcgcgcccggcgcactaaatttttttcttttttttgagacggactttcactcttgttgcacaggctggagtgcaatggcatgatctgggcacactgcaacctccgcctcccgggttcaagcaattctcctgcctcaacctcctgagtagctgaaattacaggcacgcaccattatacctggctaatttttgtatttttagtagagacaggtttcaccatgttggccaggctggtctcgaacccctgacctcaggtgatccgcacccccccccccccccggcctcccaaagtgctgggattacaggtgtgagtcaccgcgcctggcctcattctttttaagataaggagtatgtgggaaaatccttgaaaattttagagttatatacatgtaattgttatctgagttctggtctgaatgtaagtatctctccttggaaaggaggctccttgactaccctgcacatatggaaggccagatctggttcttgccacgttcctacagcttacaggcttccaagcctacaaactacgggtgacacacctgtaccaactgaagcagcacaatattctggcatctgttggagaagatgaagagggcatcaaccccttggtgagtcccagcagggaaatgggaaagatccagaagcctaggaatgattttttgttggaggatgactagcatttacacttctgaggtctgtccacaggttaagatctggaacctggagaagagagatggtggcaatccactctgcactcgaatcttccctgctattccaggaacagagccaactgttgtatcttgtttgactgtccatgaaaatctcaactttatggccattggtaaacagaaggcaaaactaaccctcctagatttgttatagattttcttcagagttgcttctgcctctcatctttactgttttcaggagaccactttgtactgaactgaggcctttgcgatattaaattttggaatgggggccaggcgcggtggctcatgcctgtaatcccagcaccttgggaggctgaggtgggcggatcacctgagattgggagtttgagatcagcctgaccaacatggagaaaccccatctctactaaaaatacaaaattagttgggtgtagtggcacatgcctgtaatcccagctactagggaggctgcggcaggaaaatcacttgaacctgggaggcggagtttgcagtgagccaagatcgcgccattgcactgtagcctgggcaacaagagcaaaactctgtctcaaaataaataaataaataaataaataaataaaataaataaagtttggaatgggaaggcatttaattttgttctttgaaaatgtgtcagtgagtaccaatattcaggttaaccattagagaggttgggtatatggagaaagcttgtcacttctgagtgcctcaagtggtcttttttcccctctccacttcctgatcttttcagccttactgaagtaattttcttgttttcttacaggtttcacagatggcagtgttacattgaacaaaggagacatcacccgggaccggcatagcaagacccagattttgcacaagggcaactatcctgtaactggattggcctttcgccaagcaggaaagaccactcacttgtttgttgtgacaacagagaacgtccaggtatgaccaaggcctccactcttaggagcaggcagggagggcttctccattgttcagggggatagggtaatgaagtgacaggaaaggtgggagtgttaaagttttaatcatataattcgaatcatttgcctagctttgtattttatttttttgcctaggaagctggaaagagttagactctgggcttgtagtaaaaagatgtgaattttctttcttttttttttttgagaccgagtctcactgtgttgctcaggctggagtgcagtggcgagatcttgactcactgtaacctcagtctcccaggttcaagcaattctcctgcctcagcctcctgagtagctgggattacaggcacacaccagcatgtccagctaatttttgtatttttagtagagacagggtttcaccatgttggccagtctggtctccaactcctgacctcaggtgatccacccaccttggccttccaaagtgctgagattacaggcgtgagccaccgcactcggccttgaattttatttctaactagctttttttttttttttctttgagacaggatcttgctgtgtaacccaggctagagtgcaatggtgctgtctcagctcactgcaacctctgcctcctgggctcaagtgatcctcccacctcagcctcctgagtacgtgggattacaggcatgtgtcaccatgcctggctaatttttgtattttttctagatatgggggtttcaccatgttgcccaggctgatctcgaactcctgggcccaagcaatccacctgcctcaaccacccaaagtgctggaattacaggcatgagccactgcaccggcctattttctaactaactttttaaatgacgttggacaagtatctttacctttcttgttcctggtgccccagatttacaacagtctactctctcaggaatactcttgataaagtagtagattattacatttttcttacttgcagaatttctgtactagatagtgataatatatacagagaaagaaattgtgatctctggttatatatttaatagatgggtaatggttaatgaagaaggccagcagccaagagaaagactttagaatgccaagagggaaaaaagagccagtatggagatgggaatacctttgtgaaggcttagagttacctcctcaaaggagcctgttaacccctttgttgcttctggcagtcctatatagtttctggaaaagactaccctcgcgtggagttggacacccatggttgtggcctgcgctgctcagccctaagtgacccttctcaggacctgcagttcattgtggccggggatgagtgtgtctacttgtaccagcctgatgaacgtgggccctgcttcgcctttgagggccataagctcattgcccactggtttagaggctaccttatcattgtctcccgtgaccggaaggtttctcccaagtaaggactcagtgagaagggacagggagagggctggacttgttccccagaatccgcctgattttaaaatcctaatgcctggatactgccaatctcctactcctactccggtgttatgtaggtaacatttctgttttttttttttgagatggagtctcgctctgtcacccaggagtgcagtggcgtgatctcggctcactgcagcctcgcctcctgggttccagtgatactcctgcctcagcctcctgaatagctgggattacaggcatgtgccaccacgcctggctactttttgtattttcagtagagacgaggtttcaccatgttggccaggctggtgtcagactcctgacctcaagtgatctacccgcctcggcctcccaaagtactgggattacaggtgtgagccactgcacccagccagtgacacttatagctagagttggttacaatgctttttttaactgaaaaatggatgtttttactgcaggtatttgctacatagccctagcatactagaatgctccagggaatttggacctgctttttttgttctgttttgtttgagatggagtctcgctctattgcccaggctggagtgcagtggcgcgatctcggctcactgcaagctccgcctcccgggttcacgccattctcctgcctcagcctcccgagcaactgggactacaggtgcccgcccccatgcccggctaattttttgtatttttattagagacggggtttcaccgtgttagccaggatggtctcgatctcctgacctcgtgatctgcctgcctcgtcctcccaaagtgctgggattacaggcgtgagccactgcgcccggccttgttttgttttttaactcttttgtcaaaataaattgggcagaggaacaagggattcagcagtggagaaattagaaagtgctgggaaacgtaggatgcaagttttctgttttgttttggttttatttttttaaggggtaagtggggtcttctgcatgatgaaagtactccctgttagatgctggtttgttttgctttcattcagttccaggcacagtgttttacatataccatgtattggattattattttctaaatgaatggatatgttagtgtacttaattttctaatctgttacttgggttaattgtaggatcctaaagggtaagatcaggtttatgtgttctctatgtacaactaccggcacagcgctgcatgttatgggatgagagggaccagagaggtgatttgtgctgggtgaaatgtgcaccaaagttatcatgggaaaggaaataggggagataagacagagatgtccaaacatctggtgctttttctttcctatgcaggtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggaggcaaggccaccaggctcgcagagctggccacaggcacctagaagcagctgcaggagcaggttccccaagtcatattggccagggtgtttccctccttgtgggtcacagccttactcagcttccttagggtaggattataaggtaaatggcctgggatggggctttagagggaagtagtggctgggagcctgagcccactctaagggttcactttgtttccagagaaccttatgaaataagatgatactgatcttggggatatctggtagctcttggtttgtctaggatctaggcagatcagaaatccaggactttctgttttgtgtgttgtgcgcacattttgggaaagtgtcttcccaggaccacttctaccaattttctaatctctcttcccttctagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccggtcagtctggaggcactttgggatatagctgtgaatgcagggacaggcagctagatagctaaagcccatccatgctccaggtaggggctagaattctaccaggaactgtttttgtttttggttttttgtttgtttttgttagtttttttttgagatggagtttcgctcttgttgtccaagctggagtgcaatggcgcgatctcgacttactgcaaccttccctcctgggttcacatgattctcctgcttcagtctcccgagtagctgggattacaggcgcgtgccaccacacctggctaattttttgtatttttagtagaaacggggtttcaccatgttagccaggctggtcatgaactcctgacctcaggtgatctgcccgcttcagcctcccaaagtgctgggattacaggcatgagccactgcgcccggtgtttttttctttgctttttttgtttgtttgtttgtttttgagacagattctcgctctttcacccaggctggagtgcaatggtgtgatctcggctcactgcaacctctgcctcgggttcaagcaattctcctgtctcagcctcccaagtagctgggattacaggatcatgctgccatgcctggctaattttttgtatttttagtagagacggggtttcaccacgttctctaggctggtctcgaactcctgagctcaggcaatctgcctgcctcggcctcccaaagtgttaggattacaggtgtgagccacagtgcctggcctttttaattttctttataagaactatgatgccttaaatgagagaacaagattccttgttgaaaagggaattttagggtcaaatattatatgaccagtatgcagttgagccgatgattacctctcattttaacctttagcttggcctttgtaaatattcactttgacctggttctttaagggggaaaaggtattcatctcttgcttccataattccttccatcagtactaattcttggaattttctgccttaagaaggggttttagaaatctgtctaaggtggccgggcgcggtagctcacgcatgtaatcccagcactttgggaggctgaggcgggtggatcacgaggtcaggagatcgagaccatcctggctaacacggtgaaaccccgtctctactaaaaaatacaaaaaattagctgggtgtcgtggcgggcgcctgtagtcccagctacttgggaggctgaggcaggagaatggcctgaaccccagaggcggagcttgcagtgagccgagatcgcaccactgcactccagcctgggtatcagagcaggactgtctcaaaaaaaaaaagtttgtctaaggctggggtgcagtggcatgtgcctgtgatcctatccctttgggagaccgaggtgggaggaatgcatgagcccagtctgagcaacatagcaagaccccatttctaacaataaataaataaataaaatttaaaaatatggctgggcgccgtggctcattcctgtaatcccagcactttgggaggccaaggcgggtggatcacttgaggttaggagtttgagaccagcctggccaacatggtgaaaccctgtctccactaaaaaaaaaaaaaaaaaaaaaatacaaggccaggcgtggtggctcacgcctgtaatctcagcactttgggaggctgaggcaggtggatcacctgaggtcaagagttcaagaccagcctggccaacatggcgaaaccccatctctactaaaaatacaaaaattagctgggcatggtggcgggcgcctgtaatcccatcttaaaaaaaaaaattagctgggtgtggtggcatatgcctgtaatcccagccactcgcaaagctgaggcaggagattcacttgaacctgggaagcagaggctatagtgagccaagatcgtgccactgcactccagcctgggcaacagagcaagactctatcaaaaaaataatagtagataataataataataataaataaataaattgccagggggcagtgactcacgcctgtaatccaaacactttgggaggctgaggtgggcggatcacgaggtcaagagattgagaccatcctggccaacatggtgaaaccccgtttctactaaaaatacaaaaattagctgggtgtggtggcatgcacctgtagtcccagctactcgggaggctgaggcaggagaatagcttgaacccaggaggcggaggttgcagtgagccaagatcgtgccctgcactccagcctggcgaaatagcgaaacttcgtctcaaaaaaataataataaaaaaaggccgggtgtggtggctcacacctgtaatcccagcactttgggaggctgaggtgagtggatcacctgaggtcgggagttcgaaactagcctgaccaacatggagaaaccctgcctctactaaaaatacaaaactagctgggcatggtggcacatgcctgtaatcccagctactcaggaggctgaggcagaagaatcgcttgatcctgggaggcagaggttgcggtgggctgagatcgtgccactgcactccagcctgggcaacaggagcgaacctccctctcaaaaaaaaaaaaattaattaaattttaaaataatgtaaaagaaagagaacaaaaatacaacaataaaacaacaacaaaatagtaataatataaaaagaaacctgtttggcctcttccccgttctctttagaattcctatttttagccaaatttaagaagcagtgctctggagccttgttacccagtgtggtccacagtctagtagcaccgatattacctgggactttgttagaaatgtagaatctcaggccccactccagatccactgaaatagaatttgcattttgagaagatctgcaagtgattcctgtgtacatgagctggagaagtacactgattcagatgctatcgggtgcacatgtctccctagaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaaggtgcaggatgttgttggtggggaagtcttggaggccccactgagcatgaggtggctccaccgggacttgttcgtttcagcaagacatagggagaggaaagggctgaccttatttagaggagtggctgttcctgttagttcggtgccatctcccctcttgttttatgattctagaaattcccatggtatctaagcccagggtggtggcactggggaagtcctgtccctagcggtgtccctctaatggtaggggcagaggaaaactttagtcagaaactcccacaggctgagtagcataatattttcaaagtgtgaacgttatgatatcaccttaggaatctgaaagtcaggtgcctgtttcctctcccttctctatctccctctgtgtaaatgattttgtctcatgtctccctggcagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaaggtaggtgagactgtcttttttccccaagagacagggtctcactatgttgcccaggctggagttgaattcctgggctcaggtgatcctcccaccccatcctcctgagtggaggtgagactctcaacttgggcagagccctgtcgtttttgaagacatctccagaatggtgaaagtgcttcctggtggctgaggcaggagtatacactattctgccctttacttttccacagaattatcaggaagcccttcgatacatcggcaagctgccttttgagcaggcagagagcaacatgaagcgctacggcaagatcctcatgcaccacataccagagcagacaactcagttgctgaagggactttgtactgattatcggcccagcctcgaaggccgcagcgatagggaggccccaggctgcagggtgaggctgcagggaaaagagcttcagactgtggggatcaccttaagggcttcctgtatatcacgcccactcattcagcctcctttttcctctcttgccatcctaggccaactctgaggagttcatccccatctttgccaataacccgcgagagctgaaagccttcctagagcacatgagtgaagtgcagccagactcaccccaggggatctacgacacactccttgagctgcgactgcagaactgggcccacgagaaggatccacaggtgaggcctggccagggcttcaggagaaaagacagttcgtgccgtctccattcttccgtcttggtggctgcctttcactgcattccttagaccagtaacaccttacctcggggctcaatggtcctctgtgaagagggaatggactgagggaaagagttgactggctttgtcccaagagaccttgtgattttccccttttgtccagcagctctgccctccttcctctccaggtcaaagagaagcttcacgcagaggccatttccctgctgaagagtggtcgcttctgcgacgtctttgacaaggccctggtcctgtgccagatgcacgacttccaggatggtgtcctttacctttatgagcaggggaagctgtaagagtttggggaatttcagggaaaggggaagaatccaagtcattttccagagacagccactgaggtgtgcccttgccccggccgcaggttccagcagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctaggtacttgggaagacagatgggtgggtgacaagctgctgacagctgggctctgtggcaggggcccttcacctttatccagagagtgccacacgtggttgattgtcttgtttcctcttggaccccaatctcagtggtgcagaccctggcccacaactccacagccacactctccgtcatcagggactacctggtccaaaaactacagaaacagagccagcagattgcacaggatgagctgcgggtgcggcggtaccgagaggagaccacccgtatccgccaggagatccaagagctcaaggccaggtacccggggcatggatatgtggaggagtccaggggataacttgcccttcacagggtattcattactaagtactttccgtagaggatactatggagtgcttttgagcattttgattcttcaagttgtgttttaattgaggaattccaaaaaatggtttattacatagatcattatttattgggctttggatgatattattttgtagcaggtactttttgttctttatatgcctgtattctaccacttctaaacacatccgtattgtggttggaagccgttctggtgtttttcttttttgagacaggatcttgtcactgaggctggagtggaggggtgtgatcacggctcactgcagctttgatctcctgggctcaagtgattctcccgcctcagcctcccaagtagctgggattacaggcgtgtgccaccaagcccagctaatttttggatttttagtagagatggggtttataatgttggccaggctggtctcgaactcctggcctcaagtgatcctccggccttgacctcccaaagtgctgggatgagccacggtgcccggccataatcccaactctgaaatcttacctgcccttaacattctgtaaaatatttattagagaacaacagtttcttcattctacaaatattgagcctctgtggtgtcccagacactattctgaacagcacaggcaaaaagccttcatggagctttatgttgtagaagagacagacagcaaacatgttaaataggcaaactttttttttttcttttgagatagagtctcactctgtcacccaggctagagtgcagtggcgcgatctcagctcacagcaacctttacctcctgggttcaagcgattctcctgcctcagcctcctgagtagatggaattacaggcgcctgccaccatgcctggctaatttttgtatttttgtagagacagggtttcactatgttggccaggctggtcttgaactcctgacttcaggggatctgcctgccttggcctcccaaagtgctgggattacatgcgtgagccactgcacccggccaaataggcaaattttttttttcttttttgagacgaagtctcgctcttgtcccccacgctggagtgtgatggcgcaatctcggctcactgcaacctctgcctcctgggttcaagcgattctcctgccttggccccctgagtacctgggattacaggtgcctgccatcatgcctggctaatctttatatttttagtagagactgggtttcaccatattggccaggctggtctagaactcctgacgtcaggtgatccacctgcctcggcctcccaaagtgctgggattacaggtgtgagccactgtgcccagccaaatagacaaagttttgtagtatgttaggtggtgataagttctgagtggcaaatgaattgagcaaggggagtgggagaagtgtgttaacaagtttagagaaggtggcccaggaaaggcctcagtgaaagggtcacatctgagtacagacctgaaagttaatttagtggcagttgtgaaaatggagacagaggaaacaatccccaggctgagttggccttgttgggagcatgctgagactcactgcaggtccagggctgttgtattcatttgactcccttaaggcgataagaagagcagggcagggccttcaggggccttaccagggaccttgccctgtgcacttcagctgccttctttctcatccttgactcctggccttgccctcacttttgccactcacttctggtctttcttccctgtagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcaggtggggatgagtgggctagatgggccaggggattcccactagtgtcacagagtcactggagggcttgtttccttatcacctcctcatttaagaaacaagcactttgattctgattcgtattccttccctcctcttctcctgcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatgatttgggagcttaaggatttttttctggggacttcctggtgattcttaactgcatgatggacttccttccctctgctctcctggcgttccacttccctcctacggttttcttggagaccatgttgactcagtctcgttctggtaatgggtggggcctgtggcatcgcatacagttcaatttactgaagaacctctgcaaaagacctaatgactgagctccaggagcagcctggaccaagacccccaaaacagctcttactctttcctcttcctggtctctatggctgtagtttgggcaaaatattcaagcaggaggcagattctggtagggagctttgggcttaacctaccttaaataatgggtaggttggtgtcttgctatacttaataccagatgataaacgggataaaaggtcctttctggaaacacctttccctctctgaaattgtcagctaaagtttatgttgctaggtgtccccgtgtaatttgggtggtgctgcctgtctgaaaattgctcctatgttgtcgttttccccacagcctcacctaatttcatcttctacgttgtttaat

SEQ ID NO: 65 - DNA, 16863 bp, Homo sapiens
gcgggtgcctgtagtcccagctactcaggaggctgaggcaggagaatggagttagcccgggaggtggagcttgcagtgagccgagatagcgccactgcactctagcctgggcgacagagtgagactctgtctcaaaaaaaaaaaaaaaaaaaaaaactatgatactgtcagaggcacctgaggtgtgaggtttacatatgcctatatagtaaaatgtctgcaaagttctggacagacaacttgaatctcttgtctgctgtcctgcttctgatcattagtatatattaacatgcctcctttatattattattattatttttttttttttttgagacagagtttcactcttgttgcccaggctggagtacaatggcaggatcttggctcaccgcaacctcagcctcccgagttagctgggattaaaggcatgtgccaccacgcccggctaattatgtattcttagtagagacagggtttctccatgttggtcaggctggtctggaactcctgacctcaggtgatccgcccacctcagcctcccagcctcatctatattattctaataataattttggtcatacaaagcttctagtttaaacagtactttcagctgggcatggtgactcacgcatgtaatccaagcactttgggaggccgaggcgggtggattgcctgaggtcagcagttagagaccaacctgaccaacatggtgaaaccccatctctactaaaaataaaaaaaattagctgggcatggtggtgggtgcctgtaatcccagctattcaggaggctaaggcaggagaatcatttgaacccaggaggtagaggttaggttacagtgagccaagatcacaccattgcactctagcctgggcaaaagaggaaaacggtctcaaaaaaaaaagtactttcatatctttcattaattcaataaatatcatttgattaattagctgatatgaatcttacaattagtctgtgaggttaaaaaaaaacatatattactactcccaattttaactacctaattatagacaaataaattaaagctcaaagaggtcaaatgacactttgggccacagagtcaataggccacacagtcagccctcatacacctgggtcctctgtgtgtcaatatacacaattatctgagtgaggtcctgagctgatgctactgttgaagtaaaatgaacaatctttaccacttagaagcacttccagcttacttttatatttatttatttgtttattcattttgagacagagtctcgctctgtcgcccagactggagtgcagtggcacgatcttggcttactgcaacctgtgcctcctgggttcaagcaattctcctgcctcagcttcccaagtagctgggattacaggcgcgtgccaccacgcccggctaattattgtatttttagtagagacagggtttcaccatgttggccaggctggtcttgaactcctgactttgtgatccacccgccttggcctcccaaagtgctgggattacagcctttacttttattttttatttccgaaagcagcaggagaaaaacagcttacttttaaagacgcaaggaaacacattctgactggctgagactgccagatgtctgactttcagatgctgttcctctttacttctcaaatatctttctaaaattctctgaacgctacagccacactttattaatatagactccacacatgaaagttgagatatattcagaactgagctgaagtttacctctgcactctaataaagactaagaaaacagtgtaaataagattgcagggagaaatgtttaatgagctgtttttaagcatttcaagtctaatttacatacaattaaagttaatttgcacaccattctcagctattcattaaaccaggtacaaggatctctatctaacaaaataacctggtaacactattagcctagtttcaattactgtatgaactcaaagtaacagctgcatctaaagaaaaataacctacaacactctcactaggttttcccccaattagcccaaattaatgaggtttaatactacctccatgatgacccacaaaacctatcttcccctgatgacccctacagtataagctaaaatgtagttaaaccacctgtcctagagactaggcagaggaagcaagacaaaatggcaatggctaaggaaggctacggttctagggcagattacggtactaaatctgtgctaccttagttaaatcactcaacttctcttgccttcagctgcctcttttacaaaatgagggagctaataatgtggtctctaaacacaatatcgcaataagaggatccagagcttaggggaaagggcagaaaatgtacaagatgagttgggaacacattatcgtgctagaaagcaaggaacactatcaaagactgctgaaattatgtcaaaaggaatcaggagctagcttgaagaacttcccactggtccaatatgaaacaaagttaacatcaataagaataactgcaatggattaaaacacatcaaatatgttaacacctaaaagttcctgatcatgccctaaaaaaccctaaaaagtcactggtcctctctggagtatatctgaaaaccaactcattattttgaaaactagtaaatgaaagaataaagggaatgaattaagtatttaccttgccttccttgtacatatcaaaccccagggtaaccaaagagttgataaagtaaactttttcttttttgaagtattccagatgataaacaacaacaaaaaagaatgatagaattaaaatctaatcatttttcacacatttaatgaaatcatggatctaggtaatcatcatccatgaccacgtacaacagaaaaagagacatctggacattatgagcctcctcacagaataatacaccaccacttatgaagtattattgccaaaaaagcaaccggattcagttcaagcctctagaggagcactgcacaacaggagccactgcatacatgcagctatggagcaccaaaaccagggccactccaaaccgatatgtgccgtaagtgcaaagcaccaactttcaaagatttaatattaaaaaaggatgctgctgggcgcagtggtgcatacctgaaattccagcctttgggaagctgaggtgagaggatggcttgaggccaggagttcaagataagcctgggcaacataatgaagcccgtctctacaaataatttaaaagttagctgggtgtggtggtgcatgcctgtagtcctagctacttgggaggctgaggtgggagcccaggtggttgaggctgcaatgagctgaaatcatgccactgtactccagcctgaaaaacagagtgagagctcagctcaagaaaaaaacaaatcacaataattttttattgattatatgtcattatattaatgttaaaataataagacttttcaggctggggtgcggtggctcacactggtaatcctagcactttgggagaccggggcaggcagattgtttgagcccaggagtttgagatcagcctgggcaacatggagaaaccccatccctataaaaaatataaaaattagctgggttggtggtgcacgcctatagtcccagctacttgggaagctgaggtgggagggtcacttgagcctgagaagtggaggttgcagtgagtcgagataatgccacactgcactacagcctgggtgtcagagtgagaccttgtctcaaaaaaaaaaaaaaaaaccaaaacacacacacacacacacaaagaaaaaaataatagtttgcaactattgggtaaaataaagtttttcgtttgtttgttttctgttttttttttttgagatggtgtccaggctggaatgcagtggtgcaatctcagctcactgcaagctccgcctcccgggttcatgccattcccctgcctcagcctcccgagtagctgggactacaggcacctgccaccacgcccggctaactttttggattttttagtagagacggcatttcaccgtgttagccaggatggtctcaatctcctgacctcgtgatccgcccgccttgacctcccaaagtgctgggattacaggcgtgagccaccacgcctagccaaaataaagtatattattaaaatgaatttccggggggcgcagtggctcacacgtgtaatcccagcactttaggaggccgaggtgggcggatcacgaggtcaggagatggagaccagcctggctgacacggtgagactctatctctactaaaaatataaaaaactagccaggcgtggtggcacgcgactgtagtcccagctactggggaggctgaggcaggagaatcgcttgaacccaggaggcggaggttgcagtacatcgagatcacgccactgcactccagcctgggtgacagagcaatttcctgtttcttcttatctttttaatgtgccaaataatttttttttttttgagacagggtctcactctgtcgcccagtctggagtgtagtagcacaatctcagctcactgcaacctccacctcctgggttaaagcaattctcgtgtctcagtcacccaagtagatgggattacaggcacatgccaccacaagcagctaatttttctgttttagtatagatggggttttaccatgttgaccaggctgaaattttaaatttaattagaagcttgaatatttctgttagacaacactctctagatctaacaaccagtttatagggaataaaagggatagaggaatataaatgaattacagaaattcaactagcaaagtccagaacgggagaattacacaactttgtttctttaacaacagcagcaataacaaaaaaaaaacaccagagaaaaaaagaactgaccaggcgtagtggctcacgcctgtaatctcagcactttgggaggccgaggcaggcggatcacctgaggtcaggagttagagaccagcctgaccaacatggtgaaatcccgtctctactaaaaatacaaaaattagctggtcgtggtggctaatgcctgcaatcccagctactcaggaggctgaggtaggagaatcatttgaacctgggggacagaggttacaatgagccgagattgcgccattgcactccagcctgggcgacaagagcgaaactccgtctccggggaaaaaaaaaaaagaactgagagaacctgtagattaaaaaagacgtaaaagaggccgggcacggtggttcacgcctgtaatcccagcactttgggaggccaaggagggtagatcacctgaggtcaggagttcaagaccagcctggccaacatggtgaaaccccgtctctactaagaatacaaaaattagctgggtgccgtggtggaggcggaggttgcaatgggctgagatcgcgccactgcactccagcctggcaacagagtgggactctgtctcaaaaaaaaaaaaaaaaaaaggagacatagaagctatgtaaaccaaatcaatgtatcaaccttgtctgaaacctgattcaaataaaccaaatgttcagagagaaggggtggcagggatgaagggagagcagaaagagaaattaattgtggaaatttgaacattaacaggatgcagtgtggttatgttttttaaaaacagtctctttattttttacagctatacacagaaattagcatttaaatgatatgatgtctgggacttgtttcaaaatgatctaagggggatgagggaacgaataggggtatggatgaaacaagactgaccatgagctaataattgttgaagctgagtgttgggcatgtaaggcctcactatatcaccctctccacatctgtatatgtttgaaattttctatacttttctaaagaacgagatgagcagacaagtttatctataaaaacttcttgtagcttttgaatctacaaaaatgtatgaaaataagtcacagagttggctaatacttcaagagatcattcgatctagtgtaccgcctccaggacacactacaacattatcacattcagcaaatatttattgagtaactattgagcacaaaggcgctaacattgtagaagatgcacagaaatacaagaaccagtttctgtttcaggactttagtcatataggagaaatcagaaaagtacctaaacataaaacaaggtaaaaagtgatgaagttgaccaagcgcagtggctcatgtctgtaatcccagcacttcgggaggccaaggctggcagatcacctgaggtcaggaattagagaccagcctggccaacatggtgaaaccccatctctactaaaaatacaaaaattagccaggtgtggtggtgtgcacctgtagtcccagctactcgggaggctgaggcaggagaatcacttgatcccgagaggcagaaaggttgcagtgagcagagatcgcaccaccacactccagagtgggcgacagaatgagactctgtgtcaaaaaaaaaaaggtgaagttacggtttaagtatcataagcaaggtagtttttaagtatatcagaagccatcatagaagagtgtcatataactgggcatgaaaaataggcaggatttggacatgtagtgacagggagtattatatctgaagtgtacagacagtgtcagcagaagcacaaaggcagaatataatgaaacatttttgggaaatgaagatgagcgcattattgcgcctgtagtgggaaacagagctggaaagacaagtaggggctagaccacagaatcttaaatatcaggctgagtttgtactttagtcaataagcattgggagtcacacatttggagttctagatgatagaatatttaggaagaaactatacacctcacctaagtttagtagaaaagaatggagctggggagggggatgaaaataaggataaataatcaaggcaaaaggtaacacaggacctaaaatgcagtagtgggaggaaaagacagggagggatctgagagtgtctgggcatgaaaacaagcaggagttgagaagtcaacagtaactaagattttacaactggatgaactgggagaatggtggggccaatgtttagcatgttggcagacctataccagccctgaatagtgttcaataaatgactgactgactgaataaataaatagaaatatgtgagtcaaaatgaagagcagtaagtcaggggatttggggggctggggagtggggtgggcaggagataagctgaaccttctcattgaacctgtgttcctcacaaggttctgaagaacaaaatgctgcccaggagtgctatgcattttcttgggaatgcacttctctaaagcaaaggactcatcattaaaacctacataaaaggtataaaacccatccttaaaaccagtaaacatgcctcccaagcaaggaggagacaacctgtacaatctgaccacaggttctcaaaagcagacagctcatgaaaagctggaggtgcaagtaggatatcagtgaagcggtccaataggaattctggtactggagctgagaggcaaaaatatagatgtggcagttactgcatgaaggttgtaacagaagacataagagtaggctgtgggccgggcgcggtggctcacgcctgtaatcccagcactttgggaggccgaggcgggcggatcacgaggtcaggagatcgagaccatcccggctaaaaacagtgaaaccccatctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaagagtaggctgtgcacagagcctcaaacctgtgatcccagcactctgagaagctgtgacggaagaatcgcttgagtccatgagttcaagacccttggctccacaaaaaataaaattagctgggcatggtggtgtacatctgtggtcccagctacttgagaggctgaggtgggaggctcacttcagcccaggaagctgaggctgcagaaagccgagatggcgccactgtactgcagcctggccaacagcgcaagaacctgtctcaaacacacacacacacaaagagtagatgacctctcaatacaaaagcaaaaaaaagagaagcaaggcctgagacaacttagggactgacaaaggaggatcaggaaggcagaaagagaaccagaacaatgttgtgtcataaaagctaagagaagaatgtccagaaggaaggcctgttcaatccttatcttcttccttgacccacaaattcaacccatcaacaagccttatcagctctacctccaaaatatatactaaacacatccatttctctccatctctttagcgacctacctagtagttcaaactttcatcactgcctagatttctgcagtagcctgttcaacccacctcaatcaagtcctgcccccaaataatccactctctttgtagcaactggattaatcttttaaaaatggaaatcagggccaggcgcggtggcttatgcctgtaatcgcggtactttcagaggcagaggcgggcagatcacgaggtcaggagatggagaccaccctgcccaacatggtgaaaccctgtctctactaaaaataaaaaaattagccgggcatggtggcgggtgcctgtaatcccatctactcgagaggcaggagaattgcttcagcccaggagactgatgtggtggtaagctgagaccacgccactgcactccagcctgtgtgccagagcaagacgccaactcaaaaaaaaaaaaaaaaatgtaaatcaaaactgggtgcagtgatgcaagcctgtgatcctagcactttgggaggctgaggcaggtggatcacttgagctcaggagttcaggaccagcctgggcaacatggtgaaatcccatctctacaaaaaatacaaaaattagccaggcatggtggctagcacctatagttccagccacttggaaggctgagatgggaggactgcttgagcccaggaggcagaggttgcagtgagctgagatttcacgactgcactccagcactccagcactccagcctgggtgacacagtgaaaccccgtctccaaaaaaaaaaaaaaaaaaaaaaaaggggaaatcaggccagggtggctcatgcctgtaaccccagcaccttgggaggccaaggcaaggattgcttgaggccaggagttcaagaccaatctgggcaacaaagcaagaccccatctttaccaaaaaaaaaaaaaaaggaagaaaattagtatggcatgaagatgtgagcctgtagccctagctacttaggaggctgaggtgggaggatcccttgagcccagaaattcaaggctgcagtgagccatgatggcaccactgcattccagcctgggagacacagcaagaccttgtctcaaaaaaaaaaaaaaaaaaggaaacaaacaacaaaaaaaattgtgctttatagggcatgatcatgaaaagtgaaaagacaacccacagaatgggagaaaatctttgtaaataatttatctgataacctgtatccggaataaagaactattaaaatacaataaaaggacaaataacccaattttaaaagaagcaacagatttaaatagacatataaatagccaataaatggccaagagcggtggctcatgcctctaattccagcactttcagaggccgaggcgggcggatcacgaggtcaggagatgaagaccatcctggctaacatggtgaaaccccgtctctactaaaaatacaaaaaattagccgggcgtggtggcaggtgcctgtagtcccagctactcgggaggctgaggttgcagtgagccaaaactgcaccactgcactccaccctgggtaacagagcaagactccagactccatggccaaaaaaaaaaaaaaaaaaagaaagaaaaaaaaagttacattgttaatcatggaaaaaattgtaacagaggaggaaagaggggtattggaagaaacaacacagtaagtcctcacttaactcatcaatagattcttggatattactattttaagcaaaacaatgtataacaaaaccaattttaccacagtctaatgtaaacaagagttaagttcctatagcatatttctggtcacaaaaaacatcaccaaacttctaaagaaagaccaaaacacttccaatattaaacactgaaacaaatgtgagctacacaaacatttaagaaagattaataaaaacaagaaagataagtatttacctaattattccagttcagggtcatgggtggccggagcctgtcccaacagcccagggagcaaggtgggaaccaactctgggcaggatgccatcccatcaatcacacacgcacccacactcactcagactgggaccatttagagacaccaattcatcaaacacgaacaattctgtgatgcgggaggaaaccagagtacctggagggaaaccaaagtactggagaaagcccacacagatgtggggagaacgtgcaaactacacagacagtagccccggccaggaatacattttttttctcatcaacattataacgcaatgaaggtgaacaaaataatgttattcaaagacctgttgtaatggccatgagttgatacttgttgaggctaggagatagatacataggagttcattacatcattctctttacttacatgtatgcttgatattttttcattaaaaagttttttttttaaatcttcaagcacctcaatttaaaaacaaaacacttcttccagacttcccatttacttaaaaataaaacacacccaggcaaagtagctcacacgcctgtaatctcagcactctgggaggctgaagctgaggatcacttgagcccaggagttcaagaatagcctaggcaacatagtgagactccatctccataaaaaataaaacaattaggctgggcatggtggctcacacctctaatcccagcactttgggaggctgaggtgggcggatcacgaggtcacaagatcgagaccatcctggccaacatgatgaaaccccgcctctactaaaaatacaaaaattagctgcgcatggtggcatgagcctatagtcccagctactcaggaggctgaggcaggagaatcgcgcctaaacccaggaggcagaggttgcagtgagccgagatcatgccactgccctccagcttgggcaacagagcgagactctgcctcaaaaaaaaaataaaaataaaaaataaaacaattagcctggcatggtgacctgcatctgtagtcccaagtacccaagaggctgaggtgggaggatcacttgagccacagaggttaaggctgcagtgagccatgatcgcaccactgcactccagcctaggtgacagagtgggatcttgtctcaaaaacaaaacaaaacaaaacaaaatacacacaaaactcctggccagatgtggtggctcacatctgaaagcccaccactttgggaggctgaggcaggaggactgcttgaggccaggggttcaagaccagcctgggcaacacagtgagatgcaatctctacacataaaatttaaaaattaggcaggtgtggtgttatgtaactgtagtcccagttacgcaggaggctgaggcaggagttcaaagctgcagcgagccaagactgtgccactagcctgggcaacagagcaagaccttgtctcaaaatataaataaacagaactccttaacagtcctaaaaagctttgaaatatctggctcctacccatctctccaatcacatattttgttaccaccgttcactaatacatagccatggtaggcttccatcactctcaggatacactaaggattttcctgattcagggcttctgccatcaacagttccttctccctggaactctcttccctcgtttctctatttcaatggttcattttcattcttcactttcagtatatcaccttctcagagaagcctttcctgaccatccttatctaagttcctctattactctctattatagcaccctattttattttctaacatacatcacaatctttaactttttatgtctttttgttttgttctgttttgtttgagagagtgtctgcctctgttgcccaggctggagtgcagtggcataatcttggctcattgcaacctctgcctcctgggttcaagtgatcctcccacttcagcctcctgagcagctggtactacaggtgcacaccatcacacccagctaatttttgtattttttgtagggatggggtttcaccatgttacccaggctggtctcaaactcctgggctcaagtgatctgcctacgttagcctcccaaaatacttggcctcacgcctccccatgtgggcgtgagccactacacccagccttatttatgtctttactgtctatccaaggcttcccaaactgcatgagagcatgcaccttgtttcttctcaagatcactgagttgtatccttagtagtacgtgacacacagtaggcacttaacacatctgttgaatgttaaactaataacccaatactaggcattatcctattgttgaatgtttaatatagcaaaggcttacagaaaacctactgtttacgaggccttaggtaacacatatacacatctgatgagaaggtaaatggtgtcttaggccattcttgcattgctataaagaaatatctgagactgggtaatttataggcaaagaggtttcactgctcacagttctgcaggctgtacaggaaacagtgccagcatgtgctcctggggaggcttcaggaagcttttactcatggcagaaggaaaagcgcaagcaggcacttcacatgtgaactcagagcgagagctcacttatcaccaaggggatggcccaagccattcatgagggacctgcccccatgacccaaacacctcctaccaggccccatctccaacactgggtattacatttcaacatgagatttagagaggatacatattcaaactacatcacatggtataatgagaattaagtggacaaaatttaaaaaaaaaaaaacctcttccagaggcttctgaaaagagcaaataagtagactatttttcccccagagaattcatttaaaaacagaaataagagagttgtgacacagtcccttctctaaagatgtataaacaaagggtccccaagggatcaaggctgaaatgtaccacaattaacatttttagaaattatctagaaaaaacaatagtgaaatcttcccagtttgcagatgactctacagcaacacatagaagtacaatggtgcaaggctctgtgtgttcagcaatgtgaaaaacagcttccatgtagacaaaaataaggtaattcagtgacagaaaaatagttcaaactataattatcaaacgatgagctctaaaactacctgttttaacataggaaaggggtttcaaagtccctagactgtaccctgaatacagctacaaaaaggcaacaaaatactggctgtcattatgaaagctttggaaacacagaacatattatcctatccttgtacaaaccaaagtgtacctgtacctagaatagaatgtgtagttgtagtcatcatagcacaaaaaaggtaaaatagagaaggcctagaaagatatcacagaagaccaaagggaccagaggggcttctatatgagtacagattttttttaaatgtctttttaaggccaggcgcggtggctcacgcctgtaatcccagcactttgggaggctgatgctggcagatcacgtgaggccaggagtccaacaccagcctggccaacatggcgaaatcccatctctactaaaaatacaaaaattagctgggcgtgttgacacatgcctacaatcccagctactcgataggctgaggcagaagaatcacttgaaccaggcaggtggaagttgcagtgagcagagatcatgccactgcactccagcctgggtgacagagcaagacttcgtctcaaaaaataaaaaataatctgttgcaatgagcaagtattacttttgtaacttcaaagagattttaaaaataaataaatcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggctacagagcgagactccgtctcaaaaaaaaaaaataaataaataaaaaaaaaaataaaaataaataaatctaggatattagaaatgggaggcaggccgggtgtagtggctcatgcctgtaatcctagcactttgggaggctgaagcaggtggatcacttgaaaccaggagttcaagaccaacctgaccaacatggtgaaacccccgtctctactaaaaagagacttgggaggctgaggcagaagaactgcttgaacccgggaggcagaggttgcagcgagccgagatcctgccactgcactctaacctgggggacagagggaagactctacctccaaaaaaaataaaaaaggaaagaaagaaaagaagtagaaaataaatttcatgcaaatagcaaagcaaaaaaaaaaaaaaaaaggatatgatgtaagaataagcaaattagtagctgtggtttgttggaaagaactctagatatgcatcaaaggacttgggttcgtatacacattaacatggacaaatgtgaaaaactttatgttgaacagaaaaagtcagacacaaaagtgtgcatactatatgattcaagaataggtaaatttaatatgtggggatagaaatcagaacattggttgcctataaaatggtggagattgactggaaggggaactggaaggagggaactttggagggttataaaaatattctatttctttttcctttttttgagatggagtttcactcttgttgcccaggctggagtgcaatggcgtgatctcggctcactgcaaactccgcctcccaggttcaagcgagtctcctgcctcagcctccagagtagctgggattacaggcatccgtcaccacacccagataattttttgtatttttagtagagacagggcttctccatgttggtcaggctggtctccaattcccgacctcaggtgatccacccgcctcgacctcacaaagtgctgggattacaggcgtgagccactgcgcccagccaaaatgttctatttcttgatgtgggtgttggctacataggtgtttacatttgtcaaaactcgtctaattatatacttccatctcactgtatataagttttacctttaaaaatcttggttagggccgggtgtggtggctcacgcctgtaatcccagagctttgggaggccgaggtgggtgaatcacaaggtcaggagttcaagaccaccctagtcaacatggtgaaaccccgtctctactaaaaatacaaaaaattagccaggcgtggtggcaggcacctgtaatcccagctactcgggaggctgaggcaggagaattgcttgaacccgggaggcggaggttgcagtgagccaagactgcgccactgcactccagtgtgggcgacagagtgagactccatctcaaaaaaaaaaaaaatcttggctaggcttggtggcttacacctgtaatcttggcagcaccttcgaggctaaggtgggaggatcacttgaagccaggggctggagaccagccttagcaacatacccacacctcatctctattttattatttaaaaattccaaataattttaaaataaatataaatctcatcttaaaaaagacatttcaatttcaaatgttccattatttagttgaataattttgaggaagttaatctctcagaaccagtttactttatctataaaatgcagctactaatggcctggcacggtggctcacgcctgtaatcccagcactttgggaggccaaggcgggtggatcacctgaggtcaggagttcaagaccagcctggccaatatggtgaaaccccgtctctactaaaaatacaaaaattagctgggtgtggtggcacatgcctataatcctagttactcaggaggctggggcaggagaatcactggaaccagggaggcagaagctgcagtgagccaagatggcgccactacattccagcctgggtgacagagcaagactccgtctcaaaaaaacaaacaaacaaaaaagtagctactaacatatctcaagtgctggggactgtctgtaatagtatacaacaaagtggagcactatgctttgcaaattatcatccaatgaatgctgaaggaactttaaaagtaaagatagggaagaagttagtcttataattctcataattccacagatgccgttggtattcaggaatactattctttaaagactatcaatattctacaaagggaaattcacttatagttcccaattgtgaatgaaaaggagtatcaataggcatgacccaaaaccttcttctacacagttaaacaaaatttctcaagacctgatttaagagcaaactttttaaactgagtacttatggccgggtgtggaggctcatgtctgtaatcccagcactttgggaggccgaattgggcagatcacttgaggtcaggagttcgagaacagcctggccaacatggtgaagccccatctcta

SEQ ID NO: 66 - DNA, 123871 bp, Homo sapiens
gatcctttggggcacccagccccatagccaagcgaaaggatgctgtgcattgaatgaggagatcttgagagggggatgaagagggagtgctctgggtaagcaaactgattagaaaagtccaaatgagcccaacggatgccaggaagaggaagacagtagactttgggaagcttgcaaccttcaagtccagcacttggctgtttctaaagcacttttcccaagattatcgcacagtatacacctgctcggtttcaagagaaggtccaagattagaacgaaggccagtctcaggagtgtgcagcctaagcagtcacacagcgtcccacacttagaagggctctgcacgcttgaattaatgctctactgccactgacttgaaatgcttaataatttttaaacaaggggccctgaatttttattttgcactaggccccacaagttttatagccagtcctagctaaaacctttattttataagagagaaagctgacccgtagggagcagatgtacttagtctaagttcacgtgactgaaagtgcacctcaggggctaatgcatttgcacttagctgctttcaggcaccagcaactagactgaaacaggccttcagtgtgggaaggcattcctggggttcccgtggcagaaaggtaggggtagctggaatcacagctccctcacttgttctaaggatccaactcagaactggagaaatccaggctttagggagctctcaggctcgtagggaagcagacagcattaagaaaatacaattggaataggagctgaggaggtgacagcaggacaacacctgttaggggctatctggtgtcccccaaaattcatatattgaattcctaagccctagtacctcagaatgtgactgtttagacatggggcctttaaataggtaattaagatagaatgaggccgttagggtggtccctgatccaatatgactggtgtccatgttaaaaaaggagattcagacacagacttgtgcagagggagaaccatgtgcggacgcagggagaagtgggccatctacaagccaaggacagaggcctcagaatgaaccaaccctgcccacaccttggtctccaacttccagcctccagatctgggagacgatgcatttttatggtttaagcctcccagtctgtgatgctttgtcatggtagctggagcagactagtataacatccttcattcctcccactcctgtgaaataaagcctatgactctttcacagagaaagggcccaagactttaaggggttaactatcttgctcagggtcaaaccagtaggcagccatgccaggacttgaacgcagcttgatctgtccctaagcctgtgttttccactccaccagcctagggggaattgcaccccaattcgcccaattcagaaggtctgaatccctttcctaggcatgcccatccctctgctgccctgtgggctcagggacttcctggcacagatctcccaaccccagactcaaagcttccctgtggtttgcattcctgccctagactaagaggactgccgtggctggatcctttgacagaaggactctggagccatatcaacatttaccctaaccctaaggaccaaacaaaagagtgaatatgacaagcctttataagtgtcacacaccagagttccaggtgcatggggttcatgaacaccagcactaagggaacattcttcctttactattaaagtagctacatcaggaaatcacagattctgttgcctttatgtggaggagcaattcagctctctctgtgactccctcatttcaacccagaggcagccaggtatcttcctaaacaaagagctatctacccagggacaaccatgttactcgcctgaaaagcaaaagcaactgcagatagttaaggagatttttcttctttcttcttttgttaaaacaattttaggttaatggtgctttattggggtataacatacatacaataaattacccagatattgtgtccaacttagtgaaaaatttaacaaatgtacactcccatggaaccatcattcttgttgatatggcagttgtatttttaaatagaaatcccaccttctttagccaggcgtggtgacatgtgacagtagtttgagctactcaggaggctgaggtgggaggattgcttgagcccaggagtttgaggctgcagtgagctaaggtcacgccactgcactccaggctgggtgacagagcaagactcccatctttatttacaaaaagagaaagaaaatcccatctctctgctgcgaggcttccgtgccatgatgaagagaacaagggctggggaagcacagagaagagtacaaatccagcatggaggaatcctgaaagcatcccctcgagcgtgtgacagacaggtaagctagatcttgtaaagagtctgctgagaggagacagggaataaagggacattgtagacataaggataagcaaaggcttaggggtttccaacagcttaggagaaagagttcagagtaaatacagcagaagatggctcatggggtgccatctggggtcaggaacagatatgattatataaaaatgaaaccaagcttgctgtctgatttagaagctatttctgctaccagaacagtcagtgcctgtctaacgttcatgtcaggttttattgcttgtggtcaaaggctgtcgcacagtacacggagcaaagagcagaaactgcatgatttttcagaacaacgtccagaataaatatgaatctctgccttaaatgggacattgcagagcaagttacataaagaattatcagtctaatagatcacagcactagttgatcaaaatacttaacatcagcttagcacggacgtttaaagcagtcagcatcaaagagatacttaaagttgtaaaacctaaatgcatgtttcccctcattgtccccacgtcattttctccctctttaaacgcttgtcttactctattgcatagaattcatctttttaagctgttttaaatcctttctggaaaaatgaaagtatacaatatacacagattaccacatacataggtgcatgcctgtctgtctcagaaacggcctatcatttcacatcaatttttaataccacccctaccataaaccagattgccatatgcacataagcctgtttcaagactatttcttctgttccaatagtccatttattcgttcctggtagtataccacactcttacttactgtattttctttcatctaaacaatcaaacattctcaagtctttcccattaaaaaaagaaaattctcccactgccacccccacatggccactagctaccatgctaactctctttccacccttttacggtcacatttctcaaaacgtctgcatgtggccctctgtttcctcagccacttttcaatcctaagccacggcaatcttatttctactcccaccacaccacacaaactgctcttgctaaggtcaatgagcttatgttgctaaatccagagggcaaactccagccttcactagcttcacccaggtgaccacttcctctccctttgcttctgtgcccttccatcctcttgggtttcctgcagttgctttccttattttccatcccccttcttggcctctcctcctcttcccacttcttaaacacggaagctcctaggatttcggggctgggttacattctcttaacaggctcaccacagtttacctaggagcactccccctcatctatggcttccaacattacctgcaacatggaccatgctgcatgttcaccaaacacggtttccttttcctgctttacatgcagttagaccacatttcctggaatcccttttgattatgtgccactagcttctgaccaatgggatgtgggaagaagagatgtttaacacttgcaggtctggccactcaaacctcacacgtgatcttccatgttctctcttttcattcatctgccagcccggtgccaaaaaaaaaaaaaaatgccagtggagatctctgagtgcctaggggcccctggaactactggacaagaggaagctggatgtctaataccctgaataaaacagagcccggcctccaccccaacccacccccactgactttgaacatgagtgaaaaataatcctttattgagtcagctcactgaaatacagaaattgtttgatgaagcaattaacctggcccaactaatacactatctctatgctaatgacaaccaaatatttgcattatgggcctgttcttctaattatgcatcaaatgattgacaatgcagcccaaactgatgggacagatagtttttttttaatagattactaggaagtcacagatattcatgcatacattcattcattcaataaatgtttatcgagtgcctacaggcaccagataccgtgctagaaactaaggttgcaatgatgagcaaagataaaaccagtccattcactcacaaagtttactgtgagcctgatgacagctgattctcatgtctcattatattccagctgcgagaaacttctgtagcatttgctgcttcatgcaagcccgctacccataaaactgaggcttcccctctctagatcctggaatccactgttctctcctctatgaaagggtgcaactggatataatagtataacacccctttctcttaagtattttgtcagttttttattgtagtaaaatatatataacacaatctttttcaatgtaacaatttgttgctaattcagtggcattaaatatatttacaatgttgtgtaacttttaccactatctataccccaaaattgtcactatcaacaaaaactccatgcccattcaacagtaactcctctttccccttcacctgagcctccagtgacctctattctactttctgtctctaaaattggcctattctaggtacctcatataagtggaatcatataatatttgtcctctgtgtctggtttttatcaggaagcgtagtttttaatagtacatccacgttatagcatgtatgagagtttcatcccttttcgtggctcaataatattccattgtatggctagaccatatcttgtttatccactcatctgttgggatgcacttgggtttctacttttggctataatgaataatgttgctatgaacattggtgtataaatatcttttcaagtccctgttttcaattcttttgcatctatatcttgaagtgtgattgctaggtcatatcataattctatgcttaaccgtctgaggaactgccacactgtttcccaaggtggctgcaccattttacattcccatcagcaataaatccaggttccagttattccacatacttgccaacacttgttattttccttatttttttattatagccgtcctagcgtgtcctagcatgtgtgaagctgtatctaagaacagttttaagtataaatgttatatatgaatacaattttgttctgacaaattcaaacccagaatagaatttaaaaatccacttcactgtagccacgtccaacctccttcccctctccagagaaaatcactgttaaaaatttggtatgcatctttcctgatcttgttctctgcatttgtgttctttttttttcatatatggatttttttttatggcagaatttttatatatttataaatcagttgggaaaaggtaaactattcaataagtgatgctggaacaaatgagtctccatatgggttcagaaggaaaattttgccacccaccaaaaaattaagatgaaatagacacgaaacatggaaaacaaaactataaaacttacagaagaaaacacaggaaaatatcttcattatacgtgggcaaacacagatttctttttttttaaattttatttttccataagttattggggtgcaggtggtatttggttacatgagtaagttctttagtggagatttgtgagaacctggtggacccatcacccaagcagtatacgctgcaccatatttgttgtcttttatcccttgacccccctcccactcatccccccaagtccccaaagtccattgtatcattctgctttttgttttgtgttgttttgcatttgtattcttatgtgtgcgtgaatgcaagattatgcgtaatggaaacatagccattctgtcactgtcagttttcttccttctttccaactgttccactgttgttgttgtttttttctgttagagaagttccacttcgaaaattttgccctttagcttgtactgctggttataacgtggtctttgatttccaggaagagtatgctgtgttggctgaagtcactagcagaagaactttggtgtctgcctcatgtagaatgcattgcctaggtcgtctcaggcctgatctgagctgaacttctcctatcacatatgccaacaactctttatgcttctctctttctctgaaattaccttcttttgtctggaaaaaaaaggaatgaggaagatttttcaccccttcagagaaaacaactatccaacaggacgaacgtgggaaacagccagtgtttggtgagagatcgccctctgctgcctgtgttaatcagggttctccagagcagcagccaataggaaagatagatacatttgtaaggagtaacataatacatataaatatacatatttaaacatatatatttagattataaatataaatctatgtctatattatatataaatatatacaagttggttataaggaactgactaacactgttatggaggctggcaagtttccagatctgcagggtgagttggcaagctggagatccaggagagctgataatgtagttccagtcagagttcgaaggcctgagacccaggagagctgatgacatagttccagtccaaagcccagcaggctcaagactcaagagaagccgatgctgcagtttgagtccaaaggcaggaaaaagccaatgtcccagtttgaaggccttcaagcaggagggattctctcttacttgggggagagttggccttttttttctattcaggcctttaactacctggatgaggcccacccacataatgggtggcaatctttacccagtctcctaactcaaatgctaatctcatccagaaacaccctcacagacacaccgggaatgacgtctgaccaaatgtctgggcactccgtggcccagtccagttgacacataaaattaaccatcacactagccatatgggccttttagggagcctgaacccatagcaggaagctctggtgccttgagcaattgtccggatgggcattataggcagttaaaattctaagcaagaaagattaagaaaaaaacaaaagcgtgtaggccaaactggagagaaagagagtgcagtggcaatgctattcgggtttctttcctgctcagaaccccgtgatgactcctcatcccccatagaacatacccttaccttatggggtttgtgaggcctgactcactgcctgcctcctgctgccaccacacatgcttcttcactgttcctcacttgtgccaagcctgttgctgtttcagggcctttgcacttgctgttccatctgcctgggcactctttcccagatccttacagggcttcatggcaaggccttccctgaccaccctccccaaaatagcaccccctccatccatttccgcctccttacccccctttatttgtttgagcttgtttcctgtcttcttcactaaaatgtaaattccacgaggccagggactttattttttttctctgcaaggcctggatcggaataggtgctaagtatttgctgagtgagtggataaatgaataaatgaataaatgcaaaagatagaaggaggggacagatctagtgatggataaaaagcacatacgaaatggtgtggatcctaacgaataattaatctggggaaagctaaagctgaaaatgaattgaggctttaagaaaatgctgaagacagataagtaaaatgccttttagtcagtgtaaggaagtgtgagagcaatttcttggaagaaaataaatcctcttttgttggcatttttccttccagaagattgatcttcaagctaaagaaaagttggaggagagggaggagagagagcgggaaatccagacagctggtgaagttgctagatcccagaggctccaaggagcgattgattgcaggggatgtctagatagtgacagagaaagcgtcatagagatccccaggccccagagcagcaaggaagcagcagcctcatgccctcaggcatggcataaaaataatgctagagctgcctcactgaaaaaaatcccgaagggccaggaagcaggctgaactcagccaatgtctgtatggacagaggatctctaaaccagcccccacccccccacacacacacacacacacacacacacacacacacacacacacacacacacacacacacagagctatggcacaatgctatgggtttgcatatttttctccatgccccccagaatgatgtccaaatctagagcagtgggtgtgaatcttggctcgtgaactctttgaacaaatctgatgaaaattgccacatgtgcattatttcagggaatttaaggaaatttcaggaattctcctccaggcgattcatggacacctgaaatccaagtgccccaggttagaaactcctgttctaagggtatattcctcaattgcagcacttggattaatgatgtaactccttaaccctagagttgaagattgcagccaaattcttagtgtattcattcaacaaatatgtattgattgactgtcatgtagcttatttaatcctcacaactgcccttgaagtagattatattaataccaccctcactcttgacagatgaaacaaacgaggtactggggctttgggtaacttgctacaggtcactcattttgcactagtcactagtaggagcagagccagtggtggaaccccagaaattcagctttagagacattttactgctaccccacgatgcctcttacgaggttggcatctgtctttcagatagccccgttcaccctgaaaacatgtctcttagactacatatagtaggttagacatgaaaatcccaccaccaacgacatccggaggctctgtcaccctgcctctgcttattcatcgttcccatggtttgctgactcagttttaatcattggtttaccttctggatctatttgtatgagggattgcacaaatatttccccacatccaacatctcgcaaggagatggactcacgtgcatgttcaagttcagtctccaagttgagaagaaagctttctggtagcaatgctgcacacacccaggggctcatggatctctcaggagaggccacatccagtgtccatgaagtcatgagttctgcagcatagattccaagttcagcttttgtttcatcaacattactgtgtgcacttctggttgagacacttaggggaacagagaaagttcttcagtaaaagagaggatgtatgagcttcctgtggcttctgtaacaaagtacccatggactgaggagttaaacaacacaactacatggtcttgcagttctggaggctggaagtcaaagatcaagatgtcagcagggtgagctccttctgagggctgtgaagaaaggatgtgttccaggcctctctccttggcatgaagatgactgtctttgccctgtgtcccttcacatcatcttccctctacacgtgtctgtgtctctgtccaaatttctccttttataaggaaataaatactgtaaatatatatatattttgcactataatactggaaatatttatatattcctagtgtttatttatatatgtatattcccagtattcatatatgtatatatttccagtatttatttatatatttatttgatataaggaaatactggttgtattggattaaggcctactgttgtaaactcactctaacttgattacctccacaaataccctacccccaaataagttcaccttctgacgtcctagcagttaagacaccaacatatgaattttagaggtcacaattcaactcataacaagggataatggtcaggaagaaaaagagccacagaatgctagacatttttaatgagttaataaatccttgctataggatcaacaaacttagtaagttaataaacctgatgatggatggatggagcattgtaccaggcacaaagcccggctatgatgacatcaaaggcaccctgctctcttctgttgagaagtgttcaaagtagttagggagtctcaatgagcccatgtagcaggtaagcaatcttgatcgctcacactcaaaaatgcaaatgtatcattttgttcacttatagctagacttaatagggtatccattcaaatgacctgtcattccatcagtgcccacacctggtgactttttccaaggggtccacagccccaccaggattctccccactgtggcattatctccatcacaccccaaggctagatgagaccacagccctccaaggctaaatgagaccacagccctcttggggcactaggaagatccagcttaaaccactgctgaattcaaggtaatttagtggcactgcctcagaacctctctgtcctggcaccccacctagtggcaagggacatatctgcaagactgctgtcttccagaattccagctgggacgcagtcctctatttgaaaacaagttttctggaaggagggagctctgaggaggagtttcacaaggagaagaacacagatttgggataagatggggggacaatatttcagtagggacaatgacagagacatgagtacatatatatatagcaactaactttatatgaagggaaacacacatagacatgtattaaggacacggtgtccaagtcagagggaaaaagaaaaacaggctaattaatgagcagccatcatctgtggcaaagaggcatcaggctctacgctagcctttgtttgctgtctttgacctctctgcacctttgttttctagatgagcaaactgaggcttgagggggttgaatcctttcccccaaaaccacagctgctgggttgaagagttgggattttaaccaggggcggctgaatcaaaaggctaggtctcttccctgagcaaaataatggcatgacaaagacagtactgcagattgtcttgggaaaagacaggacagggaaatcagctaggaggacatttcagcaatctgaatttgagttgaggtggtggcttcagaaatgaaaaagaaaggggtggatgagtgtgaatactgtagggaaagtctgggtgacatataaggcaaagacaaaaaagaaaatgaaaatgacatcaatcctctaaaccactgcatcagaaagataaaggcaaacggtggtggttaaggagaggcttggaagaccagatgactgggaggctgcagggaaaagctagaaatgagggtaactttagctccagatacagcaagtgctgatggcgatgttctttgaaatgggtccacaaacccacataagaatttggagggctactgacagagatttgggtcagcaaatgggtccgatatgtccgagcatggcacacaaggatgatgtctcagcttcacagctgcagctgatgcagaggcactatttttgctacaactgaagatgtggccattccagcggcttccagcatgtaggacgatgaactaagcaggtcatgagacatggagtggagaaaggagcaacctgctgtaagatacttctcactaatggtgatggaggagctagctcaaaaaggggtagcttctgcactgtgcaggaacttgacaccatctggacagcaagccggtccagtccaactgaagggtgactaagtgtatagtgggctgcctactggcctagagtagtgactaagttgcaattctcgttaaactgttgttttgagtgtattacttccttctagcatattgtcaaaattctagtattcaaaggtgtgacaaaaacataaaataaagttgagcagccctggaatacagttatccttgacagcaggagtccctcaagggaagagctgctctaagatcaagttttgaggttggcccaatgacagtcagacatcctggcacttgaggttgcatttgaaaggtcagcattctcaaaagccagattgaactttaaggaaatttcccccagtggatggtagggagccacgtggtccctgagacacctgggtctaacctcacagtctaactcctaggcttcctaaagaggtggttaaacaagaaaagtggtaaaaaatgtgttctttcttctcttcccggtcatcatagaacttaaaaaaatctcagtcccagcagctgttccatgtcttacagagacagaaactgaaccacctcctttcttaaatcatttcgttatatcaggcttgagcatgtctaccaacaaattctgctgttcacagtagttctaacacttggaagcaaagaaaagacgaatctgctggacaggtttttcaaggaaatttagcacaaccctaagttattaaggaggcccacaagaccaaacacaaactgactattctccctctccgtccccctacccttcctcccctccggctctctggtccatcctcagggaactggcctgcattccctagccctctccaccatcccgccagatctctctagtccaaccccatatcaactgacctctgctctctctccatccccatccccttatcccccccatccccctctacctctctggtccagccccacatgaactaactctgggctcaatctccttcccagtacccagtccattgtgagatgacctctcttgctccctatgtctctaagcctttgcacctgtttgctccatctttgcatgaactaatctctgctccctctacttttccatccccctcaactcctctggcatccctctggtccagccccacatgaaggaacccctgctccctcttcctcccctttttctccaactctgattgaactttttagttcaacctcacatgaagcaatctctgacctctctagttcaaaattccacccccaccctcctgcagctctccagtccaaccccgcatgaactgctctctgctctctcctgtgccctgtctccccccattgcactactgccctctgccgcagctgcacatgaatgaatctttgccctctctccagcccaatccctacacgcaaccgacatttctttggtccagccccacatgaactgccctctgctttctctcctgccccttccccaccacctccctacattggtccgtcccacgctgcatgaactgacctcagtccctttacttctgatcttctcccactccccagtgtccttctggtccagtcccacatgaactgacctctgttacctctccattccaaacccaccccactcctccatctctctggtccacccgcaagggctgacccctgctacctctgtctccctgcctgtcccctgcagctctgaaatgaccggtatttgaacccactcaccctgcctctccctccctaacaacaaaatgggaggcagggcccagtcttttcactcctctccaatagtatatgtctttatgcaatcatatgccaccttcacaccccttagaacttacccagtcactctccctacatctctctggtccagccctccatgacatgaactcagctccatctcctttccttccccttccccaccatacatctctggtccagccacacgtgaactaagctccgttccctctcctttcccttgccccacactccggctacctctgcagatacagccacacataagctgtcctcagtggcttttcctttccctctctgacgctctgcatctctccagtgcagctgcacaggagctggcctcgaatgcctctcccatgccatcccattcagccttctgcatctcttggtacagcctacatgaactgacatctgctccctctaagtgtgcatcgccacttcatccccctccagcttcctgggccagccccacatgaactgtcatttcccctcactccctcacaactctattgtccacatgaataagccactaactctacaaacccacccactgacactcccatgaaaactcagctgcatcctcacatgaactgatccctgctccctctcactcccttccccctacccctgctcccctgcacctctccgggacaccccatgcacggatcttttctacttctctgtccctatcctctgcaatttcccttcatctcttggtccagccccacgtgaactgacctcagttacttctccatccacatcctcccccgccttcaggactcttttctgcctccacatgaactgagcccagctccctctccttccccatcttcctgatccctttacagctctctggtccagccccactgactcatgctccctctccgtccccatcttcctgatccctttacagctctccggtccagccccactgactcatgctccctctctgtccccatccttccactgaataactgcacacctatgttagaatggctgccaggcaaagaccttatgtttgcttttatcctcagggataacctattacttgccactctccgtcctgtctcaagagattcctgagagatttcatttatgggaatattaagcaggaggagataagaatgtctccaggatagtccattagcttaatttagccattcaacaatgtatacatctttcaaaacatcatattgtacaccataaatatatacaatgttgtcaatttcaaaacttctttttaattaacttttttttccttatccctgaaactgtttttttttttttaagttaagttccgggatacatgtgcaggacgtgctggttgcataggtaaacgtgtgccacggtggtttgctgcacctatcaacccatcacctaggtgttaagccccacatgcattagctatttatcctgatgttctccctccccccacacccccacccccactgccaccgacaggcccctatgtatattgtccccttccctgtaactacgtgttctctctgttcagctcccactcacgagtgagaacaagtggtgtttggtttcctgttcctgggttagtttgctgaggataatggcttccagctccatccatgtccctgcaaaggacatgatctcgtttaattaactttttttcaaaagagtgtttccagggttacagttaacagtaaaattggaggcagggcccagtcttttcactcctttccaatattatgtcttttatccaatcatatgcctcttattagaaaatcacaatacaacaaaggtcaaatcctcctaggaaatgctatcaacacactttggggacagtaatgataaaagcttcatggacccacatttaacaacaaagcttatgtgataactgtagcaaaagaatgggagtaagactgaacacttctgaatcctcttgttcttgaataccttcaagccaggtcctctctgtaagtttgtatttcacctccagtgattctgagtaggcacaactcttctccccatcacacagacatcaaactccaggcacctagagaagtagcttgccccaaattgcccgatgaggaagtgggtgtgtgtgagaatccagggtttgggctagtctgggctcttcccccaagtttttcttaaggagcagtccctcggcatgagactcatctgggggatatggtaaacttcatattcctgggcccccaagtcctacaggatgtcagggtccagaggcatgagaccgagggccaggcttctggcctctgtaacgtgctccccgggtagggttaccagtggcaatacaggatgcttaggtaaatttgcatttaagatcaacaatgaataaacaaaaaatacaaatgggatatagtcatactaaaaaaaaggcatcattgatctgaaatgcaaatttacctcaactttctttttattagctgaatcaggcaaccctatccccagaggactagcctacccccagaagtttgaaaatctgttttctccctctccatgtgaacaaacgagcattccatcattgttcattttctattctccctcaccccttctgcctccccactctcaccctggagcagagactttaatgtcatctaccaggatttctcacacagggaatcccgggcaaggccaggaagatggttggatggggtcactcagcccaacccacctccaagagtcgatgagataccataagcaaataaattcacgagaggttggctgaatccatcctagtgttgcgttagcctggctctccccattttattcaagcacaaattactaacaagactcttttccagtcttagctttgccaaaactatttttagagcatcatttaggcttaggtgatataaaaattctgctagttttacaaaccagcagccttccaaggcaaaaagcaattcatgccaggaaagtagcaaaggattattcattttctgtccataggctggtaaggagttttgtatctaataggctgccttcaacacaataattgagaagaggaactcataagcaaagctaaagaactcatccttagagaatacaagttcaaactgagaaaggttttacttttaagacaaaacaaatagcattaacacacatccaaatgccagtgcaggagttcactgggtttataaaagagaaaactaaactcaagtgtcaaataaaaactggagccgtcaagaatgactgcttgtggcaacacaggtgtaacatgtgcttgtctaaagtcgttctgtgtttgtggatatgtggaaatgcatgacgagggaaacgatgcaaggcaaaatggcaggtgctcaaagctttaagatccttttcttcacgcttgtgtgctcttgttttgcttttgagaattagggtaattcgcaggtcattttacaaagaactgtaatatcaaagaacacttccaaacggctaaaataggctcaaggtcactattaaagtgataaagggaggtccgtgggggaaaagtttgtgttctcaaaagccagatttcacaccatggcaggcactaaatctagttacatgtgcttgcagtagaaaaagaagacactgatcttaatagaggctggtctttttcatgatgcgcaggaactcttgctcactgacctctccatctccatctcgatcagcttcatcaatcatttcctatatgacagtaaagattcaggttaatttataaactaatgccaaaaggtgactaagtaatagacttttttttttttagagatggggtctctatgctgcccacactggtctcaaattcctggccacaagagatcctcctgcctcagcctcccaaagtactgggattatatgcatgatccactgtgcctggcaagcaatagacttttaatctatgtgaatagataatttgtatctatgtgaatagatcattgtagtccacccaatgccagtatgctactcctgataatagcttggtttctgaaaagttatttgaaaaccaactcatactttgtcaaacatatcacctgggagggaccttgaagattgccttgactagagggattcctggaacctaaaatagtaagcaaaattgtgcatatgtgcatttttctggaagcagggttcataggtttgtctgactattaaaggagaattaagttgtctgcagagggacaaagtacactggcttttcttcaaagaggtgctcacactagggaaaatgtaatggaaaagtcacagagggctcaaaggtgggaattttaagttccagtgtgatgcattacaaacctgcagctcctcatcagtcaggttctcacccaactccttggccacgcgtttcagatttttgaacgaaatcttcccagtttcatcatcatcaaagagcttgaaagctttcaggatttcttctttagtatctttctcagacttaacaagtagaacataaaacacatgagtagggggacaccacggttggttactactgtcctgtagccctgccactgcctggtcaggtcaccctttcctttttaacaatgtaactcgagtctagacttgcggcaagtgtcaggaagcccattttggcctcaaagaaacaccaggcaagccaggcactccatccaaggtgacgtttgctacctatcgctatatctctccctatcccatatctatttcctaactgatttggaattctgtgggaagaggtatctgcttggaagtcttgagaaagaagcacaagggcttgttttgggagcccaaagtaacatgatgggagggcaggcctcctgatgcagttgctacctggactgctctgtggtcacatgactgttttaacaggaagacgccatggacctctgcagatgactggggctccataccatgataattgtcttagctacttaccattttctgggtcatcacagttaaaaagtcaccaaagttcatttttcctgtcccttccttatcaatttcacttatcattttcttaatttcttctttcttgggttcaaagcccagggccctcattgccacctataaagaaaacaggatcgtctcaataagcacatctaaagtagcaggagcaaaaataacagtgttgagagcattaagccagcatctgatgtggtcatgttaatatgattggggaacactatgacattgatctaattgatatttgcaatcaattttattgaataatactcaaagtaagtaaagacaggaaaacagcacagtacaacctcccctgttacttactgcagggagaagagggcaaaaggggtagagaggtgatagggagatgacaaggaagaggcagaggaaaggaagggcagtacggcaggaatgcacagagcttgccttcagttctttaacatctatggtgccagttccatccgcatcgaaaagatcaaaagcttcccggatctcctgcttttgctcttcagtaagctcaggcttagggctcattctttttcgctgagaacttgatgccatgtttgccttcttaaagttggaggcctttatatgttatgcaatacacaagcacaataatatatcatacagtccatatttacataacatagttacagacacccatatgtatttttaaagtcatttatataaccaattccaaagctttgcttaaaaagaaagataacagggtttactggcaagaacaatgaatctttccatgaacttctacccctcccttttctttactgttgtttctagaagcagggagatcacttgttcagtaaggacacctcttactgaaaatcatcccaaaagagagccagtcaagaagatgactgtgaataactagagataatcagctcttcccgaacgtggggatcctggttctgaaaacagtcttacgatgcccactcccagtactccccttcccagtaagtactccgacttcccaattacttctagatttggccaaatattagtaagttgttaagatgtatattgtgtcagtaccgagtaataaaactcaatccatctggcaccttcgtgccttctccaagaagctaaagcatcccctgaatgcccctgtatttaaattgtaaaaaacattgtaacagaacacgatacaccttttcccagctgtgtgtggaaattttggcagaatgaggaggccagggggccaaggtctgagagagtcaggggcctgtgagggattcgagtcttttttgcccagggaggttcaccgaggggatcagggaatgcaaggggagcccgaggggcgggtgtgggcctgttgtgggtgaagaggaggcagcagcgaagcgcaggcccagtaggttggttagcgtctgtaccctactctcccgggaaagagctcaaaggaaagactggtgcgctaaagccgagaaaggcgcaggagaggcggcgtggccgagctggggcctgggaagggctcagccgctgggcgtggggcgcgacagagcggcagcactcaccatagccaaaggagtccgctgccggttgttaggcaaccgacgtgtacactgactcggcgccgttcccaccgccccgcgcgcgcagccccgctccccattggccgtccgctcgtcgccgcctctccctattggtgcagggccgaagagggtgggactaacctggcaaagccccggcccagcgcggggaggggcacgctggcgacagagccccgtctttattgggcaagatcacgccgtgagcgccaattggctgagtcgtcgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacgggtaagagtcgtggccttgccattggaggtcaccctgtgtcagcgactgggcagtgcgggagggtggggagctacggggtcgcccgggtcgggtgctttctgggttgacctaaggctgagtttagggaccgagtgcatcagagcagccagaaacgattaccttgcgtgttggagcagggactgtactcacggggcaactgagacccggagaggggaaggggtgtgctgagtgttgtcgcagaggtcggacggctgggacctaggaactgaatccagccgaggctcgctctttgagggtggcccttcgagagcacccctagactgacccagatgtataggccccagaccaggttccaagagaggatcactttagatcttacctggctaaaagcagcccaggacggtgaactggggcctttgggaacggactttgaaaggagtgagggggatgtgagcgagcatgaggggcggggagaggtcatcaaaatatactctttttgacacccacacaatgcagataaggaggagcattccaggccgagacgccctcatcagcagagtcacaggagttttggaagtgagaggtatgcttggagaattaaaagggagcgtgtgcaagggctgtggactgacatagacctgcagaagtggagctggaggtccagtttgccctctttagctatccccgtggcttttagccttcacctgtttttcctccaggcataggggcagtaatctagggagacagagggcagagagtaagtttctcagacagagaaaggcccgaggcttattagaaccttttaaatggagctgctgccctttgccctcttctctcttcagcagtgaacagattcctgacttttgggtcatcatcatccccccaagtagtacgagccagagttctcactgtgatctccaaagcttggcacgacgtgtccccttccatcgctccacaactcttctctcgtctggctcactccagccccagaacactggctttgtggttgaacctcatgtgccagccacactcctgcctctcatctttgtctcagttgtcctctccgcctgcctcctcttaggcaccctatttaagtattgcagcccccagtacaaacaagccactcaccttgctctacttttttttccaacagttcttatccccttctgacctactgtatattttgcttgtttgttttgctctttgttgtccctccactagaaggcaggctgtctgagggcaggcatctttgttgtattcactactggtactccaggacctagaacagagaggggcacatattagacaactgatgagtagctcccctgtttcccagctctcacctagctagtcctccctgctctaccaggttaatcttcgtagtgaacggccctggtcagggcatctccctgctcttaaaccttcagagcctgaaccgtaaagggctccttagcctggcctgtgatccctctgcccagttttgcccctggtaacccttctagcttaatgtccctccataccttgcttcccagtccgtcaacctgcagatcggaagcctgacagagtacaagggaaaaacacaagttctgcgcaggctgtgtgcaggctgtgtgaccttgggcaagtcgcttaacctctctgagcctgtttctcatttgttgagtgagaccagtactgtctacctgatgggatacttttgcatctcaatgggatgaactacttatatgtaaagtggcctgatgttgagcaggtcttcaggcagtattacagttgacccctgaacaacatgggtttgaaccttgtgagtccatttacaggcagatttttttctcatctctcccaccgctgagcagcaggatcagctcctcctcatcttccttctcagcatactcatcaggaagaccgtgaggatggagaccatgatgatccactttcactcagtgaatagtaaatatattttctcttccttatgatttcatagtaacattttcttttctctagcttaatttattgctgggacacagtatgtaatacatgtaatgtacaaaatatttgttcatcaactgtttacattattggtaaggcttccagccaacagtaagctatattagtgaagttttaggtgagtcaaaagttatatgtggatttttgacttcggggctccgtgcccctaacccccacattgttcaagagtcaaatgtagttcttgtctctgatttgctcttgtcattcccccccgcccaccatgcctggagccttagacttgtccaaaatctcttccctgcactgcagccaaggtgatctttccagtcgcaacactcactcctgcttccaacttctaggggctccaccatctttccccccttgtaactccctagcttggcacacagcccccacatgttctcaactttgctcccgatcttgcttcacacttgctgtgacacagcttgtcactgttataagaacatgctggctctgtgccatcactttgtccttcccaccctggccatggaatgtctttcaggacaccatgcgctctgttttactcactcttctggggccttttgaagtcagcttagggatctcctagttggggcaggcttccctgagccagcagcctgcattggtgctctgggcttgccctcatcagagtggaaacgcacttctgtgactctttgcttgctcctgtctcccaccctagatggcgggctccttgaaggttggcagtgtgtctttgtcagcttctgcctggtagtggctggcatttgataacttgtgaatgaggaaatcaatgcatgaggtgacacctgggggttcttttacaagttacagctcccgctttaaccctgggggtttgtttgagcctcacagtagctctgaggtagggaagaaggacgctgttttacagataaggcctcatggccagcggcagcacgataattcactcaaacccatcttccattccaggctgtctgctgggcctccaggggctcgtggtgtcctacagggtgctgagtgtgaggatgagagcagaaacaggtgctgtggaagcgactcaccttccctggggagggggaggaagtttcacagagggggcagttcagctaggccttgaaggaagaggaggcactcaccgtggagaggagagagaaggtattccatgcagaggaacagcgtaagctaagctcacaggcatgctgctgggtttctgagaggtctaccacaaaataaaagctggcgactttttttgtcctaaaagtaaatagagaaacaaacaactggtggaaacatggacaccgcaggtccgtggaaggacaaggtcaagctgggttgccccagcataatcaaggctaaagtgacacctctaaagagaaatgacctccaagctattggcctcactaatcctaatctgggtattttctttcccatatcacatctttgaattctgaaagggaggctttattgttgttcctacagggctcctgctttgctgtattttctctaagaaatatgtccataatgaaggtgtgtgccgcctcaggtgaatccttctctttgcatctgatcatctggcccagtcctgcagaggaggccaagcatgaggcatgaggtgatgggaaataggggaatcctcttttataatccaaggcttaggcccccatttcaggattccaaagaaagttctaagaaacattacttggcattccttggatagccaaactctactgaggtgtttggggaagggcagtttgcctggcattgtctgcccatggactgaagggatgagctctcagtggccacattctagcttcctgcactggaccttgtgcaagggtggggctccgacaacctttcccctttacaaagatgtcacacttctttctagaaggacgggacgctctcatctctctccctagtttgagacagaatgttctctccttttccctccaggaaatgttccccagcaggaaggaggaggttgggctaactcgcttctctcttctcgcttcacatgaggcggcacacaccttcattatggatgtgtttcttagaaaaaatacagcaaagcaggagtcctctaggagcaaacgtaaggcctccctttcaagatgtgatatgggaaagaaaatactcagattaggattagtgaggccagtggctacaaggtcacatctctctttttttttttttaattattattatactttaagttctagggtacatgtgcacaacatgcaggtttgttacataggtatacatgtgccatcttggtttgctgcacccatcaactcgtcatttacattaggtatatctcctaatgctatccctcccccaggcccccaccccccaggccccagtgtgtgatgttccccgccctgtgtccaagtgttcttattgttcagttcctacctatgagtgagaacatgtggtgtttggttatctgtccttgtgatagtttgctgagaatgatagtttccagcttcatccatgcccctacaaaggacatgaactcatcatttttcatggctgcatagtattccatggtgtatatgtgccacattttcttaatccagtctatcagtgttggacatttgggttggttccaagcctttgctattgtgaatagtgccacaataaacatatgtgtgcatgagtctttatagtagcatgatttataatcctttgggtatatatacccagtaatgggattgctgggtcaaatggtatttctagttctagatccttgaggaatggccacactgtcttccacaatggttgaactaatttacactcccaccaacagtgtaaaagtgttcctatttctccacatcctctccagtatctgttgtttcctgactttttaaagatcgccattctaactagtgtgagatggtatctcattgtggttttgatttgcatttctctgatggccagtgatgatcagcattttttcgtgtgtctgttggctgcataaatgtcttcttatgagaagtgtctgttcatatcctttgcccactttttgatggggttgtttgtgtttttcttgtaaatttgtttaagttctttgtagattctggatattagccctttgtcagatgggtagattgcaaacattttctcccatcctgtaggttgcctgttcactatgatggtagtttcttttgatgtgcagaaactctttagtttaattacatcccatttgtttattttggcttttgttgccattgcttctggtgttttagtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccatttcttgtttttgtcaggtttgttaaagatcagatggttgtagatgtgtggtgttatttctgagcgctctgttttgttccattggtctatatctctgttttggtaccagtaccatgctgttttggttactgtagccttgtagtatagttcgaagtcaagtagtatgatgcctccagcttcgttctttttgcttaggattctcttggctatgtgggctcttttttggttccatatgaactttaaagtagttttttccaattctgtgaagaaagtcattggtagcttgatggtgatggcattgaatctataaattaccttggacagtatggccagtttcacaatattgatttttcctattcatgagcatggaatgttcttccatttgtttgtgtcctcttttatttcgttgagcaatggttcgtagttctccttgaagaggtccttcacgtcccttgtaagttggattcctaggtattttattatctttgaagcaattgtgaatgggagttcactcatgatttggctctctgtttgtctgctattggtgtttaggaatgcttgtgatttttgcacattgatttggtatcctgagactttgctgaagttgcttaaggagattttgggctgaaacgatagggttttctaaatatataatcatgtcatctgcaaacagggacaatttgacttcctcttttcctaattgaataccctttatttctttctcttgcctgattgccctggccagaacttccaacactatgttgaataggagtggtgagagaggggacccctctcttgtgccagttttcaaagggaatgcttccagtttttacccattcagtatgatattggctgtgggtttgtcataagtagctcttattattttgagatatgtcccatcaatacctaatttattgagagattttagcatgaaaggctgttgaattttgtcaaaggccttttctgcatctattgagataatcatgtggtttttgtctttggttctgtttatatgctggattacatttattgatttatgtatgttgaaccagccttgcatccctaggatgaagcccacttgatcgtggtggataagctttttgacatgctactggattcagtttgccagtattttattgaggatttttgcatcgatgttcatcagggatattggtctaaaattctctttttttgttgtgtctctgccaggctttggtatcaggatgatgctggcctcataaaatgagttagggaggattccctctttttctattgagtggaatagtttcagaaggaatagtaccagctcctctttgtacctctggtagaattcggctgtgaatccgtccggtcctggcctttttttggttggtaggctattaattattgcctcaatttcagagcctgttattggtctgttcagggattcaacttcttcctggtttagtcttgggaggatgtgtgtgtccaggaatttatccatttcttctagattttctagtttatttgcatagaagtgtttatagtattctctgatggtagtttgtatttctgtgggatcggtggtgatatctcctatatcattttttattgtgtctatttgattcttctctcttttcttctttattagtcttgctagcggtctatcaattttattgatcttttcaaaaaaccagctcctggattcactgattttttttgaagggttttttgtgtctctatctccttcagttctgctctgatcttagttatttcttaccttctgctagcttgtgaatgtgtttgctcttgtttctctagttcttttaattgtgatgttagggtgtcaattttagatctttcctgctttctcttgtgggcatttagtgctataaatttccctctacgcactgctttaaatgtgttccagagattctggtatgttgtgtctttgttctcattggtttcaaagaacatctttatttctgccttcatttcgatatttacccagtagtcattcaggagcaggtttttcagttttcatgtagttgtgcagtttttagtgagtttcttaatcctgagttctaatttgattgccctgtgtctgagagacggtttgttgtgctttctgttcttttacatttgctgaggagtgctttacttccaactatgtggtcaattttggaataagtgtgatgtggtgctgagaagaatgtatattctgttgatttggggtggagagttctgtagatgtctattaggtctgcttggtgcagagctgagttcaattcctggatatccttgttaaccttctgtcttgttgatctgtctaatgttgacagtggggtgtgaaagtctcccattattattgagtgggagtctaagtctctttgtaggtctctaaggacttgctttatgaatctgggtgctcctgtattaggtgcatatatatttaggatagttagctcttcttgttgaatggatccctttaccattatgtaatggccttctttgtctcttttgatctttgttggtttaaagtctgttttatcaaagactaggattgcaacttctgcttttttttgctttccatttgcttggtagatctctcttcatccctttattttgagcctatgtacgtcactgcacgtgagatgggtctcctgaatacagcacactgatgggtcttgactctttatccaatttgtcagtctgtgtcttttaattggggcatttagcccatttacatttaaggttaatattgttatgtgtgaatttgatcctgtcattatgatgttaggtggttattttgcccgttaattgatgcagtttcttcctagcattgacagtctttacaatttgtcatgtttttgcagtggctggtaccagttgttcctttccatgtttagtgcttccttcaggagctcttataaggcaggcctggtggtgacaaaatctcccagcatttgtttgtctgtaaaggattttatttctccttcacttatgaagcttagtttggctggatatgaaattctaggttgaaaattcttttctttaagaatgttgaatattggctcccactctcttctggcttgtagggtttctgccgagggatctgctgttagtctgatgggcttccctttgtcggtaacccgacctttctctctggctgccctttacattttttccttcatttcaactttggtgaatctgacaattatgtgtcttggagttgctcttctcgaggagtatctttgtggcattctctgtatttcctaaatttgaatgttggcctgccttgctaggttggggaagttctcctggataatatcctgcagagtgttttccaacttggttccattctccctgtcactttcaggtactccagtcaaatgtagatttggtcttttcacatagtcccatgttatttggaggctttgttcatttctttttactctttttttctctaaccttgtcttctcactttatttcattaatttgatcttcaatcactgatatcctttcttccaattgattgatttggctattgaagcttgtgcgtatgtcatgaagttctcgtgccatggtttttcagctccgtcagggcatttaaggtcttctctacactgtttattctagttagtcattcatctaaccttttttcaaggtttttagcttccttgcgatgggttagaacatgttcctttagctcagagaagttttttattaccaaccttctgaagcctacttctgtcaacttgtcaaagtcattctccatccagctttgttctgttgctggcgaggagctgtgatcctttggaggagaagaggcacgctggtttttagaattttcaggctttctgctctggtttctccccatctttgtggttttatctacctttggtctttgatgttggtaacctacagatggggttttggtgtgatgtcctttctgttgatgttgatgctattcctttctgtttgttagttttccttctaacagtcaggtcactcagctgcaggtctgttggaatttgctggagctccactccaaaccctgtttccctgggtatcaccaatggaggctgcagaacagcaaatattgctgcctgatccttcctctgggagcttcgtgccagagggtcacccgcctgtataaggtgtctgtcggcccctactgggaggtgtctccagttaggctacatgagggtcagggacccacttgaggagcagtctgtcctttctcagagctcaaacgccatgctgggagaactactgctctcttaagagctgtcagacaaggacgtttaagtctgccaaagtttctgctgccttttgttcagctatgccatgcccacagaggtggagtctatagaggcagtaggccttgctgagctgtggtgggctctgcccagttcgagcttctcagccactttgtttacctattcaagcctcagcaatggcggacgcccctccccctccaggctgcagcctcacaggtggatctcagactgctgcactagcagtgagcaaggctccatggccatgggaccctccgagccaggcacaggagagaatctcctggtctgccagttgctaagaccgtgggaaaagtgtagtatttgagcgggagtgtcccgtttttccaggtacagtctgtcacggcttcccttggctaggaaagggaaatcccccaaccccttgcacttcctgggtaaggcaacgccgtgccctgctttggctcaccctccatgggctgcacccactgtccaaccagtcccaacgaggtgaaccaggtacctccattggaaatgcagaaatcacccatcttctgtgtcgatcacgctgggagctgcagaccggagctgttcctattcggccctcttggaatgaactgagttcacatctctttagaggtttcagtttagccttattttgctgtggcagctcagctcaactttgtccttccatgggcctgtggtgtggggcaaggtggttggatttcaccagtacaacatatctctgttttcctatattatttttagcttaagattttgtcccagtgtacatcgtgggtgcacatattggtttttaatggattcaaataactaacattttaaaggaagagacttgaggcttctgatgtgtgaaccataacaatccaccagcccctaaaacattgctctttggagtcttgttttcagtagttcagagctattcttctgtatgtctgtgtggtaaagtagacataacagaaaatgtaccatcttcaccatatttaggtggacagttgagtggcattacatgcattcccattgttgagtgaccatcaccccatccgccttcagaactcttttcctcctgcagcactgagagtctgttcccatcagcagtcactccccactcacagagcatttgtccttttgtgtctagcttatttcactgaccataatgttctcgaggttcacgcatgttgttgcatgtctcagaacttcattcctttttatggctgaagaatatgcccgtgtgtggctagaccatattttgtttatctgttcatctgtcagtggacacattgctgctcctaccttttggctgtagtgattaatgctgctgtgaacatggatgtacaaatttttcttcaagtccctgcttttagtttttgggggtatatgcccagacatgaaattgctggatcctattgtaattctctgtttaatttttttgaggagctgccatactattttccacaacgtcgcaccattttacatgcccatgaacaatatatgagggttccaggttctccacatcctcactgacacttgctattttctcttttctggcttttgataatagccatcctaataatgggtgtaaggtgacacctcactgtggttttgatttgcattgccctgttgattagtgacgttgagcatcgttttttattttttgttttttgtttttttgagacagagtcttgttctgtcgcccaggctggagtgcaatggcggcaccatcttggctcactgcaacctctgcctcccgggttcaagtgattctcctgcctcagcctcccgagtagttgggattacacgcatgtgccaccacgcccagctaatttttgtatttttagtagagacggggtttcaccatgttggccagtctggtcttgaactcctgacttcaagtgtttcacctgcctcggcctcccaaagtactgagattacatgcgtgatccaccacgcccagcctgttgaacatcttttcatgtgctttttagccatctttaaagtagatcttctttggagaaatgtctattcagtcagagctattctcaatgtacattttaacccaagcgtatatcacatggtgaatttaggtgagtaggcaggggacgggggttgcctatgggatctgactcatttgcgcggctagctctgggtactccaacccatagagacagctaagctgtcaccaaaattcttatctgactcatagtatttacaaactttaaaataattggtatataatttgagacaaaggagattttgttttgacaagaggctggtttgcaaagaattgtgtgattattgtttcagcagtacagctccgttggggtgagacatgtttcttctttgacctcctacatcctcctctagcaaacgaggagaggaataggctctaaggcttcttgcttttgctagtcatacaaggggacttgtggaattggcagctctgctatttggatttcggcactacaaaggatactcgtatagtttgctgggtctgctgtaacagatgaccacaaactgggtgacttagaaaagcagaaatgtgtctctcacagttctggaggccacaagtccaaaatcaaggtgttgacaaggttgtgttccctctgaaggatccaggggagactcgttcttcattgtttccaccttctagtggctccaggtgttcctttgcttgtagccacatcactctaacctctgcctccatcttcacatggcctcctcctcttctccctgcctttcccctctgtatgtctcttataagaccacttgtcattggatttagggcctaccaggcctccaaggacctctattggcccattcttttcctacttttcatgcaaaacttaaggctacgggagcagttaaagttactttttggttcaagaagaactgaatgaagcatttggtgttagtcattatgctattcattgaatgaggccaaagaggaaatgattctttccacccaagtttgcttgcgagtcccagtctttctttacactcctgccccatgctgtcgctgtacacctactttacaaagcatgtccttggttgtttatttgttagccagcatctagttgttgcgacaaccccaggagttagcctttaggcaggacctgggagccgtttccaggacagataggacagcccctgcctgcccaagcttataccgcatggcagcagattagataggggagaactaaagtggtggagagagtccaaaggcagcccaagaggaggcataggcagggagactcctgcacaggaagctgtgttacaatgataataaaattagctgccttgaatggcgtgttgacaggtatttgacacaatcctcataatgaccttatgaggccatttactttacatatgaggaaaggcaagctcagttcttttaaataactcccccgagggctacctgctggtaaggaatagtagctgggatttgaacccaggcagccgactctgggttaatttattgccagctgcactgaggagtggcgtgatttgtgatttctcatgtgtagagggtgagcagaggcttacaagagcagaactccacaggggtgggcttgcttagcccggctggcctagttagcctgtcatgcggtcctgtcactgccccaggcacacgcccctcagatcccctgccagcagaggtcaataaggccttggtggggtcagaggccagatgtgagccatctccttgcccctgtagatgccatgtgccttttcatttgctcacatttccctgaatatctggggaatctggataagaagccagcagtgggcattcgtgattatatcatcactaaataacagtcacttgccccactgaagcccctgcaccttagatgggatatgcatgtatgcgatggagagcagtatgggagctctggtgggtgtgcccacacatggtagtctcatgacccccggccgatatgtgagtgcccactttgtgctgggcactatgcttcatgcccaagttgcaacagtgggcaaggctttggtgcaaggtgccaaaatccttgttctctagctgctttggtctagatacacattgagtcccagtgagttcaatatcagccacatgtctttcgaatgaacagttgacagggcccctaccaatgtgaaggggattctgggataaagggagggacagggcaggcacagagctacagattgacttcaatgcattctaaaaatggccatgacaagtcaagttttgacatacagtttcttaataacttccattatgagttcagaaaaatgttcccccaaatggctcctccagacattgagggtcctgcatccatttcaaggccattttggctttctacatgcccgtaaagtctgtccccactgggacacatgatcatgcccattcgttaaaagtggcaaggagtgtaaaattcgaggtgtggggttggattggagcaatcacagcaggtggaatcccagtgctgcctgccacctcctcactgaagtgttctgtgaatctagcctttcatgagcaaagttagactcttgtcttgtcgtgggttttgccatctccagatgttaggggagccatgactaagtaaattggcaactaccaagaaaacatggatgcaagaccaaatacatcatagtcaagtggcatctttgtgtttgcagttcagtatcatgggtgactgaggagaggagcaccctaagggctgtcactaaagccatactcctctgtttggcaacgttgtcggattttattgctaccgtctccctgctgtgaactgctgggtgcccactgtactctgatcacttctcaagggtttctgatggcccaagatgctaagttcctccacgcatcgtcagggcggctttaacttagccaagcaggagagctccgtctcctattgcactccactcatcccccgtcccagcatcccatgtcctgagctcctagacatgagcccttgtgcccatttcattgatgggaaaactgagctgcagcaaagggaagtgactggagcaattccgtacagttcgtgataggcccagagcaggactccctaggtgtgggcactgctacaccctaatgagcaccacaggggaaatccacgctgactgaagcgtgggagagccatggaaaaagctacaatgccaaagacgttttttatgttgtcactgataagtgagctgatttaactggcctcctgtgcgcctctaatctaacagtgtggtgagtcataggcccagtcgttggccccgttagccgggcatggtggcagacacctgtaatcccagctactcaggagcctagtgtcttgtcgaacagctgtcgctatggttcagctatttgtaaaaacatgaacggggggatggcatctgcccaaaacactaacaactaaagatgttttgacttaggcaacattaatgtctgtctctaactatgtctttaagaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggtaaggagaaagttgacacgtacataccaacaggctgatactatttacctgtgggtgaaaaattgtatttgtacatgtattaatcaatgttgggtattttttatgtaagatatatagctttgtttaagatgtgtcagttacttattgctgtgtaacaatatcagaacacagtggtttaaaagaacaaccatttctttgcttatgactgtggtttcggctgagcccagctggggtgttcttggatggtctcccctgggctcttgcatgtagttgcaatcacatggggaccccttgaagcatatgctcccaggtggccttgctcacacctctggtagtaactggtggctgtcaactgggcaccttggtttgccttcatgtggcctccagtagaccaggctgggcttcctagtgaaatggcagcagtatttattaggcctaagatttagtgtcgcaagtctcagtctgagagaggacttgaagaaattgttgagcctggtcgttgtcaggcttcctggagattcttcacatcagtctgcaaaggtttgctttgattgattcttaatcagtgctgcacttcaaaaatgtggctgggcacggtgtctcacacctgtgaaatcccagcactttgggaggccgagacaggtggatcaccagaagtcaggagtttgagaccagccaggccaacatggtgaaaccccatctctactgaaaatacaaaaaattagccaggcatggtggcagacacctgtaatcccagctactcaggaggctgaggcaggagaatcacttgaacccaggaggtggaggttgcagtgagctgagatcacaccattgcactccagcctgggcgacagagcgagactctgtctcaaaacaaacaaacaaaacaaaacaaaacaaacaacgtaattacatcaagacaaaatgtgtttatatcaaatgttaataggttcaagatccctaagaggttatcatgggccgtgaaatcaccctgtatttggtgtagaactcagagtcaagcctcctctgggcctctgtggttgaagccacgtgccatctgcagttcctcatttatgtaaatttgggttttatggctacttggcagccagcaaacaaaggtggattccaatggttatagcaaactgccattttcagctagtttcaaatttttgtgtccttcgaaataacatttttttctctcattagtggactgattttataagaagtaaaagttctaaatttagactactaaaacaaaaagaacacatttgtcttaacttactatacgttctgcataagacctctctgagaaaagggtcccactgctgacaacaaagcaaaacaagaagggttggaaaaacccagcgccctagactattctgttatctcaagattctattgcaattagattagtttgcctaaatggttttttttctttttttttttttgagatggagtctggctctgtcgcccaggctggagtgcagtggcgtgatttcaggtcactgcaacctctgcctcccggattcaagcaattctccctcctcagcctcctgagtagctgggactacaggcgcctaccaccacacctggctaattttttgtatttttagtagagacgggatttcaccatgttggccaggctggtctcgaacccctgacctcaggtgatctacccaccttggcctcccaaaatgctgggattacaggcatgagccaccgtgcctggcccctattcttaacactgtctccaagaggttgatcttataactcacctcagtaacccattatggagtcttgctgtttccagtcttgagttttatacttgattgttagtacatgttcattcttgtccactgtggctgtgagaagtaaaaagtggtcatgaaaagtttcatgtgatctcctgtaatcacacagcattataggtatgattatcacacatttgacttccctggggtaaaggccagtttgattcccatcactacaagggtctccagggaacagccattggcctactcatcccaaacattattgatagaacatttcaatatcataaaataatccacgtcacattgtccaagagtagcgtactgattagtcacaattaaaatcgtgaaatgaaatcacactggactaacagcaaggttgttttttgaagagattagcaaccttttgaaacacctgtaactagagatgccaaatgaaataaacaaggcagtctgaaatctttcaggatgctttagtaacatatctagttctgactgtctttgggcttagccagacttttagtaaactgcagaaatccaggttgggaaacaggcagctcagagttattctaaatagctacagtttgcctgtacagctgacttgggaggaggggagaagaaagggattgctagaaaagggattgatgtgagttttgtatttaatttggctatgacttgaggaaatatacatctcagtccaggtgcaaatcatgtaacctggtatgattacatgtgtttaggaataatcagaataaagcctagaaaagaacaggttgggaagttagttttgggtggtagaagaatggtgaggctgattttgttagtagattgcacatggacagatgaaggtaaagtacagtgccagctccagctgggcctggtggaatccagtatgagtgctgtttcagatgggacaccccaactgggagggaggtggatctagagaggatgtctggccctggcatcccttgagtctcttgcatagctcaattgtgttgatgtttaaggaataagtagggagatttgtttgttttttaaatctagaacataatttctttaagatctttcatttccacaaacccaagttggatttactgtatatgagctaaggaaattggaggttgtcatcttaaggaggcccagatacagttttagaaagaccctagggaggagggatatcacaggtcctcctcacagacacccatagccagcttgtctggtgtgcagcagccacagtttggcatcaacatcctgaaatgagggtatttaagtgcctgcatgtgctactgtgtcctttcattatgcccagtcaccagagttggaattacccaaggaatcgtgtgtgttgtggaggctgagacataaacaccatggctctccccatttcttcaacttccttgtagttcggaggagggaaagcagagccctgggctcatccatcctcactgcagccccaccaggagatcccatcaaggcggtcttagatttctaggctgaggcaagaaggggttgggcgatgagcccagagccacacagcccagccctgttgtggccagagagggaaagggactgactttgtcctgcaagtatggagactgctttcttctttctgttgttttcagtgcaagctatcagctaccaaatggctgccgttttgttttgttttgttttgtccttagagaagcgcccagggatcagctatcgggaacaagaaggtatcactgttttttggggtattttttagattgtccagttttggtcataggtggtttgatttcctttcactgaatacaaagcatggatcttgtcatcaaacccaaccaaagtcaatctcagtgtcattcgctatctctcttccctccttactgatcccaggagagaaggttagggttgcactagtgatggaacaccaggatgatataaagcttccaacttggctcaagaagagttccaaacaaacaagtatatctgccattgcagtggctcatgatatgtaagtctggactctgtagcttccagtcctcactaccctggtcttccccaccgttcctctctttccacaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggtaatggaccatgcagccttgctgatttcccacgagcccacgaagggaaaccacgatacttcccttgctcagaagccagccaatttgtttgaaaaacaattgtttcattgtgaaaattttcaaagttataggaaagaacaccacattcttactgcttagaatgaataaccatcatctctgtcacagatactcagctgtgtcctggtagcacaaaagcagccatggtcagcacttaaatgaacaaatggctgtggctgtatgccagtgaaacttgacttcaaaagccgtccatgggctgtattgttccaactgcaaaacaagtgtgtgctgggccacagggtcttgattttttaattgagatataattcatgtaccacaaatttcacatttttaaagtgtgcaattcagtgattttcagtacatccacaaagctgtgcaactgtctcccatgatctaactccagaatatttgtattaccccaaaatgaaatcttgtagccatcccctctcttcccctcccagcccctggccgccactcatctacttcccatctatggattggcctcttctggacatttcatataaatggaatcatgtaatatttgtacctctgtgcctgacttttttcacttagcatgatgttttcaagcttcatccatgttgtacaggtatgaatatcttgaattttattagatggtgccaaatggctcagcaaagctgctatgtcaattttacctccatatccacaatgtggcacaagccccattgcttcacatctttgccaacactgggcataactagactttttggtgttgccattctgagaagtatgaagtggtgcttcactgatgttcagagtcacatgtcctccctgaccaagtaaccagccactctgccactgggtgatcggctttcaggcttcctcctgtgtgaaatgtttgtctgtgtcctttgcccctttgtctttggggttacctttgcttccttgttgatctagttgggatgccaatcctgtgcccgttgtacttattatggatggcttccctcagcctgtcactgggcccttattcttggctttggtgtcattcgctatatggtttgttgatgaaatattaaggccattgcttccgctgcaaagttacggttgttttctctcccgtgctgcccacacctccaggcctggagatggggtagacatctttcatgctcatcattgctgcctccgaaccgttctccctcatgctgctctaagcctctccagctttgaagaggataccctcagactgtacaaaccccgacaccgttccctccttgtggtggccacccacagccgcctgctccccttcccagtgactccacatcatttctcagtgatttcagctcctttctggcattattattggtgaattcagcgttcatgtagatgaccctaccaatgccctcgcctctctcatccttggcctcctctcacccaatgatgttgccctccactcccctgtcatcaccagtaagcacgtcctctccttcttctcagttgcaggcattctactctgagcactagctcctctctgtccagctcatgccctctagtgcctcagctgtcccgattccttaaccccacccagacatccagccatgcccaccatggctcagcctgttcgtgcctcactgcctttagttccctggtctgcttgttcgcttgcatagtcttcaccccttcccctttctcttctggttgtatgtatccataaagtttctccagagaaacaccagcagggggatgtgtggagaagggcaaggagagagatgggtgggtgagacggagaaagagaggttgagatttaattcacagaattggtttacatgattgtgggggctgactaggcaagtctgaaatttgtagggcagaccagaaactcaggcaggaattgatgctgtggtcccacgttagaatttcttcttacagaaacctcagtttcacttttaaggtctttgaactgagtatatactgcctgtccagagtagcaagggtaatctccttacttaaagtcagctggttgtagatgtcaaccacagctacaaaatacctctacagcaacacctacactgtttaatggagtcaccggggactagagcctggcccaggtggcaaataaatgtggccaccacagtgtacttcacattgtaacccccaccctggttaaatcttgccttgtgcatggccatggccctcaagcagacccttggtaccaccaagcaccatctccacaaacctgcccacatccacgtctctactcagcctcccctgctgttcccgaggacgcctcatccccaccaaagtgcccatcctggtgccagctggaagccacctcctcttccctacccagtcactgccaccagggaccttgaggcaaccatatctggtggttgaatctcagtcctcctctgacttggccctgtagcagcatctgatgctttctttgcttgccttctgagataccacctcactcatttctcctcctgcctcactgattgtctcctgatcactatcatttctaaactttgcagactccagaacttattctcttttcttctccaagtttagacagtgtcacagtgactccatcccatctcatggattaattactgtctagaagctgatgtgctccctgcttgttatctccaacccctagctctctcaggcacgtgtgtgtgtgtgtgtgtgtgtgtgagcgtatgtgtgtgtatgcctgctggacatccctgtttggatacctcatggacacttcaagcttgctacatccaaaattaagctcctggttccctgacgcaagcccctcccccaccacagcaaacctatttctgctaagtcttctctatctccataaatggcctactctgcttttccagttccatcaaccaaaaaccttagattcatccctgcccgattcctttctctctcatgcccttcatcccatccatcaggaaatcttgttggctccactcagaatagatccccaatccaacaacttctcaccccttccattgctgccaccctggtccaagccaccatcactgtctcacctagatgttagagggactcttaatggataaatcagatcacaccgccctctgtacagaagcctccagtggcgtccagtcccatgtcaagcaaacagaggcctctgtaatcacccatgaggccctgcacggcacgtccccactacctgtctggcccacttcctcccacacccgcctcatggctctgccccaggcacactggccaccaaccaagtttctgcctcaggacctttgcacttggtgtcctttctgtcaggaatgctcttcctgaaccacagaacttgctccctagcttcctgtaaatctccagccaccctgtgctaaggaacaggcccccgctggtctcccttactctgctctagtttctgcataacacctgccagtacggacgtcctctagatttacttgtttgtttgcttatttgtcctgattgaaacatgattgaccatgagcggatacagagcagaggaaatctctgaaatttgtcctctctaccatagaatgtaaactccacaaaagcaggaattttgtttttcgatcactgctttgtcccctcaaaggagacgagaatccttagcaagctttcacttctctccaaaaggctcccccgctgccatgctgttgttgctagtatgttatttcagctttccttgagtacagatttcaagggaaccctccagcatgccatgttgttctccagccacactcaactgctcagccgcaagcgtggagaaggggcgagttgcatttaaccagggttggagtttactagacaaatttaataaagggagaggggaacaaggcaaaggtggtgctggtggatcatgaaatctaagctaagtccaaggtcgatgtgatgtgggtgaaagacatggcaggagaggaccttttttattttattttattttattttatttttatttttatttttttagacatagtcttgctctgttgcccagactgtggcacaatctaagctcactgcagcctccgcctcccaggttcaagcgatgctcctgcctcagcctccctaatagctgggattataggtgcccaccgccacacccggctaatttttgtatttttagtagagatagggtttcaccatgttggccaggctggtcttgaactccttgtatcaggtgatccgcccgcctctgcctcccaaagtgctgggattacaggtgtgagccactgcgcccagccgagaaggacttttaaaatgtactttcacctgggtgtggtggtatgcacttgtagtcccccagctatttggaaggccaaggtgggaggatcacttgaggccaggagttcaagactaacctggactacataacaagaccccccccatttctttttttttaaaaatgtgtttttatagtcagtagagagagagagagagagaggagagagacagatatacatacatatagataaagtttatgtatatatagttatatagttttatacacacaatatgtattacataacacttttttttttttttttgagacggagtcttgcgctgtcgcccaggctgtagtgcagtggcgtgatcttgactcactgcaaactctacctcctgggttcaagcaattctcctgcctcagcctcccgagtagctgggattacaggcgcccaccaccacccatgactaatttttatattcttagtagagacagggtttcaccatgttggccaggctagtcttgaactcctgacctcaagtgatccacccgcctcggcctcccaaagtgctcggattacaggcatgagccaccgttgccaccgcgcccggcccatgacacttttaaagtcacctcggtcttgtgcatcttttgttgctgacaggaagtctactctcaagccggtcgttgttcgtttgtaggttgtctggctttccctcttatggtttttaggattttattttttatcatttatagtctatagagaatatatctgggcctgagttttagttttgattttaaatcttaacacctggtaggcctgtgcaatctgaagatgaatgtctttcctcatttctggaaaattcttcaaagattaactctaccccttttctctcttttctctctttctagaagccgtgctggacatatggtggtctttcattgtatcatctgtctcttatcctctctttcttgcattccttctctttctctttttgtactatttcataggagatttcctcctccctgcctctgctcatggccaatcgtgtttcacctatattcctcctcagattatgttgaagtcaatcctagacatcatatcattttatctgcaaatatttcagtatttgtctctaaaagataaggattatttttaaaaacattgacagtagttccttagtatctagccagcgttcagatatccctgaatgtcttataaatgtttttgtattattgtttttccaaataaggaaccaagcaagatcaagactatggatttggttgaaatatttagctctcttttaatttacgattcccttcatttttttaaacttcagtctatttattgaataactgatgtttagtagaaaccatgtttatggtgctgtagtatttcccacagtctgggttttgccgattacatccccattgcgtttaacatgcccttctgtcctccagtattttctgtatactggtagatctgggatggcgctgtccattaaggcagccattagccacgtgcaactattgggcacttaaaatgtggcaagtcagaattgagaagcactgtaagtgtgaagtccacaccagatttcaaaaactacctacagaaaaaaggaatgtaactgtctcattaaagttaatttcacctttttctttttactttttaatgtcattactataaactttaaagtcactgtgacttttattatgtttctactggactaaagacttgatcggactctggttcagtttttccctctggggtattattacttctgatactccaatagtaataagcatgcctagtgctcagatttgggtttctatataccatttcccataaaaagaactagggcttcttgggaaaattgctcattctaggaccctagggcaagggcagtacaaaatgagtctgggacattttcttagcacaaaatgaatggggacctgccaagaagatacaagagccaacttgaagggcttcccctggccaaatttgggacattttgagcattttgagcctctcaaaacataacagtagtggatgacaatgcattttgatttcaaaaagaatccgtgggctgggtgcagggctagcgcctgcaatgccagcactttgggaggccaagacaggtggatcacctgaggtcagaagttcgagaccagccttgccaacatggtgaaaccccatctctactaaaatacaaaaaaattagccgggcatggtggcatacgcctgtaatcccagctactcgggagaatcgcttgagcccgggaggcagaggttgcagtgagctgagatcatgccactgcactccagccttgccgacagagcgagacaatgtctcaaaaaaataaaataaaaaagaatccatgggtccatagaaatactgaaaataacaattggggtcagggagaaggggaagctctacagaggaatgccaactaataaatgtaaaggccatgaattaaaaggctagacttagaatgtcaccattttatacccagtacattgattattgttccaggcaaggactatcaataaatgctgaggttaattggtagaattaacatgctacagattacttatcaattgcaaaggaaaaggtacctttttgatggccggaatctggcagccatcatcatcaccacgtgctccaacttaatatcaccaaaagtgggacagacttgcacctcctgaggtaattccctgagaaggacacaccaccactgatgtggtattcttgccaaaaccattaagcctgaatctaatcttgaggaaacagactaatccaaactgaaggacagtctataaaataacccaaacccttgaaaaatggcagcattaaaataagacagaaaagacgggaatttgtctcagattaaaagagatggaagagacctgaggactaaatactacatgtcatgcgcaattggatcctggaccccaaaacaaaaggctataaaagacattactgggacaattgggggaatttgaatatagactaattattggataagaacatcatatctgttaagtttcttgagtgtgatcattgttttatggttatttaggagaatgcttttgttcttaggagatacctgtgaagcgtttagaggcagcatgatgtctgcaacttacttgactggtttcaaaaaaaaaatcatgtgattgtatgtagagagaggaaattgtggcaaaatattaattggcacataattgtcataattgtcttttggtgacaaacatgaatcatacttagatcatattacttaattaaggtttgacaaaatgatgacatgctattagtcttcatttagtagctccagtctttataccttaatgcagaataaatatttgattctttccctttatttacctgaatttttattcttgcttgtggtcaagctgtcccttctttgcccagtgggaacctcttcaggttggcccttgagtgcttttaacgtgaccccggtagtcttagctagctagcatcctcactctctggtacaaggtgtgcctggttcctcttgtgtgtttcctgtcccagatctgcaatcagccatttctctcaggagctcttgttccttttagcagtaaatcaaacagacctgttttaaaaatccctttcaggttgctgtattgtgtcaagtttcacaggaaggaatatgcctgtgtattggctatttactgtctttaatggtgtggaactttttcatgtgattcataatttctatctgagttcaccttcctggggagttttacctcctaggtgcctgctctgaaccacccaaaaggatgttgcctctgtgtggatcccacaggcttctcatgccccaaaccccttttgactggggactagttagtggggagaaggtgattaaagggacaacttggtttccatcccatgtacttcggtatcattgattcttttatgagaatgtatttccatattgattatagaattataagacaaggaacctacaagccacaggttggagggtgaaaacatgagaatgccattgacctgtcaaagcaggaatgattattttgtctttctttgcttttccaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcaggtaaggggaaggctggagtgagtgctgtcaggagcacgtgatggccctttctaagggtgcaaggccgtagttcttgcagtctccctgggcctaggcggggttgcttcttaaagtgttgggaagatcttagaaatgaagcccttggagtcactggagatggtgaaggtctgcttgccaaggctgatttgagatgtaatattctaactgcacacaaatagaacatctgaggacctcaagcctattggccttcagttaaagagctgcagaacttagacattgcttatatttttattgtgataaaatatatatcacatacaatttaccatcctaaccatttttaagtgcggagttcagtggcattaagtacactcacaatgttgtatagccattaccaccatccatctctaaacctttttcttcttccctaataaaaactctatacccattaaacagcaactcctcaatcgcccttccctacccagcccctggcaactacccttctactttctgtctctatgggtttgacaactatagggacctcacagaagtggactcatgtagtatttctccttttgtgtctggcttttcaccgagcatgatgtcctcaggggtcatccatgttgtagcatgtgtcggaatgtccttcctttttcaggcagaacaatatttcattgtatggatgggccacattttgtttattcattcagccatggatggacatctgtgttgtcttcaccttttggcaattgtaaacaatagtgttatgaacacaagtgtacaaatatctgttcaagtccctgttttcaattctttcaggcatctacccagaagtagggttgctagatcatatactagttctacgtttaaccttttgaggagccaccacattgttttccagaccttgcttatattttaaaagaaaagcaaactgtgtttacccttagccaatagaaacgtgttataactcaggcctgaggggatacgaattttctgcccatcatagcttgctgcatcgttaccaatcctggttcttagaattgtctttagaggactccagccactggctaaaacggctccctgtcagctcagtatcctgaccctcacagggatgcatgccacaggtactgcataaattaagagaaaaacttgaagcaagccagggggttcctctcccaacaacctgtcctggcactgttggctggtccgcagcatcctcagccggcccagcagggttggagctcttctgggcttgggccctggaaaagatcacttataactgacccctagcagttgacaagatgctttgccctgctgaagttttcacctaattagctcctcgttgggtgaccaggggctaaacgatgtctctttgctagtaaatgggagaggtggggtcaaagcagattctccaagtcccagactctgcactcagccatgctgatgtaactggagccctgggaagggccctgctgctctttgttaaatggaaggttgggggcatacaacaaagatttgtgccccaggtgtggcggctcacacatgtaatcccagcgctttgggaggccaaggcaggaagatcccttgagccaaggagttcaagaccagcctgagcaacatagcaataccccacctctacacgaatttttaaaagccaggtgtggtggtatgcacctgtagcctcaactgtttcgggacgctgaggcaggaggatcgcttgagcccaggattttcaggctgcagtgagctgtgatcccaacactacaccccagcctaggcaacagagcaagaccttgtctcttaaaaaaaaaattaaaaaaacaacaagatttgagaataaaacagcacctctccactcaccacagcatttaagaaacaacattactggcatgtgtaatgtgtgcccatcctcgatgccattgctctcttcttgtagccatggatagcaattctgaatttgggtttatttccatttgctccatgtgtaagcaatataaagtattggattgcatgttataagattttatacaatgatatcttattgaacagatcctcctgcaacttgcttttttccccagtgttatgtttttctttattcatcttggcatatgtaactctggtttatttactgaaggggcagagtggcttagtgggtaagagtgcagaaagtgattgctgtgttgtattgaaggaacattttccaacactgagatcaaaagattatttaatgtactttttttcctcaaaggttttaagtgttgctttccacatttcagtctttaatccaccaggaatttatgtttgcttatggtgtgagatagagatctaactttcttccatgtgtataaccagttcagtgccatttattgcataatccatcctttctgcatcgctgcacaccatctgcagcatgtcttaggtgtttgtgtcttacatgggcctgttcccaggctctcccctctgccccattgacctccctgtctgcccatgcagagaagctctgcctttttaggataagtctcagtgtaccgtagataaatcacgcccccaaccaatttcttcaaacttcacttggctattctgagccctttgttcttctacatatgtttggcttaaccagttccttgctaaagccagctgagactgctgttgtaattgtgttgaacttgtaggtaattttggagagaattgacatctttcccatattgagtgttcctgtccataaatatgggatatgtttctgtttatctcgctctttaatgtcatcaatagagttttatactttacttcgtaaagattttgcatatctcgttaaatttatttgtatgtacttcgttttttgttatttaataactttctattacattttcagttattgctaatatataagacgagttaatttttgtatattgatttttaattcagcaactttgccaaacgctaatattttctacatatttgcctgtgttttctgtgtagatttttctctcatctgtaagcgatggaagttcagtttcttttcaaatcattataaattcgtgtttatcttaccctaccactctggctagagcttctcatacaatgttgaataagaatgggaacgatatgattcatgctaatggtgttcagtgttggatgagcttctcttaaccagcaggctggacgctggggaccctcataagagaatatcttcctttagaatagcatttcttaagaggtcgtgtggtgtgtgtattcctatgtgtgttcacatggccaggtcactatcagaatagccagtgatctttttcagacatcttcctagaagtttgcgggctgcccttcacttacaacagagaatcgctgtcatagtgagataccatgaatgcaagtctattctatctctcaggtgtgatgggatagaaaaaatgtgttatcccttgttttgaaaccaagatctcttgattcttggttagaatgtaatacatagtgtgtctggaatccacatagctgcaaaagatggtgatctttggattattttaagaaggcatgaaaagcaaaggcattgcagcaaataatttcttcagtgcctcgaatgcgagggcaacaaagggatgcccctgattctctttcatacaggatcatgcactgtttgaattgtgataatttgtgacttttattttttctgaccttcctctgtcagaaactcattttaaccagcagtgccagtgtcatctttgagggcgtcgatatcaagaatggaactgaagaccttccctatgccatgaaacccattgactactacacagagactaagatcttacaggagagggtatgtaccttggaactggttgagtgagcagactgaagggtttagaatcctaagaaaaatgtttatgaacttatgaagtttgtattctgaggcctacgtacctgatttgagatgtaaaatttgtgggtgaaattaaatttaaaaatactgtgagaggccgggcacggtggctcacgcttataatcccagcactttgggaggccgaggtgggtggatcacctgaggtcaggagttcgagaccagcctggccaacatggcgaaaccccatctctactaaaaatacaaaaattagcccagcatggtggcaggcgcctgtaatcctagccacttgggaggctgaggtatgagaattgcttgaacctgggaggcggaggttgcagtgagccgagattgtgccattgcactccagcctgggggatagagagagagagacgctgtctcccaaaaaaaaaaaagttactatgagaacagctttatgtggccagacactgttctgagtgttttccaggagtattttccttgtttaaaggtcacaattatcgcatcatcaccagattatagatgaagactgtggtgcacagatgcacagagaggctcagaacctttctaaaactgtgcagctaggaggtggctgaccccaggcagtctgtctacagagcttacagcccaccctcaatgccatgggagcttcctcgcctgctatgggaatttacagcagttgcaagcgtgcagacaggaatcaggctggaggcaccttcctagtggcactctcaccccctcccttacttagaaaaacaaacaacggaaggatcttgctttattttaaggaaaaagtacttttccacttggcaaaacagcttcatcaaagggcacctgattttagtatggttggattcagccacggtcgctaccaagccttcaggctgctggggctgtggggcccctgacaactgctagctgcagatggggattgtcaccctgaggccatcctaagctgcaggccaggagtgctcctgagcctgggatagctcgtcttagctgggtagctgtgagtatacccctcccaggtgtgtgcagtgtatcacacccactgaggttttctcgcaaagccggtacatgctgtactggagctgaacactgacctggctacctgagagccagctgcctcctggctgtttgccgtattttttttttttttcttttttgagatggattctcactctgttgcccaggctggagtgcagtggcacgatctcggctcactgcaacctccacctcccaggttcaagcgattctcctgcctcagcctcctgagtagctgggattacaggcgcgtgccaccatgcccggctaatttttgtatttttagtagagacggggtttcaccgtgttggtcggatggtctcgaactcctgacctcatgatctgcccgccttggcctctcaaagtgctgggattacaggcgtgagccaccatgcccagcctgtctgctgttgcttcagctcagaaagtcctggcagaactggtccacagggagacacaagggccacccagaccaggggtggaggcttgaactttggcaagccacagtcctggctccagactatgctgtcttgctccttggagcactcatgtgctcgaacttggcccaaggagtactaaagcctccctgcgccttgcaggcagttcagtcaccatggagaccctgtgtattctcaacccaatatgcctgatactgattgccaccagagctgagcccatctaggctcaggagcttcaaatgatggccttggcccagaccatcagtgtctcgcttatatcaacttttgggttctcaactggaaataagcaaagcctgcagatgactccagcagtaactcaccggaagcctcctttcagccgaggttgacatccactgttggctttataaccttcctactgatcataaaccaaatgtgatggggagctaggactccttcacctctcttccctttagtagtagagatgagccttggtggaagccatttgagggtttatttagtcatttcctccatcgctgtggggaccagagtcctggcgggaagaggagggccagctctgggaatctgttgagaggcagcttttccattgttgagttgcttaagatcactggggccaaaacatagaccagcactttgctaccatagagtagaagaaacccgaggtgacatgacagcaggaaccgtacttaccaagcatacagacacgcactgaagcaactcacatgggccatctcatgtaattcgcatgcagccccgtcagggtaggtacctttatgatcaccacttttacccacgataaaacaaatcctttggaaagttttgttacttttgaggcgaaacccatttcactgtgctttagactcttgagttctagtttgtccatgaagtcacacagaagtcaccctttccttgcggtggcaacaggagcactggctctggaccaggcactgctctgaggactttacatgtctcggcctcctttgccccccagctgctggcctgtttctccccaggcatggtcttcagacccttcaccttctctgaccctcttctgggcccacttgggtttctcagagccctcccctcggaggtgatactcagaattgcctggaacagacccggcctggtggaaacgtgggcggcacatgcagttcaagtcactggaggctcacggctaacttgtttgccagaacctttggacgttttccacaaactgctgccgaggcatgtcttctggcagtgttggtggattttagcctttgaacgcaaaccagggccttctgatttgatcttaccagtttttgcccagctgtctgtcctgcattttcagattttggtgtgagggtgggtggggtagagaggtagcccagaattataccagccactgatgtaggttgtcagctcaaggcagaccactgctcagtggccacatgccagcagagtgtgtcatctgtctgtcccccacgagtggtgcttctcacccagcgaggcactctcttggcttgggcctaggaatttgcaatggacgtgccccttctcccactctcctccaggcagttctgggcgccaacgatcctgagaagaatttcttaaccacagccatccgccctcatggcattttcggcccaagggacccgcagttggtacccatcctcatcgaggcagccaggaacggcaagatgaagttcgtgattgggtgagtcagcccacagcggctcttccctagtccttcctggtccatgctcgcattcagagagcacttggcaggagccacatggcattgtagctcttttcttatgtgactgtcttggtccatgcaggctgctgtaacaaaatacctaagactgggtaacaaacaacagagagcttggaggctgggaagtccagatcaaggcgttcccagactgggtgtccattgaggccctgttcctcatgagtggcaccttttcaccatgtcctcacatggtggaaggggcaaacaggctcccttgggcctcttttatgaggacactaatcccattcccgagggcagagcccccatgacctaatcaccccctaaaggtccctcttcacagtaccattgcactggaggttaagtttcaacatatgaatgttgcggggatgcaaagattcaggcgatagcagtgaccttgtccgctgtcctctgtattcatttcttgtagttgccataacaacctgccacaaagtaagtgcttaaaacaacaaatggattctgtcacattttgggaggccagaagtcctcagttaagatgttggcagggctagtgtcttctggaggttcgcagggagcgtctgttccaggcctctgccctagcttctgctggcttccagccatccttagcattctgtgcttggagaggcatcactcctgcctctgcgtccctttcacatggctgtgttccttgctttctgtgtccaaatttccctcttataaggacatcattccctggatttaaagcccaccctaccccagtatgagctcagcttaactaattgcatctgccgagcccctatttccaaataaggtcacattcacaaggcccaagtggacagaagctttgggaggatactgttcaatccagtgtaccctctcaggtaggctgggaaggtatttgtgaccctgtttggaaattgaagaaaccgtgactcagagggaaagcaatgggccccgggtcaaaggccagggcttgactgtccttgcatctgggaaggcaggcgggggcattacttttctcctcgggttaagtgcaggtggaggggcctccacaggggacaacagtgtgcctctctcccaaataggctttctcttccttcatttcctccttttctcctctctctcttccttcctttttccctctgccttgccttcctgtttctcactcagcctcactgctaccctgacttgtcaccttgaaggattacagggagactggtcaataaacggaggaccagagcaaggcgttggccccgtgtctcctgggaaggggctgaaaagctgctacccaaatcgggacaggagagacagcaccagtgttggccatgctggaatgggtgggcaggtcccccagctttcagattccactaaccctgaagacccaggagtcccggcccagtgtacatctttaaccagtacaggcatccatgagtgcctgggccggccttgccaagtgaggtggcagccattctgtaggtcacagtctctcaaatgccaagacttgggagtggccctggccttcgtgcaggggctcccagcacgtattccatcatcccttgtgcacctgcagaaatgggaagaacttggtggacttcacctttgtggagaacgtggtccatggacacatcctggcggcagagcagctctcccgagactcgacactgggtgggaaggtaaggcctgctgcaccggtccctgcacaggtgcctttctgcgggtttcttctccttgccattggatttgctggcaagttgctcctgtgatcctgtatcatggaggatctgccttaggaccccctgtgccaagatcaagcccctctgatagagcatgtggtgtcactgcagcgtcacatcacttgggcagccaaatttggagagctgacgagctgggattgaacagacattcaggtcacggtcatctatggtcccctgacctggctgcccacctgttggcatggctccttgtggcaggagcccacgtagattgggcagggtgcttgctcctcaccctttctcccactcattcctcaggtctctccctcccttgctgtttggtcctcttttattctcctgaacctctgccgtttccccactgataaccttcaaataagttgggaatagggtgggtgtggcattttttttttctttttttttttttgagacagtctcactctgtcaccctggctggagtgcagtggcgtgatctcggttcactgcaacctccgtctcactggttcaagcgattctcatgcctgagcctcccgagtagctgggactacaggcacatgccaccacgctcagctaattttttgtacttttagtagagacggggtttcaccatgttggccaggctggtctcctgacctcaggtgatctgcccgcctctgcgtcccaaagtgctggggtgacaggcgtgagccaccgcgcctggcccgggtgtggcttttgatttaaaacaagcagaacaccgtcaagaaatgtaatatgaggaattcattgcatccaaagatatgtagatgagttttatgatgattaacaattatcaaattaacaaatgtgcctttccaagtgcaatctatgcttcatttaaaatcctggcccatagatgaaactttcattgtctgccctttctatgccttagcagttgtgcaattgagggcaggccacgtggaaagctgcagcaattaggcagtgagaatgcgatctgcacgggcttaatagatgcttcaactttgggcaggtgggggtggtgtttctaacttcttgttcttgttctcccgccaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtctttttgtgtctctctgtttaccccctcccttgccccctcttctggtttatacatttcattccagtgtccttgtacataatcaaggaagctgtaggaagctacaacccatttgttagttctgatggagaaccatttccatgcagaccaatactagagtgaagcctctagactttgttcaagatactctatcttcaaaatatcccagaagaaaaacagaagctgttaacacacaggtgagactttacatatacatttcatactgacagtgagcttagagcaaaagctgaaagctgaaatgactgtaattcctccccagtctctgttgcttgttcaactccttacatgttccacattctctttcaggtacgttgccgtgcctgcctgcattgttttttgttgtggtcgttgtagagacagagtctgagtgtgtctgttgcccagctgagagtgcactggctaatcacaggcccaatcatagagcactgcagccttgaactcttgggctcaagcagtcctcccatctcagcctcctgagagcaaatgtgcgccgccacagcaggcttgcactgttttcacaaaacatttctcttatcaacagagttctgttgttttgagaggcaaggcagtgatccagcccagtggcaccctgtttcatctgttcagctcctctcctaatgtgggacactgggctgggcgacagtaagccagggagcaggaggggctccttccctgcagctcaccctcagaacccttcaggccagtttccaaagggcatagcgtagaggataattcctcggaatgaggagagactgtgctgccctctgctgatggggcagggggatataaacataaataagacagcctttgcccctaaggcacttagaatcatggacttaagatatgttcgcaagcccctgtaatgccaggcaggacatgatacacacacttaagacgcagtggtaaatgttcagcttctgtcgaggaggtgatgccttgagtcggaccttgaagaatggataagcagtgagacttcactgtcgaagttggcatttcaggctaaagatgtcagagggtcacagtcaatggcatgtcatagtttaattagcagcacgttgtgtttcttaggggtccatgagataacggtgtcttagattcagtgaaggacagacgtgccagcctggtttggctgatggtgcaaagctgaaggggatgtacttttatctcccaggcagtggtggccaagaatcaaggaaaccatcgtggctcttacgtggagccttcagacaagaagcaacaaaggcccacgcgatgatggagttgggcgggggcggtagggttgggggtagaaatgaagccttacaagaaatggcctggagggggtccgcgctcagcacctgatttcctgtggggagtgagagggagggaggaggccactcaggctggaatgaagccgcagagcagctctaagctggtgggaggatggtgtcgggcccggagtgggtgaggccagcagaccttgctgatgagcaccaaggaccaaactgccctcagcttcgacctaaccactcgctcagaaaaatactagctgccatctagaccaaagatgtccctcatggaacgtcttctctgccctctcttcactcattagaccacagataatcgttgggccctgccctgcgcttcagtggtgaataaaacacgcagcccacagaccaatagattattcaaaactgctgaagtttccaaaaaagaaaagtgcagggtgctatgagagggacatagggctgcaagcaagcctggcccaggtggcgatcacggcagaacagttgcagaaacagtgcctgctcagatccgaaaggtgaggctgtgcacagagaccctgagccccccgctggccaagctgacgacctcccagccgctccttgtatttccctgcattcctgacccacacctatctcgacccacccgtttggagaaagtctaaccaccaggaaaccataacctcagtacccgctgagagcttgttagaaaccatcaggccccaccccggagctactgaaccgagaccctgggcttgggccagcactctcttcacaagccctgtggatggtttctgaccagtgaagaagccttcctgcagatcactgagtccagctagaacctccccttggctgctgcaagactgaacttgccctactcacaggcccagggcctgggggccacccccacccatttctttcctgacagctgatggcatcctagagtgcggacccaggcctatgtctgtccctcgtgtcacatcccatctggagaatcggggccaagggaaggcagttctctcccagattggggacagctagaagccctattgccaagtgctgcgtgtcctttgggatgatcgcattcaatccctcttccttcccttccctatcgacactgacctagttcagcacctgaccccatctgcacctaggtcaggtgtcctgggacagccgacctgatctgtctgcttactttcgcccctcctcccatccagctgctatgtgtacacctagggtatccagtctctctgctaaaaacactaaagcagggtccgattttctcccagcccacatttccagctccttccactggtcttcacacctgctgtgttgtagccaaatggaaccacggtttcctgttcacgccctgtcatgcatcccctgctcaggctgtcatgactgcatgcgatgtcctctccccactgtgtcccagctccagaatggcccgttcccttcccctaaaaagccatgcctaatcctcccagttggaaaccacctcttttctctggattcccagcctggggcccctgacctgtacctcattttgtgtttcctatttgtgctttttcctgcccccaccaggccaggagttcttaaggacagaggcaatcagtgtccccacagcatagtgggtgctcaggaaacctccctgtcttggaatcctggagtcacagtagcaacaaaagaaagtggtcccaggaatggggaaaggcacagcccatgagactgggttgaagcagagagaggttcccaacctgccattcagatggggcttgaggagtctgtgaactccctaaattcgatgcagcctctgggggtgtgggtgtgtgtgtgtgtgggggtgtgtgtgtgtgtttgtgggtgtgtttgtgtgtgtgggtgtgtgtgtgggggtgtgtgggtgtttgtgggtgtgtgtgtgtgggtgggtgtgtgtgggtgtgtgggtgtgtttgtgggtgtgtttgtgggtgtgcgggtgtgtgtgtgggtgggtgtgggtgtgtgtgtttgtgggtgtgtgtgtgggtgtgtgggtgtgtgtgtgggtgtgtgtgtttgtgggtgtgtgggtgtgtttgtgggtgtgtgtgggtgtgtgtgtgttggcatgaaagggcacatggctttcaccagcttctcaaagaggactgtggcctaataaaaactagtgagtggagggggccagcagctgtcgggggaggggccaggagagacatgccaagggcagagtggggctcccaggcctcatcgtcacccctgtgtgtgtgtgtggctggctgttccatcatggggtccatggcttcaaaacagggaagcactggaatccacgaggaggagggcttgccagacaggatggcaatggttgaggcctctggccccagccctctgggctctggtgcccattgcccctggaagattcttagctttctggatgagacagcccttgctagtagaaagctctaccttctgctgaactgaaacaccattggatgtgacttcccttgtcctccctcatttcctccctcaccaaaccccagcaagtgcagcttacacaggcgctattccctccggtatcccgcagctcatcagcagcactgtcctctgctcagctcacctgcctcagggcacctggtcctgcagggccagccactcttcttcaaactccatctccaacatcatttcttctttgcagctgtcccccacaggtctctctggcttcatacaatggctggcctacatctccatcaaagcacttcctccatcacagggcaaccatccacttagctgcccagatagagctctatgaactgctttgctcctcaagggcttttgattcgttacctgttccagggaagtaagcatgcccagttcatgtgccaagactccaagggcatttacaggagaaagccagcaactcattggcaatctgggggagccccagagaaaagaggccatggccaagggcactcaagggcagtcagcagagccagggctggaccactagctcctgatcccccaggccagcgcaccccaggtcacccattcagatccaggcagcctaatgccacataggtgcccatgtgggaaggaggcagtcaggatatgggctccaccctgaggttctcttaacatgaagggctgaaaaagcacaaatggatcattaggaactgtgagaaagaagatatgttggcagacactagaaccttccattccagtctgtatctcttgtcaccagcactgcctagtcattgatcgtggaaggctccaaaagatggtggacccaaagtcgagactctttgccagctctgcctcttaccggctccaggaggtctgttcatattaactcattcggcccagagaatttcccaaagaactttctagagtgactggggtaggggagaaaaggagggaagaggatggaggcctctcagcttcttttgtcctgtatcacagcctggctcccagcaacacttttgggatgcctcttgtagcaggtactgggagacatgcacaccactggctttgttctccatggtgggcagggggaacatcaattcaaaacattttaactgggcacctgccatttccctcaaagagctcacagtcccatagaagaaatgaaatgcagaaattaataacccaagcactccttcctttaagagcagaggtcagcaaactatgaactcaggctccaatctcgcttgccacctgcttttgtaaatacagtttcgttgtcacacaaccacatccatttatttacataatgtctaagactgccttttcactacaatagcagagttgagtagttatgacagaggccatctagcctacaaagccagtcaaaatattgactatcttgcccttcatagaaaaggttttgtgatggaagaatgaggtcagagaaaaaaagaagaaaaggaaaggtttgtcaacctctgcttaagagggactgagaggccacgagcacacgatgcttagcatcactaatcattaaggacacgcaactcagtaccacgatgcgacatcgcctcatcccattaggatggctactatcaaaacaaaaaaataggccaggcacaatggctcacgcctataatcccagcactttgggaggctgaggcgggcagatcacttgagatcagaagttcaagaccagcctggccaacaggatgaaaccctgtctctactaaaaatacaaaaaattagccaggtgtggtgacaggcgcttgtaatctcagctactcgggaggctgaggcaggagaattgcttgaacctgggaggcggaggttgcagtcagccaagatcgcaccactgcattccagcctgggtgatagagcttggacttgataactccctggagggtgacatggtgacatttgtgtttggatggtggggagagtgcagggagagggaccagaggtggggcgccagtggggaactacctctagtccaggggagagacggtaagagtgtgtctgtcctgaggaacaggcaacggggctatggtgcagacgtaatgaagagatgattctgtgcaagaatggaccatccatgatgattgattggatgtggggctaagggaggggaagggataaagagaactaggaggctgaagcttagaagaattggtggccagccatgccttctgctgagctagggacccaggagaggatgagatataggtagcagcaaggaagaagctgaattccattctggccataatgagttgaatgaaccttgcagtttccaggtagaaaagtctagaaggcaagagatagttatttcggacatcttggcttattgctgctaccgaaagccacaggaaaagcaggaggatgaaaaaaatgggaccctgagaattaagaagtgaacgaaatacccaggtgtcaaggaaagctagggaggagggatcaagcttgagaggatggtcagcagcgtgggtggtgctgggaagttaaagaggctgaagactgagcaaggaaatgtccctgaaatctaacactgaacacccactttataactggccttgtgctgggggtaagggccaccgtggtagacagtctatccaagagcctttccagagctcctgatctagctaagggaaagaaccacagttgatgccagctgagctaagcggccccagggaagctgcagcacagcctatttggcagtacacttgtgcccagcgtggattttcataccctgctcatggacttgtgtcctttcttcatcctcccttccatattcttccttgatggcgctcttctcaaccatagattttcttagaccttttgggggcccttccagcttctgacccagacagtgctagccaggccgtgggcactacaggtttgttgagtggttttgatgggagcggattagaggaaaaaccaaagatgaatgctgagcaagatgataggagcagggttgtgggaaggagagtgcctcctcagccagccagtgccttcccaggtggtcaagcactttctccttggatcctcaacaagcctgttgagtccagcaaggtctcccaatatccccattccccattttgtatagggaagcccaaagtttcagacagggaaaggggcattctgaagatgcacagcaagttagggacagcatccttttcctcaatggccttctactctcttggaataatgttgagtggcctgaactccttgcctctgtactggctgggaacactggatgtactcctttcctatgactgctgtatcagattaccaccagttgagtggcttaaaacaatgcaaatgtattatcttatagttgtgggggccagaaccccaaaatcagcttcactgggctaaagtccaggagttggaagctctgaggcttctggaggctccgagggaggagttccattttctttcctcttttgagcttctggtggccgcttgttttccttagcttgtggccccttcttccatctttgaagcacattactccaatctctgcttctatggtcacatttcctgctcttcttctgtagtaaaatctccctctgactttctcttatgaggacacttgtgattacacttagggcccacccagataacccaggataatctccacatttaaagatctttaacttaattgcatttgcaaagtcccttttgccatataaggtaagaagagtaacaggtctcaggggttagaatgtggacatgaagctggctaagagaggcaagcccttgggtaaagcgtcacctcacaaaagaccctgcttggcttcagtaggctgaggaccttgaggaaactctgctagatcactacagccctgtctgccagaactatccagatcgttcactgggctggtttggcaccagctagtgattgtgaaaactgaacagaagtcaccaataggatggtgccaacttagtgctagaaaatgtgggaggatcggcagggcaggttcacaaaggcccgagaatccagcggcccaggtgagcaagtgcctgtcccagcactgcctccaggctcgggactggggcttccaatcctgggtctggacttcaggtcctgcaggggagggactcagacttacacatcctctttgtaccttgtttgctgctgggattagaatttaggggagtgaagttcagggacgaatctaaggcctcccagccaaaggccatctagccacagcccaaacaaaggggcttccaacatggtcctaggtggcactgagaccaagcctgcagagactgggccctgtgagagaggcaaggcaaggccccagggcactgcaggctgttcaggtgagggcacctcatgccactgtggaaccaggagctcccaaggtccctgttctgtcagcatgagtgtctgattgctcccttcttcaaagccggctctggctcggaacgctgggtgctgagacactgcctttggtgagcatgggctgcttaggagctttagagggactcctgctgaactggggggcctctctctgcaatgccttctgccctgtctgcctgcctgactcccacatgtatctctatgggctagtagcctggtcgagtgaggctccctctgtgcctgtccagtttggcaccagctaatgattgtgtccaggggctctggacctgcctctttctagaccaaggagtcctcaaaggcagggtctgctgggagcctccctgtgacccctgcagtaccagcacaggcattcgtgccatgagttgaatagaactgaagagaagggagaagcttcccgggggtgggcaagaggaggcttgagagcccaggaataatgataaaacagtaacggcccagggctaaaggaatcctccagaatccgagttctgtggatctaagttggcctgggactgcctgaggatggggcaggccctgcccagagccctcttggagccagcctccagcacctcctcagcctgaccttccaccttcagtgtttagagctgagagagcaggctacggggcacataggtcagccctgcattgcttacacaagtgggccaagactccaagaggggctgagatttggccaaggtctttgaagaaggaatgcccattcatgaaagaagagctattacaacttctgtctcttcccagagtcttctttccagctcttcctagaaaagcatggcctgctcagtcattctcaggttcctgtgctgagaacaggagtgaggaagggaagctcacaggaatgaagcacccactggccactggagatcagatgggcaccattatatgttggatagtattcctccaaaaaatatgttgaagtcccaacacccagtgcctgtgaatgtgaccttattgggaaggagaacatttgtagatataatcaagttaatatgagatcattagagtgggcactaatccaacatgatggtgtcctcataaggagagacagagacacagacacacgtgggaagacagtcacatggagatggaggcagagacgagtgatgcagccacaagtcaagaacacctggggctaccagaagctggaggagacaaggatcctcctctactcctgaaggagcgtggccctgctgataccttgttcttagacttctggccccagaactgggagataattcatttctgttgtttccagccacccaatttgtggtactttgttccagctatcctagcaaagtcatacagacactttcacaaatgtctcacaacagcctctcagccaggcagagatggcagcattggctccgtcttctcattctaatgtcaactccttgcattacctctccaggcttgccaccgccccaactgtgaataaacagtgctcctcatcttcaaagccctttggaaatactaattaactctcagctaattggatgaaagaacgtgaagctctgatgacatcatctccattctgtgcccagatctagccacaagcgaaatctgggactgctgggctatgagccttgtcttgtgggaacatgttgtgcccacgaaacatggctggggacggccgtctactcactttagctccatgggcttcagaaaacggccagctgtgggcacacttggccaatcaagcacgcataacacaaacagtttctgtgattaagagtttgtgtgggtgtgggtgtgtgtgtgcgtgtgtgttaatcacatacctttgcactctgcacatcactgagattgtcttattggccgttctaaacagaagcttacaaaaacatgtgtactttcaaatctcctcagaatgcatccctgtgatcctgagggcctgtgtaccccctgccttgtagaaccaagaagaatccctctgcgtccagggccccagggggtgagcatcagttgagctgggcaagtagctgcgtgcaaggcctggaggcaagagcctgcaagtcggaggccatctgagccaggagccagagctgagagagattccgaccaaggccagaagggcgtgaggaggaggtgcagggctggggctgtccccacgacagcagggtctttggtggacagacagcaggcatgctgcagtggacagggtcaggagacgagggttagaatcctgcctttgactttgccactcattaacctggacaacagtgacaggcccattccaggtctccctgactccgtgcgatctctccttcatcctccaccctgtggccaggagcaccatccatgcaccaggcagatctgctcctggcactgaccactaaaaacctcacccgtgtgtcccacgggatggacttgaacatgatgggtagtacaatgaccgtctttgttcaataacaaagaaagaaagaaaggccattcctgctcagttatctttcaatccttcagatcatgaaaaaagatcaaaaaaactaaaaaaaaccccaaaacctcagagttccatgctctcgtgttttttgactttgtattgaagcataatatacattttgaaaagtgcatgtcatacataagtataacgcttgatgactgcccacaaggagaacatatccatgtcaaagcacccaaaccgagaaacaagatggccactaccctgacatctaggagcagaaattagtttcacccatttttctgttttatttaaaagaaatcggccgggtgtggtggctcacacctgtattcccagcactttgggaggccgaggacggtggatcacctgaggtcaggagttcaagaccagcctggccaacatggcgaaaccctgtctctactaaaaatacaaaaattagctgggtgtggtggtatgtgcctgtaatcccagctacttgggaggtcaaggcacaagaatcacttgaacctgggaggcagaggttgcagtgagcagaggtcgtgccactgtaaatccagcctgggcgacagagtgaaactctgtctcaaaaaataaaaataaaaaataaaaacaagaaatcactctatatgtgctcttaggtgtttagctttcttccctcgacattatgtttgtgagctgcatccatttgtttctacactcattgtcattgctgtagagcattacattgtgtgaagacaccataaattacttgttccttctaccttaatgggcattagggttgcttttggctataacaaatagtcctgctctgagtatttcttgggtacatgtttttaaaaacatccgtaggctgttgagtgggaacctgaaagtgggattactaagtcagaaagtatgtgtgtatttggcttcagtgggtaagctgagtttcccaagtggttgtaccaatgtaccctccccaccagtaaaatatgagtattctagttgccaacaatcagtattttctgtcttcttaattttattttattatgttatgtatgtatgtatttatttatttctttttagagacagggtctcactctgttgctcatgctgcagtgcagtggtgcgatctcgggtcactgcagcctccaactcttgggctcaagcgattctcccaccttagcctcctgaatagctgggacaacaggcgtgcttcaccatgcctggctacttttttattttctagttttttgtagagaggagggtctcgctgtgtttcccaggctgttctcaaactcctgcactcaagcaatcctcccacctcggcctcccaaaatgctgggatcacaggtgagtgccactgtgcccggcctggagttgtttatttgtttgatgtattctggatgagggttttgttgaagatgtgtatggtgaagatctcccacatgttgagtatcctttcactttcttaacagtgtgttttgatgaacagaagtttctcactttaatatggttcaatttatcacatttttggtcacactcagcacttttcgtgtcacacttaagaaatctttggctgttgccagttcacaaagacactctcctatgtttttcttctaaaagctttattgttttacctttcacatttaggtctgcagtttgtgtggaactgatttttttatatgatgtgtagtaaggattcatagacatttttttttcccatatgggaacccaattaacccagcactttttgttgaaaggccaatcctattcctactgccctgccctgtggtgctagtgtatctttagcttctcaaacacttgataactctctgatttgctgttgtaagtgttaatgagttaaaacagttcagaccccagttatcaatcaagcacttatctaggtggtgttgtgaaggtggtttgcagatgtgattaaagtctttcataattgactttaagtatggagattgtcctagatcacctgtgcaagcctcagccaatcagttgaaaggatttaagagcaaagctgagactgccctgaggaagaagaaattctgtctgtggattgcagcttgggcccacgtccaagagttcctgcatgcccttcctgacgacctgccttatggattttggacctccccagtcagcccccaccaccacataagccaattctttctcatagatctcttaatatgtatctcctactggttttctttctctgatggaaccctgtctgatacatgcctccatctcccaaacaagaccgaaatggtttcaatagtaaattcactagccattcaccgcagactaggcgaagagggaaccctcactaatgggaatggaatggaggaggaaaatgagtctaatctcaatcatgaacatagatttaaaaaagaaaaaactctacaaaatcttagccaagtattcaaaggatcttatgccatgaccgagttcatgttggtatacactgcaattgcaaaccaagtcttgccaggccaactcatcttaatggaaatgatgaaattcagttgagaacagtggcaggccaacagtgaaacttttgaatgaaatgcactttaattcaatgtcctcatccttgaatgtcttcatatctttattatccttggtactttcatgccccaggacccaaagctgagaaaccagcttgaggaagcatcctgggcccacaactgatttggttccacccctacatctctctcctaaaactccctttctcactgtgtccacctcactcagaagcagtagtcctcagtccttggagcacacctgagtctgcagggatacctgttaaaaatgtgagctgtctcctggggcaggttagttgacctagtggactcacgtctctgaaaggttccagctgacttgcactggtatctaggctcacccactttccagctgtatggccttgggcaaatgatctccctgctctgaggttcagcatcctcccgtgaaccacatagcctccctagcccaaaggggagggaagagtcacagctcctttgcccaccatgcagggtgccgcatggtggtaagggcagcagccagtggggagcaagggaagatatcctttgggcagcctgagtccaggaaacacagctctgcctcgctcagccccagaaggagccacacatctgccaggatctcagcagggtcaacaggagcagccaggctgagctcacatctccctgaaagaaagacagccgtggggcgtttcctgctggggacaggtggagtgaagtccttgctctccttgcaagcagccgaacattcaaagcgaggctgacaagttcaagtcatcctctgatccttctagaaatatcctgctaaaagccaatcacatgttttctttcaaatgtgtcattttgcacagatgtttaaactctggcataagcagcaggttgcatcagcctctcttacatctaaggcctgcaggatcccaataatttaatgttgaccaaaggaagaaagcctccttacaaagtggcagaaagaagaggatcaagacctcaaggagggttttctcaggacacctactgacagaagcactgtgcatcatacctagcatgtagtaagccctcaacaaatattagctttattattagcattgttagcacagctcccacgaacagtccccgatgccgcatgtaagtggctaactgagcaatttgaacccagtggggtaataatcttggaagttaagagtccgggctctagagtaagacagcctaggtccaaatcccagctccaccactcactagcccttccgtgccatagagtcctcatctgtaaaatggggataataatagtatttacgtcatagggctgtagcaaggatggaatgagatgttttcagtagagcgcttgggacagcacctgacataaaaagcattaagtcaacatggaccctcaaatcacccccttcagctgagctttgtcaaatcggccttgcccatctattaacagaatcttgagcaagtttccgaagttactggtgtcttgcagttgttaaaactcagaccagattaaaatgtcaatctcagactcagtttcactcttccctgagcccctggctgctctgagaccctcctgccgccctaccctgtttgggaaaatcaaaggacactggctgtctcatgggaagggggaggagtgggggaaatacatgagcccttttgaaggctctttgagacttgagtaggtttctgctccttgcctcagaggcatcttaacaaaggtgactcctgacaccttcctgtaggctctttttgcgtgggggatctctttgaggggagctggttggagctccttcctggccttctctgatcatccaacacacactcaaccattcccatactgcctaggtgatgtcatgccctcccgtggcctcaaggggccatcgctagctgcctctgcccctacaagcttggcctctaccctggacggttcctctgagctcctcccctgtggtgtcctggtgtcagctcatcttatccactcggttgccatacaggccccacagcctcactgtctcccaagtgaaaatcagatctctatcctattcccttcccccaactgttacccgtggagtctctaattcctgaataaaagatctgtgcaagtaactgaggccagcaggcccctctgtctctccttcccagcccagactctctttgggcaaagctcattcctggctattatgcacaccaaacaccagtccttcaatttggggctggggcaaacagtttaactctccagtcttaggaggagaggtctcccttgtcgaagatgggagtggaggccagagaacggggagatgaaagtatatcccagccacgtaggaacatttctgctggtgcaagaaacctacatcaaagtggccacaagatgagctaatagaaggtggataaatatgagtccatgtttactgcactttatgtggaatcttgaccatgtagggagggaagggcctgcctgcgccattctcctgctcccacccctttttcccaagctgagcaggagcccccttgggtcttggggttgactttatagcatttgagattcttatctcttccttctagtcttttgaagtacatgatgacactctctccttcctctgccttttcctctggggaaatataagaaaggaataaagacttatttgtctggaaaaaaaccaagtccaacttttacaagtagagaataaactacaaacaacttcaatctgatggttgactttcactgacaagaaatttcctcctttcctctccatccccatctctccttccttccctctttttctaaacatctagcagcctccttaactgccctgtaggcatagccctggctaatacctgtgactggaggagctctcatccacccaaggtagacatcatttcaccatgccaggatgcaagctgtaggcgaggcctgaggctcaacagatcttggaatccccctctaaatgggtatggtctctgcagaattcaggctccccttctagtctattcttctgaggaccatctctttctatttttccgtcaacaccctctgcccctcctctgactccctctcccatcaccgctactcctccatcctctggctaccagtttttgcctcagtactaggtggctttttaccagactgaacccctcagggtccaggcctggctcaaagcaggtgctcaggacacaagtatgggccactggaagccctgtatcgtggggagggagcagggagtagggcttcaggaagtgtctgcaggagtgacttcatacaatccactacgattctgatattttaaaacaaataatatgtgtgactttttaaaatgtcatgtaaaaacacgatttaacttgtctttaaaatataccaggtatttaccaggttcgtacttgtgaacaaatattgtcttcatccaaacgttaagaatggctaaatgccatcatgttccctcctccaaagctaccctcttggaaaagacaaacttgtccaaagaggctgccttagtctagaacccaaaggacttgtcacctccataatttggagacacagcatgagcaagcttcgcctgccaccccacagccccgccccgagcctggcatactgggccattgcagattgggtggcaatactggcagacatctagttctaaaccttgagtttagaaacatgggcacttgcaaatggcatctctggtttctttctgtcctggaaacgatcatcgtctgttccctccaatgctcactgagcatttggtgcgtgccagcccccatacctgttacctaagactcagggaggaatataagctggtttctgccttctagagctcacgggctgtcaggtagacagaggaaaacccagtcaccaccacatgatgtgctcatgaagggactgagccacgtgcgttggcttggcagtccccagtagctcagaagggctgccatggggaggaagcattttcttccggtggtctttgagaaacaacctctctacactgacaccaagtacagcagcacctgcctgtgtcccttcacctgagtgaagtctttgtttgtctttgtttgttttaggtaaaattaattctttctcagttcagagtggcccctgattctgccatacaagtgtgtagtagataagttcacgttcagtgtcgctacgcctttctgattttgcagtctttatttccttctagctctcacctttacagacttaaaaatgctccactggaaacataggttgtttgctattggagttttttggcctctgacacccctttggctccttgcttgtgctcctcaggtttctctgggccttctggggggctggcttctccttcccacctgctttatagggaagacacattgctcttggctcaaggcaccacccagaagcagaaggaactctctcctgggcagcccagtgactggcacgggctcaacagcttgaaagctccccagccagaggaggtctggcacagattgaacgggcttgttgggaagtacttgggggcctcagaatggctgagtgggctgggcccacagcagcaggggctggcagggctggcttaagtgttaagaataactcttttctgttgttgtttttattagtgcttttttattacgaaagtaatacactgccataaaaattcaaagagtacagaaaggaataaagagaaaactcaaagcatcttcccagtcagcccacacaaacccacttcctagaggcagcagttatgatcagtttcatgtgaaacctttaatataatttttatacatatgcaaatgtaacaaatataagaatgcattttttgcaaattgcttttctttaaaggaaaaaagtatatgcccattttttaaaaagtcaaacactacagaaaacacaaaataaaacataaaaaataaaaacaaggaaaagacagctctcaaaatccatatcttagaagatagcaagtgttgacactctggaaggtgtttctcaaagcctttgggcaatttgacagaagtgaaatcacactatttacgctgccatgtaacttgctttgatgcaaactgctatttctctctttcattcaacaatatattattggcatttttcatgcccctaactagagatctaaaatcaacacctcgattggccacatagtatcctgttataactttggaatggatcttctgatagaaacttatcttgtaacgagttttttaaaatatcatgaataatgttgcaatgagcatacaggtacttagttatctccccctgatgcagttactacctgaggataaatgcctagatgcgagggtactggcaatacaaccccaaaccacactgagctgacactttctatccactgcattgagaaaatagaacacatctgacaacaccaagtgttggcaaggatatgtagcactgggaattgtttaggcaggaaagtcagtgttctgctgtcagattgaacatgcacataccctgtgacccagcaattctgccccaggatatattatatagatggttcatgacttaacaatggcccgacttacgatttttccactctaccatgatgtgaaagcgatacacattcagtggaaaccaaacttgaagtcccatacaactattctgtttttcactttcagtgcagtattcaataagttacatgagatattgaacactttattataacgtaggtttcatgttaaatgattttgcccaactataggctagtgtaagcattctgagcacatttaaggtaggccgggcaaagctatgatgtttggtaggttaagtgtattaaatgcattttctacttagggtattctgaacttatgatgcagttacatcccgataaactcactccacatctgggaatgttaaatgctgctgacatgtccagtaaaatgcaaactgaaaactgatcattggatttagcaacatagagggggttgatgaccttgacaagagccatttctgtgtagtgatgggagtgaaagagaagggaggaagaggactctgagaaagtgtagagaattctctgaaggattgttgatgtaaagggaagaaggggaatgaatggacagtagctagaaaggtgtatggggtcaagagaaaggttttttaaaatggtgggaagaattccagcatgtgtgcatgctgagcagaatgatccggtcaagagggaataattgatggtgcaggagaaagggcgaaatgttagcaagatgttcctgggtaggcaacaaatgggatttagggcacaagcagaaaacctgacctttcatctgcttcaggacacatcgttctcttgtatcaggatggggcagaatgtgtagataatggtgctgtggaggtaggggatgaagatgtttatatgcatctcatttaatataatatatatatgtactatttttgtatgtcagataataaaaagaattttaaaatgttagcattgttgagtccaagggatacctcatcattcattttgtggcatatttttagatcaccacccagaaggttgccctgacttatcctcccactctcagagcccctggggcagaagagtgcccattttcccacacgccaggtaccccagggttttgcagatttgttttaagttttacatacctgaggcaggggtggaaacagttgactttctttgcatttccttcatatgctaattggtgacccgcaaatcttcttttgtgattatctgttcacttccttggtcctttgctgattttcctactgggttgctttaaaaggagtccttttttattttcggaagattaagcctttcgctgtcatatgcagttcaaataactcttcctcatttgtcatttgtctaatgacagttatggtgggttttgccatacagaagtttttaatttctccatcttttatggtttctggttttcatgacatacttagaaaggctgtccccaccccaggattctttctcatacttttatggtttcattttttttacattaaatttctgagccatctggagtttattttggtgtggagagtgaggtaggaaatctagcttctttttccaaatggccagttattccaacatcatctcttgaatgatacacttttaatccacagattcaaaatgccaccttgatcacacactgcatttgaaactacactctatccctccgttcatcaatttggcagctgcttcctgtgtgcctactcaggcatcatactagcatgaggtgtgtttcctacatccaggaggaagggagaggagacacaggagacagcgaccctgcagggtaataagtgctagggtggaaggcggtggaagagacacttagctgggtcttggtggttagggatgacttcttgtgaaggcaatgacctctgaacagacatgagcatagtagcagttaaccagtgcgagggaccgcagtcagcactaagttctagagacagaatggaggcctatgttgggaatcagcaggaagtccagtatggcttccatatgacaggagcttagagcgtgaagaggctggagccatagcaggtactagacttggatggcagagggaatgaggagtctcagatggtgcccctgtttctagcctggactgctggacatggagtcaccttatcacccaagcagggcagaggggaagatggctctggctgctttgcagaaagtagatgcaggagtcaagcgcagaagccaggagactgggaaggaggtgatcggggacactactgtgtcccaggatagtggcagtggaagtggatggtttggagctgcaatcaggactggctgctggattggacatgggagacgagggaaagatcagttaaacacctaggccttgggaggtgcctttgatgatgaagaaaactgagggaggagaggtttggaaggtgaaggatggtggcacaagagtttgttttgaacatgtttcatttggattgactcagacattcatgtggtgatttcaagtaacaaaagtagcaatagtaaacattcactgagcaccaccatgtaacaaactccattccaagcactttatgcacgccatcccatgtcatctcacaacaacctatgaaggtagatgctggcactctcatctctattgtacaggtaagaaatggaaactcagagagggcaagtaacgtgcccaaggtcacacagctattaattggcacagctgggatttgcacgcagtccagttccagagtctgtgctcatagccttcatgcctccagataagtgggtgtcagggaagccaagagaagcaagtttttccagaaggggaaagtggagtgatcaactgtggccacggggtaagtgaaggcagaaatgtgaacactgggtttagcaacatggagatgactggtgacaagaatgatgtgaagggagtggtagggttgaagtcctgatccgggtgagtttatgagagaatgggaggagaaggagagacagtgagtctagacaactcttttgaggagttttgctcaatagcaaagtggagagatggggcagtaactagaggtgggagtgtggtcaggtgagattcttttttttttttttttatgttgatgggaaagctccaaatgaaacagacatttttatgatgtagaagagaaagggataattataaagagggaagagtctatgaaggggagaaggagtggaatccagaagtttatattggcaccattctgcacagttgcgtgacgtctgccagcatggttctttgccttggggcaagcatgaagaatatagacatttagctttgtccagatttgatgccattatcatcaggtggaggtgacaaagagacagtagggtgagaagattaggatgttcacaagacagcggttgagtaagctggatagggagggaaatgaagagaggaaaggactaatggatggatagaaagtggagcagccaacagttgggagcttgaaagatagttgtcacagaagtggttgaacgagcctgctggaaagagaggaggttggggcaagaagttggaaagcctgcattctctattctggaggaagcaacagcaggcaggctgcacctgtgggaagaagcggctgtggtggagctgacagggtcttgggagatgcctggggagcctgagggttggggatagctaagccacaagcatggatgctcaagtcacacactcactaccacacctcactgctctcaccctcaccctcccagtcactttctcacatccagggcaaagacctgcctgaatgtcaggtgggggatggtgttgccagttggcctgggcctcaaagcggggaggttttcatccaatggcaaactggactattctgaggtagctggggtgtgggagaaggaagagcctcctctggattgagctgccgggagggtgcctggcttcagtttaggaggaagtggatagctccctccaagaagggcagcatacggggtggtgcaatcctagaactttctgtgatgatggacatgtccactatctgtgctgtccaacacagtagccactggccacatggggctattgagtacttgaaatgtggccagtgtgactgaggagcagaatttcctattttattcctttgtaattcactgaaatttaaatagccacatgtggccagtggcacctgcagtaatcagtggatttctagagacatgtgctggttacaggttacagagctgcagtccccaaggcctgggatgggacaggtcagggaagaaggagaggaggaacagacggcacaatgccaggaaggctagagttatttggtcgagttcaaggtctccaagtacaggttacttgggccaaatgcaatcaacaggagccaaatgcatcccccagccaggctggtccaatcctttttgatgagagccagccccttcccccatgctgagaaaattagagttttcatcaagtgaggctctgaccagcaccagcgtgggcagaagaaggagaaaagcagcaggtctgactccaaaggtcggggaccacagtcctgctcagttgaacaaaggggcaccctctgagctgttctcccctctaatctccaaaggctgctctccatgaggaaatcaaggcagctaagcacccagggaggtttctgggaaaaactaataaagaagcatacaccctttaagaggtgaaacccagtaacctttcctctcctgtgtgaagaggacttggatttgcaatggtgttttagggatccactgcatttcctcttcccaggtgggcatttcccaagccaagggcagtgcccagccgaaaggaacatggctgggcatggtggcttatgcctgtaatcccaggcataagcactttggggggccaagtcagatgagttgattgagaccaggagttcaagatcagcctgagcaagacggtgaaacctcatctctacaaaaaattagccaggcatgacggtgcgtgcctgcagtcccagctactaggcaggctgagatgggaggattgcttgagcccaggatgttgaggctgcagcgtgccttaattgtgccactgcactccagcctgggtggcagactgaaaaaaaagaaagaaagacagaaagaaacaaatccgcaactctcagagccagacataccctctggttgatgtagtttcagctccctcagccagtggtttagccaggccaggcttagcagggccccagagtcggagctccctccctcgcaggacagatctagctgctcggaagttagcgttcacctgcagcctgcatctctctgccagacctcccagcctggggccccagagaggtctgggcggggggtgctcacagaccccaacactgactctgaccttcccatttcttgagcatgtggcagcttccacacctttcctcttccaggcgcacactcacaatgcccactgagcaccagccctgccagagggtcctaggagcctgggctgcttctggggcagcagcagggcccctggggggcggggttgggcccagctctgggggaggagctcccagctgaggccaggcagcctccagagtctccaggctgaggaccgcgggggccctcggcacggcccctagccggcagtggctgagctgagcttggggggatgagggggcgctgggcagggagcccactgtctccttctcatggcttcccttcctccttatcccaggagcctccctgccggccaactgtactaaaactccggaaaaccatggcggggaggttttccaattagaacattctttttccgacctgtggatgattcttaaagcagcaaaaagccattcttcagggcatgcagggagtatctgccagcgaggccttggctccactcgcgcactcgtgctcaggaggcctggcctggggctgcttcagagccacagacaaaaggcagagcctgtgttgtggggcatcaggtcacacagaccaagactgatggctgagagtttcctgggctcattcgaaccagtagattcaaacggcagtggggatccaggctacaggagtggcagatgtcagaccacctctctccttgctttgtgacaaggccactgctcccaatgagaccactgttcacacagcaaacaatccccaggcatggctgctgtcccttggagtagaactgggctgcctcctcccccaaactgggagccgcaacaggccgggacagggtctgactggtctctggccagggttggggtggcagtgcagtggggcaagtaagaatgtgtgtgtgttccagagagggggaccacaaccccgtagcttggagtgcaggctgagaacagggggagaggagcagccactccacatgctgagaggctggaccagctcctagcaggagagctggttacaaacacaagggcctggcctcacgggttcggggctcaaaggacccatcctacctgcaatcacacctggggacccctgcctccagggcatccaccctgcttggagtcagcagagtcacccagcaagtgtaaaccggttgaagagcttaagaggatgaggtggcagggcgggccccgggaaggaggggattagggatcaagcaggagcccagccctccccgcacatgaacctgagcaccccagcttctctccagctgggcaggggctccatccagagcagctggaaccccaggttctaagcccagctctgcctcagactagctgtgtaatcctggcaacatcttgtccctctgtgggcctctgttttcccatttgtacaactgaagtgttgaggttgcctgcctgtcttcagtcccctctagctgaggacactgcctgggggagctttgcggcctgacagctttcagggcccaacccctctttctccccctctagcctggtaactctttttgttttctgtattttttgtagagacggggtctcaccatatcgctcaggctggtcttgaactcctgagctcaagcggtcttctctccttggcctcccaaaatgctgggattacaggcgtgagccactgtgcccacctcctagcctgggaactctggggctagatcaccttgcttgagttctcttcccagccctggagatcagaatggggcctcccctggagctgaggagtgctgctggccagttctttcccagcagccacctgccgtgctacccatctcattgcttagatgcagcctcccagagacgctgcctccacggcctgcttgtgagctatggcttctccagcacagggctcaccacctgctactccctgcctctacctttcagcctcttgcctgcccagacagcccagcctggccccaccctgaagcccctacctctcacttagagccttgctgagggcctgcttgttggtgggaagagactgtccagtcccctggaggtggcactgctgcctaagctggagggacttcaggagaactctgccagagccagggggtgggagctggcctgtcttggagctgcggatgggtggaaaagtgcaagagatgtgaataggaaaggatagggccaagctcaggccaggtagggacagagcccagcctggaggcaggcagcagccaccacagccttggcctagaacttgagggaggtctaagggaaggttcatgaaggagataatgttactgctgagagaaagtggaggccacctggtgtccctggggaggaaatgtcattccaaacaaagggagcatcttgtgcagcgtcctggtggtatttgagcacttggtctatctgggtacatgtcatttgggcatgtctggtgcttgaagaggctgaagaagccagcaggtgcctgaagcctggctgaggtgactagaggtgccctggcaggcgtggaagtggaagactgttggggcaatggacaggtgggcagggcagggcagggcagttaccattcaagtcaaacccgtttgcaggcaagatcagctgcagggcctggcagcctggcagggagggaggggttcagggaaggctgatctctttggctggagcagtcgtgacagatcgggcctgggcagagactgagtcacctgggacatgggaagagcttgaggccctggggcggcccagcctggggcagtcctcacttgctggccgtgccgttggacaccacatttgctcatgctctccagctgggccccccacccctgactcagggctcttgaacaagtttgccttttccctcttccttgccctacatctcacccatcatgatgtcttctaccttctaccctttcaaactaggggctcttgaagaggactgggacccagacaaagagtatgacacagcctaagtcatacagtaaacatgtttaggaggtaagatgccaagccaaatccatggccaccagtagccacagtggaggaggggaggtgttagttgctggccaccagacaggggcatacaatattggaagcagaaaaatgcttgttggcaagagacggacatgaacagaagtgactttatatacaaccccctaagcacacacagggtcgccttctccctatctcatgaaccccaagaagaaaaggatgaggacagcttccacagcctcactcacccatccatcacttccttctgcaaattcttcggatgccctgtgctggtctccgtgacccagtgatgaatcagaaggggccctgccctcccagagctcaggatctagaacaatagagggtgacagccactatgctggattgatgtcatctgagggaactaaggggtgcacagaaggaagtgatcagctcgactgggtggcaggcaggggaggctttccggacactgggtggaggcttgaagaatgactaagagctcactagcccgacggggatgaagagcattttagggagtccgaggagcaggagcaaacaccccaaggtgagcgccatgtgatgtattcagaaggcaatggaaaaaggccagtgtggctgtaatgtattgaacaaagggaagagtggctggacctgcagggataggtcgtctcaaggagtctggcttttaccctgagagcaatgggaagccatggaggagttgcaagcaggagagcacctgatcatattgacacacgtgaacttttaacctgacctccgtgtagagactgagggaaaggaaggcaagaccagaggcagggggacaccagcaaggaggctggtcttcggggccaggtctggactagggtggtggcagcaggcacagggagaagtgggtggactggagggccatggaaacaccacattggcaggccttgatgaaggagaagcagctggtccattcttttgagcctaccaccctggtaggccaactcctggccaagtccatgccatttcttgggctggcttaattgtctccctgtttgggaggccgtggggtgaggggtctttcctccatgctctctccatccttagccccagcccagggccttgcacacaataaagcactcggtgagcaccaacgcgtgacacaggtacatcaaaccgcattggctctgggagtctggctgtatctcgtcgcccagcctgggagatagccccgtttgctgtgccttgtgagccccgggtccgtcccaggatggccttccacgatgagcggctccctcactcttctcctcctttcctgcctgcaggacttcctggatgatctcagccgccagccccccgcccccctccccgcccctgtctgggatctccatctgtaaaatggatctaggaacggtagttctcgactgaattaacccgacagcatctgtggaagtcgttggccctgtgccggggccagatcgcgcaactaggagcgggggcccttcacgtggcggaggcttcccggcctgggggccacgggcccggaggaatttgcctggaagttttccatcacggcagagccttctggagctcgccccgtgctcgacaaggggagccccagacttgatttctccagcagccccgcggggcggggccgagaaggggcgggcgggcggaggacgctggcgggagaatgtgcggaatgtgccaggcgcctctacctaccccaggaggggcagaggaaggggccggccgaggggaggggcgaggggcgaggctccgggcggccggagaaaacctgtttgttctcctgcgggcggagcccagtccgcgcctcctcgcctccctgcgcgctccccgctgtgcaccgcgccccgcgccccgcgcctgcctccccggcccggcccggcccggccgggcgccgtccacccgagggagcccgcgccctgcgactgcccgaccctccacccgccccacgagccgggcaccggtgccaggtagggctgtcgagtcgccattggatgcggccctgcttggaggcagtggggggcacccagtccgtgcccagctggggacaagtcagggcctcagtttccccatccataacccttaccagctccaagcatctctcttcgggttccccccgggagtcagtggatttctggttttcgctgtgagtgaaaagactgacaggcagaggaggccagcgtcccctacagaggcaagtgtcccccttgccagcctgatccctctgtcttgccctttaggaaagacacggtttaattgttagtaaacggcgaggggccaggatgctctgagagttgactgcaggcctttaagaatcagggaatctcatatccctccgtccccctgtgcccattttatagatgaggaaactgagacccagaggctggctcacccagaggatcccctcaatcgccctggggcctgtgaggtgcatgtgctgggtacagggcaatcttggggagggccatgaggatggtggctgctcacactcagacagaaggcgccgaatcaggtgtcactgggtgttatcgacaggatcggcactgcaccagctctgtggctggattgttttgatgggggcagagggagccaagagtctgtcctctttggaaaggcagagggataccttgccttacaaaaaggccgaaagctcaggtgctcctgcctgatctgccacttctgagctggggacacctgggtactctgtcggtttaagggggtgacacgtcaagctgcctcccacccagggctgctggggactcagataaagtaggtggtgggtgtgtcccggctttgggacatctgaggcatggtaggagttgtgttcttgctgagccgtcggcacgaagccttggcatcatgggaggccccaaagctgtgagccccgagagagggcctctcacaccccatccagcagtgcttgaggcttcagtacctggactaagtcctgccttggtctcatggcccttcagacttctggctgtcgtacctggctgggggcgggaggcaggggtgcacaggttgataggcctgaacagagctgcagaggtcctgccttcccagggcctccgctcctcatctgaaaaacaaggggcagctcagaggccagcaagtggccaagacacagatgcacagatgaggggccagccttctggcaggccttggtgcctccgctgttcccctcatcgctcccaggccacttcaggatgggaaggaacagatccctctcacctgcccctccttccagcaattcccagcccctggctggatgctgtgcattcagccgtgtggagctgatggaaggcactcagtgcagggccagacacgcagcaggtgctcaagatctgttcatttccatcctctggacactcatgactcaagcaacagaggtggcccaggaccacttaggatgttgcagctccgagtagcatgaaaacattaggggttcctcagtcctggagcagcgaggcacccctggctgggaagatcagggaaggcttcctggaggcgaagggcttggaagcaggaggaggagctcggcagccaccaggtcaaggcccgcacgtcctttggagctgctggagtctaacctccccgttactcctgaaagatcataaaccacttcttgctgagctcctgcatatgggggcccacagagaaatcagctccatgccttgccctgaggagtgacagagaggccatctgtcagtaagaagttgccatctgaatccaaatggcagcagtgcttgtccacctcacttcctgctcagctcaagtccagactccagaaaaagcctttcccacgtgaggccagtgatgccaggggcagccagcgcctcagctcagcctccctcagcctgacttgtgctccttgtcttcctgcccagtgtccccaaggcctcctgagatctggcagggcagggactctgggtccctagcactgggcccaggacctggccacgataggcatcggcacttgttccctgaactgtcttcagttgcatgccaagcaaactcccccaattctggctcggtgcattctggaagccagaagcctgccttcctccttccctactcaagcttccacaggtgactgccccctttggtgcgggttttgcttcaagccacaacttataaggtgccaggtcacatgtaacacaagctttccttctgttgctgagccctgaggctgcccccactgccagtccctggcggcatgggacaggaccagtgccagagaggagagctgctctccagtgcggcaaccccttgcagtccgggcctttgggctctcatgtttagggtcagtccagggactttgcattcgttaccactgtgcccatagtgaaccggctgatgccaagacaagggcagtgccatcaggggaccagtccctgagagatgctcaggagaggttgccatcattgcttccaaaggccgggaagaggaggaggggctgaactgtcccacacctggtcaggtgtgtggcaggtgagggtggcaccttcatagcctagtggttaagagaatggctcagaggtcagcctgggttcaaaccccagctcagccaccatccagttgtgcaaagttcggcccttcatgcaaccccttgaggcctctgttttctcaccagtactgaagggtggctaaagccaggagcacctgctgcactgggtgcctgcaagtgctaggttcctggcacagaggtgctctgtcacggaaggtagctgagccaggactatggtgccctccttcagggctgtggtggcaaggagtgaagtgggactaggtggagagagagatgctgactgggatgtgggcccctacctgaggaaaacagtttagaaattactgctgatgatgcaaacagtatctacccacatttaaagtgactcactaaagaacacttaattcttagggtgatttctcatgcctactaaagtctgactcgctttcttttttgttttcactttttttttttttttttgttagagctggggtctcgccttgtcacccaggctggtgtacagtggctagtcacaggcatgatcatagcacaccgcagcctccaactcctgggctcaagcgatcctcgtgcctcagcctcccgagtagctggcactacaggcgagtgccaccatgccagcactgttgttactttttatctttaattttttttttttttaccttgaattgatttaaaactcatagaaaagttgtacgaatcgtgcagagaactcctgaagccttatctgaattcccgctattaacattttgccacatttctcattagctttcttcacttgtagcctttggatgggtcagagggtgggcagggctgttgtcagttcatttttccaaagggaaactgaggcacagagagggacttgctcaagtgccattgattagaaactgagccagattaacttctctcagggacacatattgatgcatttggcaggtgttttcttgatcactttctgtgttgggcgctggggcacagaaatgactgagaactgacagcaaagtgggagggacaggtctgagtggagaagagactggaaaaggaaaagacaagaggccctgtgggtatcactctcaatgtcggaggtggaatgcaggaaggaatctgcagcttaagcgtgtctcccagggaatttgactgccgaagggtcccagaggccactttcagaaacacggtctaggcttttcctgttgggagtgtgctcatttctcacctcaaaagggagctaggaactgggagggtgcctgcctggagcagggaggtgggtccaggccagccaagagagcaattcctcacccactcattaacgcccgctgagccatccctcttcccgcagagctgcccttggggctgctgctgctgagatggcggcagagctctgaagccacgccctgggtcagagaggagacatagcctctggggccagtgggcaagccctaggctgctggtggttgctggcggtggtccctggccttggccccatctgtaggcccagctcgggcacccagtccgggccccttggtctagtccctgtgatctttggctcagcacgccactttgtgatgactaggtcagtttcccagagagcttgatgtggcgaagagttgctatggagagagcaagcacaaggattttaatcacaagaaccggcatccctggtgaaaatgcttacatcaggcagtgcctgctttaaactgaaataaaaataaaaataaaaataaaacccaaaaccccaaaccaggacttgcttcaccacttgtgccagcgatcccttactcatgctttcattcctttgggcctgagcctgggcacctccttgggaaatgcagtgctctggcaacattccgctaggccgatccccccagcacccagcctggcggttagggctctgaaaatgcttgttgcatacatggcagtgtgatcctgggcaagtgctttcttctctctggacttccttattcttatccaaaaataggggcagtgttagaggtaagggtggggttgaggggactctgggtctagagtgggcagaaagatgagaaagagggttgtgggaggggagaaggaggatagggagtcagagctttgggggaagtggggaggcagcgggctctttctgttccttttgctcctaactagtgatcacctgcatctaggacagaaggaattagctttggctgatgttagtcaagggcaagaaggagtgacttcctgtcactggcctgctctggcaaagactgaatggatggcagcagtggtgtgtgtgtaggcgggggtgttcctaggggagagcgaaagagggtaaaagaaagtggccgagtgcggtggctcacgcctgtaatcccagcactttgggaggctgaggtgggtggatcacttgaggtcaggagttcgagaccagcctggccaacatggtgaaaccccgtctctatcaaaaatacaaaaattagccaggtgtggtggcaggcgtctgtaatcccggccactagggaggctgaggcaggagaattgcttgaacctgggaggtggaggttgcagtgagccaagactatgccactgctactccagcctgggtgacagagcgagactcgtctcaaaaaaaaaaaaaaaaaaaaaaaaaaagaaaaggaaaaaaaagaaagaaagaaagtagggggagagggagaggtgctgtggagattggagtgtgggctccatgacctctgagcctcctctgatctcactggctgccttgtctgcaaatgggactagcatctctgcatgactgggattggctgaagaccacattggttccctggctgcagagacaactgcaggatgaggggtacagaagcagccagggccctacaagagggtccctgcccagccctctgttctccacagagacatctccaagggcccttgaagccaagccagccctgaaatggcccagttccctgaacggtcgcttgtatctggctctctgagaacgagaaaatgggcgcatgaaagccaggaggaatcccgaggccccaaggagcggtgggtggcccagctgccttctcccctcctcctcacccccagcgccccaccaccttgggaaggagctggcctgccttaaaagtctgcctcccagggcccctccagtgcagacgccgagaagtctagatgctggggtgttaggggtgggatggggagaggtgaaattccagactttcatgcagaagtcatttacctgtaaagcacatttacaaataccacccccgccatgcgttctttttccatattatattttcccctctgcaactcaagtctttttcagctctttttttttccacttgctgagcctttttcctgccaccctgttggcctccaggcgagagcccctgggactggagcatcccaggcaggtcgtgcactctggctctggcaagaggggcccagcctaggcctcctgggagctgcacgctgagcagcagactaggaggctcagacgggatccagctgctcagccctgcccacggtccctaaatcaccgttgaagtgccccatccccctggatctcagcaactcctggaacagcagctacagccgctgcagcggtgcctgtggcggtgcctgctccatccccttcccagaggaaagcaacctgtctgctgactgttgccttgccagctgctgagactccagtgcaggagactgggaatcagaatgtcctgattcaccagacctggccacaggaggctgcttcatcaaatggaacgtttcatcattccaacccttttggtccagaaaatcagcacccgcaccggcttaaatcagcctgggtccaaactgagtcagccaagtgcgtgccttgagaaaggacggggtgagggcatctgagtgggggtggaggtggtgcttcctgactttataattcctcaggcttgtccttgcacttcccatggcagcctccagggggagtctgtgccacagccaaggctctccccactgcgctaggcttttgaccttagccccctccccgggaagtatcattgcttggggtcctgtggccttggtgatgaccggaggggctgcactgaagcctacaccttcctcacatgaccaggtgcaggggccagggagcattttgagaatggggcttccttaagcccattccccctcccatgggcacagagcattctcttttacctcaaagtttagaagtgaaggtcagggagggtgagtgacgcgtccagtgactaaaacccaggtccttggactcctcgtcagtactccttcctttgctccagagttggaagagccagcatggatgtgtggctttgtggccttgaccaagccctccacatctctgacggcaccgctgtgcccgtctcatgacatgacagatgataaggcatggctggctctgcgccggggcctcctgaacatgtcatgcccctactaccctctcagcatctgtttctgctgccccatctggctcagggctgcagtctggccgcagagagggaagctctctaaggaaggagaatgggctgggagaagccacctgctgccccttgtttagcaggctgcattccctagcaagccagctctgactatctcagtgtcgcccttctcctggtcacccagaccgccctgttcctggggcagctcatgacactgcgaggggtttgtgaagggtctttcgtgggagggcccttactcagagctcacaggcatttgctcgaaagacagcaaaagaggacctaagacatggggacttttctttgagtctttttcctgacactaggtccagtggaggctctttgcccaaatggaacatttacagtgagaaatggacaggagcctcgacacccccaccctatgcagaatttgacctccacccctattttaccaaggcaagccctccagcaaatgaagctgtcagacaggcttggggggggggcggggtcacagcctgggagggaactgcctccctctcaccccttggtgctggtgctggtggtccccaggttgagttggaccagaatggaggggtggagggactcccctccaggggactcccctcccctccagggactcccctccagagtccctcccctccagggactcccctccaggggagctacctgggctggctgggctctggggcttgggcagcctggagccttgggtttgtaaagcccaactctggctcttgtaggaggactggggggaaaggtgtagcagctggggtcacccttgcacatgtgtttttccatggtttggtcattgccacccttatcgagtggtagggaacccagacaccatgaggggagaaaggatttgcccagggcagcaaagctgggatgagtctccttcccagagaccagccatcttctctgagggttccagcaggcatgagccccagcaggtatctaagctgagggatcagcactgcctgggtccgcccatctctaggagcaagttcttgggagacaagggagttatcccttcaccacttacctcatgaccagatgggagtacttatgtttctgctggagtgatgggggcaggcctatgtgctggtccccagctatattctgggcctctgcctccattaaagctccttgtcccagagccacgtgaaagtgcttgcagacagagctttcctgaaacacagccagaggtttcctaaaacatagcaatcagcctctgcagtgggcagcccaagtcttgatggcttcatccacttgtacttgacagatccatatttggtccctgtacttgactgcaggggcagcactctgggctgtgtcccccttcttgccctgtccagctgtttctttatgctgactcctgacccaccccaaaggggtccacacagatctgagctgtgagtgatccctgtgagcctagctgaggttggcacacgtggggtggcagagctgggtgtctgctcagctcctggatgcaaagcatcccaattcacctttgggaaagaagcccttctgcttgcacctctgcctgtggcacacctgctcctgcttgtgcatggcgcccagtgcccagcacacatgcactgagacaagccctgacacctgtgccctctggctgcatctcatccatgagcagcgatattcagtgctccgggaaggcaaggctgaaggcgttttgctcccttgccctcccagtttgcttaggaggccctgcctggcgtcctacttcccttctgcacagtttgggagccatcctaatcccctgcgagccagcttctctgggaggtgccgccctcggggagtcaggcagcggggaagttctacaaaactttctctgagttagtcctctcatcttggaggctgagcacgtcctgtggtgtgagagggagtcttttctcctgccgctcccgtctgtgtccatctcctcacgctccagcacctgcgtcattgcctgctgccgcccccgctcctccagcgcacgggaatctgcatgcatcagccccctgcgtcagctcccctctcactccactcgctgatgacaccaggcttgctgtggtcgggataacaggctctgttcagccacctcattggctcctcgctcctatctatccaatcagggccaggggccccttccttcgaggttgctgggcaaccttcagaggccacagaggcagggagaaaggtagagcaggaacatgcccatgggcatttggaggccatctgaattcagggaaggcctgtcctcatctcccccgcccagccctgccagggacacttcctcagattgccatctctcagcccacttggccagagacaggaagagggagaaagaaggggatgaagggcgggccggggcatctgcctggtgtctgaggtggcctggcctgtgcaagaggagttggacttggccctgaactgccctgggacaggctggtgttgcctgagtacggggctttgctcagagtcagcacagagaggggtactgtggagtgtggccacatcttgtggggcttcgggggtgcaccacgagggacagttcatgcagagggtgtcagaaaagccaaccattcctttggtggcccaggccaggtcctaagcaggatgatatggagatttccaaaaaaccagaagtcttctccaaatcaaggtagaaatgagggccatggtactgaaaaggcctagagtggctgtcctgaccagaaatgtgcccacacaggccatcaagacacccgtgtcatggcatgagagatccagagaggcacatgttctagcttggtgtatcctgtcaggaagagacccagtgagcaggcccacagatgccaccttacagatgaggagacctagactcggagagtgggatgtcacagccatgtgaggccacttagggaagaggagcagagatgtaagcacaggccacagcccatggggacagtgtttgcttttgggttgtgtggcctctctgggtgtcagggctaatggactttgaaagaagcctgagttcgcagaggaagaggaagactggaagacttgggcaggtagcaagcccctggcaccactttcaaaggtggctaaggaaggaacatttgctctccatcttcttggcagggtaaatgggaaggtgcagggaaccccagttacagcagtttctttttcttcaggaactttttctgagtctttctcaggcacaagcccagaggcatgagagagcttgacatactggactcagatggagagtgagagtgtagggctgcgggagtgggtggcctgctccgtggggtcctggagtcacatgtggcaggcctctgtggctgcatcaggccgagcagcacaggcaggcacggtgcagctgggtgagtctgaagtgtctcctccctccagcgggtgagcattgctgctggggcccagcggtttggaggaagccatagaggcgactggcagtgggtgtgccccaggagcactcgaggccgtcgtgcatgggcttacctgggccactgcgtggctgggactcagagccctgggagtgtggccagggccagacacgggcccactcctggctgactctgctgaaggggaagcaggagcattggcacagctcttgtgcgtgggctgcacacggtactgctggccttctgagacctgatcccaggagtgtgcatgcagggtgcccgcctgacacaggggtggtgctccagcaagggaagccagtgttgttattgcttcccagaggacggcatggttctcatcgcagagcggagcccaggccactgtcccagtggttgggtcttctggccgctttgctgggacctgggtgcagccctggggagggctggagtcctgcacacaggctctggaggcttcactggcttcccaaatggggttcacatccgctaatgactgccccggagagcggagagctgagggtggccctggggcagcagccatggtggccagagggtttatctgccaggcctctgtggtgggtgctctctccctgggtagactgggcctttccccccaccccctgctgccacccatatgaaagcagacataggcatcgcatgtccacacctgagccataaccggtccctgtaccaggctcttcagatattctggacgtgagcctcgtgagcagggagttgtccttgccccctggagtactttgctttctgtggaggtccctctggctgacttgccatgggctggggagccagggcgggattgcgtggggtgggagaggagccatcagtgggcctcatgtgccctcctgtcccgtcatctcttccctgggccccgtacatgtgtgaacggagaagccggcctcctgcttccaggggtgccaccgccactgccactgccgctgcagcaacctctgtttggcatccggcccgaaacacccctgcctgctctccgcttccttctccaccccagcttgtgggaaaagacgaaggaggccccgggaagaggcccaggctgcagcactgcgtggcccaaagcagtgcacagcacagctgggccccagaggctgagggcctgcccttgctgctgtggggatttcctcctcggagtgagcaagcaagagaagtccctgcatctgttcattctcctcacctcccatccttcctaggcactgcttgcctggcatcaactctttttttttttttttttttttgagatggagtctcactctgctgcccaggctggagtgtagtgatgcgatctcagctcactgcaacctccgcctcccaggttcaagcaattttcctacctcagcctcccaagtagctggtattacaggcacatgccaccatgcctggttaatttttgtatttttagtagagatggagtttccccatgtcggctaggctggtcttgaactcctgacctcaggtgatccacccaccttggcctcccacaatgctgggattacaggcatgagccaccacgtccggccctggtatcaactcttgagactaatcccttggctgctcaagcatactccactcgcacttcatttgggtaaaccaccgtcgggctcatctttagcacacagaagatacacgttcatgacaggaaaattagaaatacacaaaggagcaaaatattttggtgtatatctttacagattttttcccctgtgcatttttatgtaaatatattttgacttagatgacaccatcatacacatcctgctttacgggctgcttttcactgagtgatgtatagaaactgtacacaatacaggtttataaagcatgttaaatactacatgtctcagtatgatttgtaatagctgcatagtatttgcttgaatggatagattacaatatgtttaaatatgattgatgggcatgtagattattgccacattttcacccccatactcaacactgtgatgacacctgtttcatatacatctttgctgtactcgtgcaatttcttcctcaggctacttggctgcgaggggaattactggaccagcaggcctgcccttaagccttttgatacatacagaaactcattctgtcgagattcctggtttcccttcccacaagagccaccaggaagccacctctggaggggtccacattccatccttcaaggctgcttacatccgtagcaagggtcttcctggctgtcactgagtggagggccactctgccctgctctctgtgaagggctggacaaggggaggggacggtggatctgggaggagacctgggtccgagcaggggtaggtggcttcaggcaatcactccctggtggggtgtgctgggctgtcacagggtgcctgggcttggtccttgctgaggttgggggaggagcagggcttgcctgggaagacttggatctgcaggtctgtgcctggctgtgggagttaggggaggggagcacccagtaggagcagggctggcctcgacgtgccgggccctgagggagaagcagggcttagctcggcggaagttggaagggcatttcaggtgggcggaccagtataagctaaggcacaggcattcacttggcagggctaccttccagggactccaaggcacatggtctgcttggagcacagtgtcggcattggggggaaagaggctggctcaggggactggtgattttgctcccagtcttagaaacagtgtggaaccatcaggtgctgactgagaattgaaggctgatgtgggccaagtgggattagagaccaatgagtgttgcctggaggaggtgcagataaaggcagcaggccagggaccagggaggaggtctcaagggatcgtggcctagaccagggcaaattggagggagaagtcagctctgtagatgggatgtacattccaacctcatttgcccaccccacccaccccaccccgccccatcccatcccatcccatcccatcccatcccatcccatccctcccatcccaccccactacatctcatcccatcccatccatcccatcccatcccatcccatcccatcccatcacatccatcccatcccatcccatcccatccatctcatcccatcccatcccatcccatccatcccatcccattccatccatccatcccatcccatccatcccatcccatcccattccatccatccatcccatccatcccatcccatcccattcatcccatcccatcccatccatcccatctgatccgtccatcccatcccatccatcccatcccatccatcccatctatcccatctgatccgtctatcccatcccatccatcccatccatcccacccatcccatcccaccccatcccactgcctgacactcatcactttaaaggctccttgtcccaaagaactgccttacacttcatcgtgtggaaagactctactttggcagagatttttctgactctttcatatttattgtctcatcaaaaaagaaatttcacttgtgagactcagccaggcgtgagggaaaggagcccatgcagaagcaccagccctggtctttgtctggcaataaacccggagtcttctgactggagtctcagctataaagacgggactgaaggcagcatggtgccctctgcaggggacggatggtgttcccacccagccctgccctcctttgccatgggtccctctgcctctgtcattctgcatgtgcaaaagtgtctgtcttgactttggaagtggcttatttggtcctgatttggcaggaaacttctaggcaatgtggccatcaggtttgacaaggggtaactgatgagtccttgtgcctggtactgggcctgggatggagtccacccccgaaactgtggatgaccgtcacctgcttgccacgctcatatgtggaagctggtggctacagtccctgaggccttagaaaggagtacgtctttgaggtgcccagcgcaaaataagtcatactagctagtacagcctagcaaggttagaaggaacctaaagacgaaagactaggaggtcctcctgcaggtgaaaagctgaggcccagatgaagtgaggaactgtcccaaggtctgtagtcagtcagtggcacccagagactctgcacatgtgccctgcccatggggccactccacaggttgctgggatggggacagttaggcctgtatggccctaggaacacctgtggagtgagcgccactcaacagaactctaacgtggcagctttggtgcagggctgggcacgcggggctcccatttgcagtgatgaggtgccattcctggcacacagcaggctcgggctgtctgggctgctcgttcagtgcagtttatggaagagccagctcttgctgatgtggcaaatttggtttgctctcgtccccctgccctgcccatttgagtgtgcccctgacctccacagaaacacatccaggccctgccagctggcagcagtgctgagctggtcagaccctagccctggaggggcccaggggatgaaaggccctggagagaaaggctcttctgctttgtgactatgccagcacaaccagggccctgcttcctgtcatgcccacaagcctgagcccccagcccctattttgaggcccaagggttcggctgtggccactcagggctccctgcagctctgggtcgctcccagcctggagagccagcttcatcaccctgggcccttctccggagcaaatggccctcgagaccaccacagctcacccctcatgggcacgagagggcagcactgggctcaagggcagagaggctgaaggcagtgtggcaccgtctgggcagcatgagcagcaccgggctcaggggtagagcagggcgagaagacacagaggaagaggaagcagagctcaaggcagctgtgggccagggcgtaaggaagcctaacttaccacattgccacactcgcctgttccctgagggccactaggatttggcagtggggccctgggctttccccactgaaggtggagccaacccccgaaggaaacagggctgcacaccccagaccattcttggcgctgtttgaggaccaccgcgcctctcctagcagatgacttgagagctactgctgcttggctccttttcaggtggtgccgggtacttataggagcatcggcgcattccatcctcacagcagtcctgaaaggtagaattttttttttaactatcattttacaaatgatgaaactgaggcagctcggagaggttagctgacctgcccaaggtctgtcagaaaactcctaaggggtgagaagcaaggtccaaccccaaagcagctggtcccccagcccgtccctctccacaggccatctgcctgccctgaagctgttcggctttggatgcactctctcccaccctctgagtccaccagtgccagctgtcttccccacaccccccagcctgagccaggctgttagcactctgtaggagggctcatgttctcccgttatcagtgatcgctttgaacagacagtccctggcagcccctgagctccacattctctaggtgagcagccctgggcaggcaggtgggtgtgccgctgggcagcagcaggtacagtgagtgctggccccctggcttctgcccatacttagcactccaccaacgcttgccacccccgatgtgcagagggcagtctggatgatcttggtgtaccaggacccatatggtcacctgcaagacactacaaatgcatgaagtgacagcatttgcttacctttatccccagaagccctgctgaatcaagtgagaggagagctgcggagcaatcaccatgagtatctcagctcttggaggccgcaccaaaggtgaggcctgggctccctggtttcccaggctctgtttggggctgtttgcttccaagcctgcccctacaggccacaagcactgtcccagcagcaaagggagagcagcatactgggagaactggaaaggaggtcgagggtcctggggctgcattcctcttctgaggcggttggcttttcccaccacagggaagcctctgccaccaggcgaggaggagcgcaataacgttctcaagcagatgaaagtgcgaaccacgctgaagggggacaagagctggattaccaagcaggatgaatcggagggtcgcaccatgtaaggcaaggaggcggggagggaccgcagcaacgtgggggcgcgcaatccgtgggggaccgaccatacctggggatgcgaaggggcttccaccattcagagctccgccaggccatgtggagggcagagcgtgggaaaggctatccagcaatgtcacagggtgggagagcccctgggtgcctgggaaggagaatgtgtggcagaaatggcaggacttgctgggcagcctctaggatggaggccacaggatggcaggtgacagggagtctcggagccaatccttcaggatgcctctttcccccagagagctgccctcaggccggagtcgcgccacatccttttcatcagctggggaggttccgaagcctaggtaagaggtggtgctcaggtggctggtgggtcagccccagggactctcctgcagcttggggccagccctcaacagggaggggtgggcagtccacaggggacagggatgcagccccagccaagggtctgcaatgagtaatttgaaatctgcaggaaggaggggcttctccactgcaccttccttttgggaaggggagtgtaggagtcacttggtccaggcccttggcctggctgtgtggctgtggggcagctgacttccctgctgggcctccgtggctccagctgttaactgggattgaaattgtctttaagaagaagacgacctcccacccattccctgcagggagtgatactgcctctgagatgctttgggcagcttccagagtcacagtgactcactcctgcaggtcaccctgactgcttgagtgtacttgggactcagcatgcctgtagagaggcacgagtttgctctgactgtctcccaagtttaccgtgacatattttgtcagctgaccaaggagaactggcttctctctcttttgggggcttttccataacagtgtctaggggggctctgaagcgtgggcacaccctgctggcctctggaggaactgctcctgacagagaaagggaactgaaattcaggctcgctccttgctccaaacagccggcaggcggcttctcagggggtggtagaggcagtggcggcctctggaagggagggcctcaagtttacagccagcacacagggctacctttagtaactacggtctctctgtcacccctcgatgactcagcgcccactacctgccaggtcccatgctgggcacagaggatgcaggagtggtcaagacaaaggccctgtctttgggcaactgacgtcccagcaggggactcaggcaggaccctagtaaacagttcaatacaaaagcgagaacccccaagtgtgcctgcaacatggccacctctgggaggctgtcccctgttagagatggagattgtggggttggagactaccggaggctctgtgttgcccttgacccaaaccccgatgctccagcccacatcccctccactgcaggacagaagggtctaccctgaccccttgactcctcccctaactctgaggaggactctttgcaggggcccctaactcctgcccggaggccagaacttccaggctgaccacccctggctgtcagctccctgcccgctcgtcttggctgccccctgagttatctgagccccctcagttgctgccaagcaggaggtcccaagcacccagagcctaatgtttcccagccgctgaacaaggcctggccgcgccctctcgtctcaaacttccaccaagacttggggtgtgggcatgcaaggagctggagcaaagagggccccgagggacaggaagggggacagctggcttcggctggctgctgcctgggctctccccttcaagccctcatgcaccttcctggtggaggctgttgagggagatcaggtcagaccccgggctgaggggaagcctctggctctgactggggagcctccagcttgcactggttcagccccaagcacagaggatgggagggctgtcagctgagagcagtgctccgtcggcgcagcactgggaactggctggccaaggagaagctggactttggagaggccatcaagctgccttcctaggcacctgccatgaggagtcacctggggcacttttcctgggggagcatgagggaaataggcagagcatagcgggcacctgatcaggggcacagggggctggcacccctcgtttctgctgtactgggacacctggagcacttgccagccaatcttatttgctatcgttaagggcaggataaagtaggatgacctcagccctccagcaagcctcgcttcactccaccccttcttctcttcggcaggcctccgagcacaagggctcccactggctacatcatccggtaagtgaccgcaggactctgccggccttcctgtgcccactcacgccaagccctgacttcttacccctccagtccctccagggagctcaccggcatctcctgggctctctttcaggggagtgttcaccaagcccatagacagctcttcccagccccagcagcagttccccaaggccaacgggactccaaaaaggtatgtccatggggtgttggccagtcggccagtggggaggtgtgagggcctggtctgggctcctggcagagacagtgctctgcctatcaggactgtggggccttggaggtgccagctttcatcctgggtagggcaggaccctggagagcagggtggggtgaccagaggagatgggctggggtgggactggcagtcccaagtggatgtgtgggtctctgggaggtcctgggccactaacagtgtccttgtcctggggtcagtcctgactaggcctggctaatgggacagagaggtgcaggagtttgggaggggctgggtgtagagtccccctagcctggcagtgggcacccttgacttgacttgctgatggcattgagaaggctgaagttgcatgcaattcaagcaccttggcatcaggcattgcctgggactccgtcagactggaaaggccaaggggacccggaaacaggaagcaaagacacaggcaagagcccgctgggctgttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaa

SEQ ID NO: 67 - DNA, 11342 bp, Homo sapiens
ccatcatctgtgattttctgacttttagtaatagccattctgactggtgtgagatggtatcttatctgactggttgttttgatttgcatgcttcctccctcttaaatcatggagggaaatcttcctcacaatctcctccagcagagtcctcttcctgtcccagtggccagaactaggtcataagttcatgtcctagttgcaaaagaaatttggatgatgactatatgacatttctcatctctgatgcagggcaggttctgctggcaagtaagaaaggtagttgcatgggaaatagccatggctactttggcagattacttttaaaggtccttagcctctaaagtttaaattctctgacagcttagtcacggagttatgcctatttgatacacccgtcagggtatcaacaatctaaggccaaactctgtaaaagcacggttagacctctgcagatagaaaatatttgaaaaaaaaaaaactacaataattttaaaaatacaagtaagaaaacaacacagtataacaaatctttacaaagcatttacattgtatcatgtatttacattgtattaggtatttaaagcatacaggaggatgtgtgtaggttaggtgcaactactatgccattttgcagaaactagagtatcagtggattttttatatccatgaaggtcatggaaccaattcccccaaggatactgagcaacgattgtacataaatattaatactcagaaagcccaatataacaagtaataactttttcaataaaatatagccagaaaacaatgagcctgacacattgtgtgtccttgtatatgcacacatgcatatgtatgtgttaaaggggtcttttagaaaagaaactttgtggtggtggtggtccttgcccagttatctacaagagttttaaaacagcttaacttggcttaactattttttcagtaacattcaacatctcttcataagcatataatataggttgcaatatgttctaatgaaaatgggcatattagtaactgattatgtttctcataaccttttgattggactgctgctttatgcattctaggaccttcagctctgacagagtagccccccaccctcagaaataatgtcattgttcttgcttatagggcaccttttccctcacaaagagctcaaaagttctatcaagcatgattatatctttgctgtgtaatcgtgagttaggactgcacaataattttcagtcagtggaaaattcatgtacagcatgaatgaataattggttctggttataaattcaagaagactatatagaaagtaataaaattcaggtttctcttcagtctaattaaacccttcattaaaagcagtagtgcagtatttgtcctatagccagttgctgttattaaggtacaattttacaacttaatctttctgttttttttaacaaatataccttactgtataaacaagatgtattcttaaaaggttactaatgaagttacttctttgtacagaatctttttttcgtattgtgcattaaactagagataatcataggaaagaaaactttttcaataagacatcacaaaattaacctaaactgttcaatgttgaatatctaaaaggaaaaaatatttcctaaggaaatcctcaaaatatgtgacagcttaatgcaaattatatattttcaatgtttatcctaataatttaaatattgcaaggagtaataccttaactgataaacattaacaaagtggtttaaaaaattaggtctttccaatattctttcacaaaataatagatgtttaatttggtcacatatccttttggaagatgccataagccagtttgactttttgttgttcttgagggaagttgagttgaaatgctgaaaagtacaaacaatcacagctgtgactttggtttaagatatagtattaactaaagaaaacatttgataatagaaattatgttttatctgccatcagacactaggtatttaatgtttcctggtttataacaacaataagttacatattctcataatgaggtgttccagaagtttcctttttttttgttttttgtgagatgggagtttcactcttgttgcccaggctggagtgcaatggtgcgatctcggctcactgcaacctccacctcccgggttcaagcgattctcctgccttagccacccaagtagctgggattacaggcacccatgaccacgcctggctaattttttgtatttttagtagaaacgggactttaccatgttggccaggctggtctcaaactcttgacctcagatgatccacccacctcggcctcccaaagtgctgggattactgatgtgagccactgtgctcagcctgagtttgcatttttaaagaatataaaatcctgggccttgcagtcttcagtaactgtgctgtaaagagcaatttatttctaaaattttataatatgcagtttattcaaagagatgaattaataacaagagaagaccatgattatgtgataaaattgacaggtctaaatcataaaatccaaatgtccattaaacacaggacacagactaagcaaagtgaaaaaattctttttttaagtgtcattaagagagagacatcagacagcaataactgggagaagttttcctgtccttgtgccatgaatagccagtaattggaaagagtgagcacatttgaaaaacaagttaaaaactggaatgcataagtccatgccaaaaatttgcagaatcctgagtcagcaaatccaagttgctgcactggaaatttatgggaaaacaacattccagccaaattcatgtggcttcagaggtaatcgtacatttaaatggataaaacctctgaatctaatagaaagaaaatcatagattgtacaattttgtcaaagtgacagatgtaccaaaatattgcataaattccatcactgcttcaactggaatattttccagctttgcaatcggataaatgctgtaaagtgatagcatgataggaaggacttaattttaataaatgcaaccaaaatgacggcattaagagcaaatgtctctggattccagcagtgttcctcattatttgaaataatacatacatataaatagttaaggatttcaaataatacacaaatataaatagttatctagtgacaattttataataataaatattctcaatccttaatttatctgttatatctttattcatggtctggaaacttaaatattcttagactttaagaacaggtatagaatagggttgatagactatgtcttgtccaaatctggcaagtctgtttttgtaaataaagatttgttgcaacaaaaccatgtctatttgttaacatatcgtgtaatataacaatggtagaattgagtagagacagagaccatatggactggagagcctgaaacatttgcaatgtggccctttacagagaatgtttgctgactcctggcatagaatatagtgaactgtagagcacatatttttcataaaaacattcatatttaaacaatggtcaagccagacaaaacaggccagattcagatgactggccagtgctagaaaaagagatgaagatcctgtgtcagcactgtcactaattttctgtgtgatatggagcaagtcaccaattctcctctagtaaaaagggagtgtctccctttgctgaggttacagtgcataaggccaaatggcaaaaccacatcatctttaaggggaatgtgacactaagccaaagaactatgtccaaaataatcataaatgcaaggagagcctgaagtgaatattgggagcggaggcgcagagcctaacaggtcagagtttcaagcaggcaaatgaggatgatctaatctaatttaaatactcacaataacctacttaaataaacctagggctgtgttttcataaattaagtatgtctatgatttcacagactgagatacacaagaactgtttcatcttctgcaaaatgaagttttgatagaaaaacttctggcaaagtgtgcttctagtctaagaaatgtcctgcaggaaacaaagaaagaaaaagttccttggttacataaacaggaagtagtttaaactatttccatctgttagagattcacaacgaacatttgtatattttgtctgagaagtcctgccaataagaagcgtaacatttttttcaacaagctttgccaaaatgtactggccatctgaaattttttaaaaatcatgcaacacttataaatccttggaaaaactttagaaaacactttcttagacgatctctaaagctttttcaaactctgaaagctttcactaagtattttaataactaacacagagagtatttatcatgtgtcaggcactatttacatggtttacctatattaactattttaatcataacagtaaccctataacatagggattcttattatcattcttatagatgacaaaactgaggttcaaagatgttatttagcttgttcaaagtcaaacagctagtgagtggtggaaccaggattcagacccaggtagtttgagtccagggtccgtggtcttagctattttatatatatataaatttatatatatattttatatgtatattttatatatataatatatatattatatacatattttatatataatatatatattatatacatattttatatatataatatatatattatatacatattttatatatataatatatattacatacatattttatatataaaaataaaattttattatgtataatataaatatattttatataaaataaaaatataaatataaaatataaatatatatcatatatattatatatataaaactatatatatatatagttttgttgttgcacttcagatattcagagaagtaaaaactacctaaacatctcacccaatatttcttttatcatttgaatttttaaaaaacctattattggaaatgtcaggaagttaacacaagatttgaacatacagagactggtgcactttgccttatctgcctttagctccatgcatattccacaataagtaaactaacgtatcctcattatagtattcattaaaataggcctgtcaggatttttcattgaccattgttaattaattatagctgcctccttggcaactatcaattaattatagatgcctgatagaaattgcgtggtttctctttgtaaatattctagaattccagcttcttactggtaaagaatcattcattcatgcctgtgtaaatgtcttcatttaaccgtcactggttgagaagctatttatgttgtgaataacattggcaagttacttgcgctcacggactttaaatctagcagagggagaaaaacaacaaataaacaaataaaaactaagatattttcagtggtgttaataagaaaataaaatagggtaatatataaaatgaaggcaagaaggatagtttattttggttggtggaaaatggactaacttatgagctgagatgaggaaaagggactggctatgagaagatttacaggaataacattacaggcaggagcaacagcaataataaaagcaatgatttagaaattttacacatttcaacaattttacatgtataatgtaactatagattggtaaatatttaataccaccatttttattagaactttctccttaagataactgagttaatatgcaaatgagtctaaataatcagcaagatatttggttcagagggatgaagttcaaatagttagcattactgatggagaatgtgtgccaaacttgtgatcaagtcctaatatttgctccgtgacctacagtagagatcatatcttcaggttcagctatttgtatagggaaatcacaccaatggacttccatgtggagaaagggagataggccccagagccaccagtgcttactttcatgaagaaggcgtagagccaatgagtgcattcctcaggtaggctagtttgaatagctaagggaaagccacatgggaacccacctagtagcataaggaggtaacaaatggaggtaagatgcttacttttctgacaatcagtaaagagaggagacatttgacaatgtctggagacattgtgatggtaacaactgtaaagagtgctgctggtatctagtgggtactttggatgctgctaaacatcttagagtgcacaagatagtcccccacaacaaacaattatctcatacaaaatgtcagttgtgccaaggttgacaaacactacatcccagaagtttccttttccattcatgagagtaggacaatagactttcctgcaacatactctaatgggaatttttagagcttcttcactttggaccaaaatcttttaaatcctttgaggttgtattgcatatataagattatgtgcataatgctatctcgagctacaatctcaaaaaaatctgttgattatatctcaactttagaattactctttcagtattttcattatttctctttacatttgcaagtacatgtgattttcataacaagtttctctaaaacctagctcaaatgccacttcttaaaattattcctaattactgaactgtttgttgttccttcttctgtgttcctatagcaatctatccatacttttatcgtggcacttgtcactctatgaagtaattatttatttaaaggtcattcccatttagaaaataagcccttcagagcagaggctgtgtaggatgtgctaaacatcctacaatgcacacgatagccccctatgtcaaagaattaaccagtccaaaatgtcagtagtgctgaggtggagaaaccctgcgtctctggaatctttgtaactccagtgcccacagggcgcctgccacaaagaagcacgttataggaatgaatgaatgaatgattgctcacaaagaacaatactaacataaaaataccatgagttctattttatttttctgagaaaatcttacttgtttgtatgctcatgaaattaaaaaccctgttacatatgttcatctaaaaggaacattttttttggacaatttgacagaatgattatagtttagcaactggcacacgaacaagaaaagtaatagactgtgttatggactgtctaaaatcttgtgggtaagtgaagacagtcaaacttagaagagtgaaatacagccaataatactgaatgccatctctgaaaacagaaataagaatgtaatattttaaaggtacaaaacgtagggaaacagcagaaagacaacttcaaaagtggaaaatgtagtgacagaatgaaactatagtgatgataattaaaaactgatggaaactacggtcatataaataaaatgagataaaattaaaatagaagaaatggtattttaaataaataagcttcaggaaatgggtcataaaaccctatgggacagcttttctttcccccagaacaagcaaaagaaaattgttgcccattcaaaagactgtcaaaggaatagtaggaagctatattataaattttaaaatatggtttcccgggcatgaagttatgaaccaaaggtttcaaaagcaatagaaaaagacttagaggtggcatagagtgtacctttcttcccacaaaaggaatcgatcaaatttaaactacactaatataaaggtaagaaataattttttttaatacattgtcttggtcagaaagtatctacagagtagagtttaattctaactgccaccaggccctcagagataggaaatgtttcaggctctgcagtccatagggtgtcattctcaactattcagttctgtggttgtagtacacaagcagccaaatgtatttgctagatacattagcaaataaatatgaccgtgttccaataaaactttatttacaaaaacaagagcgtgaggaggaaagatggcggacgaggagaaactgccgcctggctgggaaaagcgcatgagccgcccctcaggccgagggtactacttcaaccacatcactaaccccagccagtgggagcggcccagcgggaacagcagcagtggcggcaaaatctggcagggggagcccgccagggtccgccgctcgcacctgctagtgaagccagtcaaggcggccctcgacctggcggcaggaaatcacccggaccaaggaggaggccctggagctgatcagcggctacatccagaagatcaaggcaggagagaaggactttgagtctccggcctcacaattcagcgactgcagctcggccaaggccaggggagacctgggtgccttcagcaaaggtcagatgcagaagccatttgaagacccctggtttgcgcggcggacgggggagatgagcgggacagtgttcacggattccggcatccacgtcattgtccgcacggagtgaggattgggggcccaggcctggcctcggggttcccccgctgcctgctggccagtggccgaaccccccactccctgccactgtcacacagtatttattgttaccaaaatggctgggagggggcccttccagactgggggcccttccagactgggggccctggggttccccactccctgtcagtccccagttggggctgcgacctccagactctccattaaggagttgacttcagcatgggagggaggctcgcagacccagggcaatgtggtgggaggagtgttccaaagagaagatctggtcagcagagccgccccatgtcccaccaggtcctggaggcagatgcgagggcccagagttgtttgtagttaggccacgcttctctgttcagtagcaaaagcaaacactcgtgggcccagctgtgggccctctgagcaactttgcagcaccctttcacccccaattaaatccggaaccactaaaaaaaaaaaaaccaccaaggatgccagatagacttgagcatgctctgttttggaaaataaacattggcaaattttagtaagtctaaattgaataatcagtgtgtttaggagtctggaaacactattatacaagggatttaagagatcattaatatttatcctatacaaagataagtcctattactaataaaatattccttaatacactgaagcataagatatcactcattttttcttttaataaaattagttttgtcttgggcctcaaccactggactggcaaaaatccactctcagctttatatcatactctcctgggacatcagtgagaactacggaattcatagaatcccagaaattgcagaaagacctctggtctttagctcattatggttctcactagaatacatgttgcctagaactatacagtcaagtcaaaagcaggtgacctactattcctatgagcatttcttattcacttgacacacttagttacttggtccttcatctgggcccccaatactttggtgcttattgtttgtttgttgggtacgtggtctcagagtaaggtttgagagaatctgccactccatattcccaggctcagaagacaatttaattctctcctcatgggccccaactattccccaagcccctttccctggaagcacctattcagtggtatagatttagtgagaggtgtagcagatgttctccttaaaacattggccaaggtttcacaaccatctttgggctgctggtggtcccacacaggacattctgggtatcttgaaacatattttaagatctggggggagaaaggagactgatagatttggaaaaagtaacaattcaagaacgtgtgtggtaaactccaagttaagtcatgcaaaaggaagaaaatggaatgtgggtttaaaaggagagttcgttttcaggtagagtagataagattttattcctcgagtctttatttccagtgaagactttttgcctgagctccagacacacacatacacacacacaaacacacacacacactttttcctaatataagtgtcttgcattcacctcaaagccaatatagtatttaaaatacaatccattacattcaacctatctccaccttagatttattccattctaatatactctcactcctattcaactaagagactatctttaattttttcctctcctttacatctgacatccaatcagtcatcatcattaatcaagtcatgtctttttccaaagcatctctcctatctgacatcacattattcatattgccattgccttatttctggccccaattatatcccacatgaatttcaaaacagtctgttatctggccttatggctaacatatcctgtccccattgcccacatcattccaagttgctgatgtgagctttctaaaataaaaacctggtatctttttcctacctgaatcttaaagccttccattgccttcaagctaaaactcaaattccttagcttgacacaggagataatctcatgatctagtgcttacctacatattatttcttactacttcctaccatttttcttatttcttatcaattcttacattcattctgtttgtttgtttgtttgtttgagacgaattctcactcttgtcccccaggctggggtgcgatggcactatctcggctcactgcaacctctgcctcccagattcaagcaattctcctgcctcaaccttctgagtagctgggattataggcacctgccatcatgcctggctaatttttgtatttttagagagacgggggtttcaccatgttggccaggctggtctcgaactcctgacctcaggtgatccacctgcctcggccccccaaagtgctgggattacaggcatgagccaccgtgcccggcacatttttcttactattcctgctaacctgcagttccttgaatgcaccatgatctcttccatcctacctctttgacattttctcctgaaatgaccatctcccctgactcctccaaagtaaagcttcagtaaagccttctattttctattcctaccttccccaaggctgaaaaagtacctctcctttttgttctctagcaacctacacgtatgatttttacggcaaatgccatattgggtagaaattgttcattccacttgtaatttctctcgattatgaactacttaatactggggacaacacctttcatctttaaaaccttaaacttgggagaaaatagaaaatcaatgtatttttgttatggaataaataattttgagtgataaatgggtaaaaagcatattggatagaagaaagagcattggcaaaagcttacaacttctaaaactaatcatctcaaaattaccactaatctccatgttgtcaaattaagtggtcagttctcagatctgtcagcggcttttgtcgcaattggtcatagcatccacctcgaaatactattctttttttta

SEQ ID NO: 68 - DNA, 24812 bp, Homo sapiens
cgccaccacgcccggctaatttttgtatttttagtagagacagggttttgccatgttggccaggctggtctccatctcctgacctcaggtgatccgcccacctcggcctcccaaagtgctgggattatgggcgtgagccaccgcgcccggccactagaagagttttactacacgtgttacggagtaatgaaatggttcactcgtttcagcatcaaatcatcttttcaaagtaaactgcatttctaaccgcttcttcttgaggcaataaaaaacacagtgccatctcatctttattttgtgctactagaagatgctatccgttaaaaatgactgtgttccccaagaatgtgttcatataattttggatgcaatgcaaaatactttttatggtggtcttctaccaaacacaaaaagcagtaccgaacctgtgaatgccgcaagctacacacaccctaggagagagcgcccccttgtgggaatcagtcacatcaacagattcagacacaccaacagctggctccaacgcggggagcactcaacaagtcttgacccttctgtgttctgatttcaacagctttgattgattgattgattgactgactgagacggagtctcactctgtccctcaggctggagtgctgtggtgcgatatcggttcactgcaacgtccgcttcccgggttcaagtgattctcctgcctcagcctcctgagtagctgggactacaggcgaccccccaccaagcctggctaattttttgaatttttagtagagacggggtttcaccgtgttagccaggctggtctcgaacccctgacctcgtgatccgcccgcctcggcctcccaaagtgctgggattacaggtgtgagccaccgtgcccggccctgcaattccttttctaatgaaaaaagtcattaggagaataaaatgaatttgcatggataaagcactttctatgaaaacataaaacatttgctacacaagtcaatgaattaataaacatggaaaaccacataacacacatatattcaataacacctgctttcaaaggtggtcacgttctttcaaaaatagttcagtccttccgttctttgctccagacccacttttatatgacccaggacaaaacagaaaatttaaaaacatttttggcagagaatacaaaatcagattaagtgacagaccatagtgatactgaaaatacataacttgagccacttcacagttttgaatgaacagagtgtgtaatccttttcatttccccctaaaaatgatatctatttaaaatagataaatattaatgcctctctatttggggcctaactatttactgtttttcacccaaataactcaacattctgaaacaaacaaacaaaggatcttacttttcctttgtctattatccctgatatcttcattttctccaagtagaagtattttctccaagtggaagcaatttagcatctggcacatggggtgggaaagctattgaaatggaatgtttttccctcgcaatagtacatgcagtcaaccaaccaaagtctgaagaacactgaaatcgagccaacaagtttctttttttttttttttttgtttttaagacagggtctcactttgtcacccgggctggagtgcagtggcacagtctcggctcactgcagcctcctcaacctcccaggttcaagtgatcctcctgcctcagccccacaagtagctgggactacgggcgcccgccaccacacctgactaatttttggtattttttatagagacagtgtttctccatgttgcctaagttggtcttgacctcctgagctcaagcagcacttcccaaagtgctgggattacaggcgtgagccaccatgcctggcccaaaatacttaaaattcaagttagctgcacaaatactacagtaagacaaaagaggccgggcgcattggcccggggtcacgaggtcaggagttcaagaccagtctggccaatatggtgaaaccccatctctactaaaaatacaaaaattagccgggcatggtggcgggcacctgtaatcccagctccttgggacgctgagacaggagaatcgcttgaacccgggaggtggaggtcgcagtgagctgagatcatgtcattgcactcaaacctgggcggcagagcaagactccgtctcaacaacaaaaaaaaaaagacaaaagacagtcgtgctgttaaaacggaaatactgggtgacaggcagtgccactgtgtgaagcagaagcaccagcaaggaaagcagaatggtctcaccaagaacacactggactcgggagactgatgacctgatgacctggatttaaatctattccgcatcatttcacacccacttcaccttcgacaagcgtctcaatacttaattttgtaaaatgagactgataatttctatcttaaccaaaagattattatgaagccaaaaaacagataatacatgaaaaaatactgtgtaagttactatagatctgttatccatatacaatgttacgtgttatgactgcacctcatctcactaatcatattctgccttgtatcatactaacctgagtatctgccttaattccctcgagcaccgagattagaaactcgtatggggccatgttggtctttttgaggcaggaaaatagggtctggagtcagggaacataaggcacattcacacttcagctatgacaggaaacatcccctccgtggggcgtaagccaagtaaatgactttgtaactttcctacctcctctcctttcacatacggcgtaccccaagtagagggtattcaaactcacaaaaactctgcaaggcggcctctgagcccctgtgcccgggctgcccccacactgtggagtgtgctttcatttccaataaatccctcactgctcccttgcttgctttgtgcgttttgtccagttccttgttcaagacgccaagaacggctgggcacaggggctgtcacctgtaatcccagcactttgggagaccaaggcaggtgggtcacctgaggtcaggagttcgagaccagcctggacaacatgatgaaaccctgtctctactagaaacacaaaattatccagctgtggtggcgggcacctgtaatctcagctactcgggaggctgaggtgggagaatcgcttgaacccaggaggtggaggttgcagtgagcccagattgcgccactgcactccagcctgggcaacaagagtgaaactccatctcaaacaaacaaaaaaagtgggcaaaggacatgaatagatatttctagaagaagatacacaaacaggcaacacatatgaaaaaaatgctcaaaatcactaatcatcaaggaaatgcaaattaaattaccagaaggagagaccaccttactcctacaagaatggttgtaatttaaaagtcaaaaagcaataaatgttggcttagatatggtgaaaagagaacacttggccgggtgcagtggctcacacctgtaatccccacacgttgggaggccaaggtgggtgggtcacttgaggtgaggtcaggagtttaagaccagcctagctaatctggtgaaaccccatctctactaaaaatagaaaaattagccaggtgtggtggcacacgcctgcagtcgcagctactagcgaggctgaggcaggagaatctattgaacctgggagccggaggctgcagtgcgccgagatcgcgccactgcactccagcctgggagacagcgagactccgtctcaaaaaaaaaaaaaaaaaaaaaaaaaaaaaaagagttcgagaccagtctggccaatatggtgaaaccccgtctctaataaaatacaaaaattagccgggcatggtggtgtgcacctgtagtcccagctactcaggaggctgaggcaggtgatccacccgccttgagcacccatgtccagcccagaaaaacaaattttaaaaagaatcagggccaggcacagtggcttgtgcctgtaatctcaacactttgggagactgaggcgggaggatcgtttcagcccaggagttcgagactagcctgggagaaactccatctcaacgtggagaaactccgtctctacaaaaaatacaaaaattagctgggcctggtggcacgcatgtagtcccagctactcgagaggctgacgtgggaggatcactttaaccggggaggcagaggttgcaggagctgagattgtgccactgcactccagcctgaataacagcgtgagaatccgcctcaaaacaaagaaacaaaaaccacacacacacacacacacacaagttgtactagtggttccagccagtgcaagtgggcaagataaacgcataaaagaattaaaactgtatagattcatagacatgattatgtagaaaacctgaaggaatttacaagcaaaagaaagcagcccactagaactaatacgtccgtttagcagggttgcagactaaaatattaatagacaaaaataaattatatttctttaaagtagcaacgagcaatcaaaagaaagctttgaaatgtaaaaagcaagcatttgcagtcccatcaaacattattaaatgctcaggggaagatgtgagacaatcattgacagacctgtacacactgaacagcacaaaacattacttaagttaaagaaggcccaaacaggccgggcgcggtggctcacgcctgtaatcccagcactttgggaggccgaggcgggcggatcacgaggtcaggagatcgagaccaacctggctaacgcggtgaaaccccatctgtactaaaaatagaaaaaattagccgggcgtggtggtgcgctcctgtagtcccagctacttgggaggctgaggcaggaaaatcgcttgaacccaggaggcggaggttgcagtgagccgagatcgcaccactgcactccaggctgggcaacagagcgagattccgtctcaaaaaaaaaaaaaaaaaagaaaaagaaaatatagagatggcaaatggcacataacaagatggtcaatatcaattcctagtcactagaaaataggcattaaaagtgcaagataccaccataaacctatcggagaggcaagatgtcaatgccggactatgctgagtgctggagatgatgtggaggaatgggagcgttcatatgcactggtgaaaacgtcaaatggtaccaccttgtaaaactactggatagtttccaaaaaagttaaatatactcctgccatgccatccaaccattccgccatttatccacaagaaaggaacgacatgcccatataaagacttatacgcaaacacttacaggtgctttatttgtcatggacaaaaactggaaacacccaaatgtccatcaaataggtgaataaacaaattgaggtatatcaaacaatggaatacgtctcagcaataaaaggaatgaaaggaataaaaggaataaactactgatacgcacagcttgcagtgagccgagatcacgccactgcactccagcctgggagacagggtgagattccatctcaaaaaaaaaaaaaatgttaatagctccccagatcgatttatagatttaataaaatcataagcaaaatcccagcaggtttctgttgttgctggtctgttactgaaatcgacaaactgattcttaaatgtatgcggaaatgcaaaaaccaataaaatcttgaacagcaaacctggaggcctcacgttaccgaatattgaattattttaaatctagtgtggcactggcattaggacaaatagaccgatgaggaaatacattgtgctaggaccattggatctctatatggaaaaaattttaaccatctccctcataccatgcacgaaatagattctagatgattctacatctagccatgacaggcaaaccattcctagaaaataacataaaagattcatgacctggccgggcgtggtggctcacgcctgtaatcccagcactttgggaggccaaggcaggcagatcacctaaggtcaggagttcgagaccagcctggccaacatgatgaaaccctgtctctactaaaaatacaaaattagccaggcgtggtggtgcatgcctgtaatcccagctactcaggaggctgaggcaggagaatcgcttgaacctgggaggtagaggttgcggtgagccgagatcttgccattgcactccagcctaggcaacgagagcgaaactccgtctcaaaaaaaaaaaaaaaaaaattagcctggcgtggtggagcgcacctgtaatcccagctacttgggaggctgaggcaggagaatcgcttgaacctgagaggtggaggttacagtgagccaagatggcgccactgccctccagcctgggcataagattgagactccgtctcaaaaaaaaaaaaaagatttatgatcttagaatagacaagtattttttaaataggacatagaaagtgcttaccttaaaggaaaagatggataaactggactgtattaaaattaagggcttctgttcctcaaaagacatcattaagagaatgaaaaagcaaggcacggcatggaagaagacagtaacaaaaacaactccaaaaacatactaaataaagacgcttagaaatcggtatcaaaacgacatcccaacagaaaaccgggcaaaaagtgtgcatgtaacaacagagatatccaaatgttcaatatattacaaagtgcttaacctcattagtaatcagagaaatgcaaactcaagccagaattaaacctcctacatacccacctacatacccaccagcatcactgtaactaaacaatgatcaggctgatatagtggctcatgcctgtaatctcagtgctcagagaggctgaggctggaggatcgcctgagaccaggagttcctgaccagcctgggccatgtagtgagactccatctctaccaaaaaataataataaataaattaaattacccaggcatggtgacacacacttacagtcctagctactcaagaggctgaggtggggctggtggctcacgcctgtaatcccagcactttgggaggccaaggcaaagttgggaggcaagatgaactgaggtcagcagttcgagaccagcctggccatcatggccaaccccgtctctcctaaaacacaaaattagccaggtgtggtggtgggcgcctgtaatcccagctactcgggaggctgaggcaggagaatcacttcaacccgggaggcagaggttgcagtgagctgagatcgcgccactacactccagcctgggcaacaagagtgaaactccatctcgaaaaaaaaaaaaaaaaagaggctgagatgggaggatcatttgagcccaggagtttaagaatgcaatgaactattaccatgctactgcatgctcaccagagtgatagagtgagaccctgtctctctaggaaaaaaaaaaaaagtgatcttatccaacgtcagtgaggatgtggagtagctggaactctcaaacccagctgataggactgtaaaatagtacaactcatttaaaaaacttttatagtttatctactgttcatctctaatgacccagttaattacttataaatgcacacatgtatatgccaaaatacatgtccaagaatattcgtaacattatttgtaacatccaaaacatgaaaatactccaatgtccatccacagaacagtggtatacaattgccacagaatactacatagctatgaaaacacgctattatcacaatgacatggattcataccacaaacacgctgacagataaaactccagaaaatactgtatgattccatttctatcaaattcagaaactaccaagactaactgaagttgataaaacactagtttccattttgggggtaagagagtaaacactgggagggggtcataacggggtcttataggatgctggtcctgttctatttcttgatgtgggcggtggttaaatggtgcattccctttgtgaaaatgcatgaagctatacacctttggtttggtttatgtttctacgttacacttgagtaaaagtttactttaaaaatacaggaacagcatacaagaacacttccaggccgggcgcggcggctcacgcctgtaatcccagcactttgggaggctgaggtggacggattgcttaaacccaggagttcgagaccagcctgggaaacatggtgaaactccatctccacaaaaaatacaaaaattagccaaacgcggtggtgcacgcctgtggtgctagcgactcgggaggctgaagcaggaggatccctggagcccaggatgctgaggtcagtgagccatgatcgtgccactgcattgcagcctgggcgatagagcaagaccctgtctcacataaaaatgaaaaaataactttctgtctccccttatacacagcaggccggctacctccagtccagcacagtgaactggtgctacaagggccaacccaggctctgccccaaagcaggagctgagaccgtttcctagaaggcaggcccactggaaatgtctccaccaaaagcagctacaaacgaatatgaccttcaggtattaaggctttggttctctagaaaactgtcacggcactgaggtaacttgacaacccataatcgctgttctccatgtaaactgtggctctatttgtccaaggtgaagtatcgtaaattgaaatgaagtactcaattgtaaattttttttttaaatttccaaattaagctaaattaaaaaaacaaaaattgccaaaaccttaacctacaaaataaactttttggacagtagccacctgagctctaaataattgtatcatttatatttcaaatctaatacactggtgaatatgcgtattgcagcttttccaagacacgtattaatcatgaaacatgtactgacctcgaaaatgtggccgcgcgcggtagctcacacctgtaatcccagcactttgggaggccgaggcaggcggatcacgaggtcaggagatcgagaccatcctggctaacacggtgaaacccggtctctactaaaaatacaaaaaattagccgggcctggtggcgggcgcctgtagtctcagctactctggaggctgaggcaggacaatggtgtgaacccgggaggcggagcttgcagtgagccgaggttgcaccactgcactccagcctgggtgacagagagagactctgtctccaaaaaaaaaaaaaaaaaaaaaagtttaaatactttaaatgatcactttagaatatattaataagggggaatatagtatttcaagaaaatagttttaatgaagagcaaaaggtagtatggcctaatgagactcttcagtgacacagatgaactgaattctgtatttgaattattagccatgcagctttcagcaagttccttaactacttcccattcagcttttcccatctgcacaatgcaggctcacctgattattattgagcgcttacgtgtgagattccagacattgcttagtaacgagcacagtgcctggtgcaaagctggtacgcaatgttagcaaaactattattattttttttttgagacaagaatctcgctctgtcgctcaggctggagtgcagtgctgcgatctcggctcactgcaagctccgcctcccgggttcacgccattctccggcctcagcctcccgagtagctgggactacaggcgcccgccaccacacccggctaattttttgtattttttagtagagacgggatttcaccgtgtcagccaggatggtctcgatctcctgacctcgtgatccgcccacgtcggcctcccaaagtgctgggattacaggcgtgagccaccgcgcccggccaatgttagctaaatattaacagtatctattacaatcctacgaactcaaagaaacaggataaaacaacacagggcttggttttcctgatccaggttggatctgggagcattcccatttcctctcacagtgctcacaaaggcttcctttaatgacacactctaggatttcaccagttttccatgaactattacttgttacaattttcaaaagaacacaggggtcacacctttatcccgctttttcagcaagcctcactctcctctattgtcctaggatcaggaagcagctaatttggggtctcatttataaggctcaaggcatttgtctgggacagaagccaattaatgtctccatttatcccaccagtttcccctttcagtgatggaagttcatccccatcttcctataggaccgaaatttaactttgcagacgtgctgttctgaggacccacccggaacagagcatgtacacaaacccacttactgtcgcttctaacattgtaggaagcctttgggttttccaaggcagcaaagtactgagatttgtaattaaaaacacatattagctacattcaagttgtaactaactaaaaacttctacttaagtcgactgatcctcaaagtaagactcaaatcaaaaccagaaaagtttgggggcaattccctttccagcccacaaatacaggaactgggagtgacaccgtcctcacagggctacggcacctttctgcagcttccctggctccctttcaattttttttttttttttttttttttgagacggagttctgctcttattgcccagattagagtgcagtggcgcgatcttggctcactgcaagctccgccttccagtttccagcgattgtcctgcctcaggcctcccaagtcactggatgttaattacacccagcaaggtcgcccgccaccacgcctggctaatttttttgtatttttagtagagacagggtttccccatgttgtccaggctggtctcttaactgctgacctcgtgatccacccaccacggcctccgaaagtgctgggattacaggcgtgagccaccgcacccggcctttcaatttttgataaggatctttccttttttttttttttgagacagtctcactctgtcgcccaggctggagtgcagtagcgtgatctcggctcactgcaacctctgcctcccgggttcaagcgattctcctgcctcagcctcccgagtagctgggagtacaggcgtgcgccaccatgcctggctaattttttgtacttttagtagagacggagtttcaccgtgttagccaggatggtctcaatctcctgacctcgtgatccgcccgcctcggcctctcaaattgcagggattacaggtgtgagccaccgcacccagccgagtggtttctttaaactctgcaacagacttgacgaattccttggattttgacctttaagtgtagcaggtgtgctggaaacagagcaaatcaacttgaaagcttcttggaggttgctccaaacagcagcatataattatattcaatggtctccctatctctcggaaaagcaactcacaaaaacatgtttattctcattgccagcactcactaaacgctactaggatatcgctgatctgttcatttcctaaatctctgctactaacactttaaaccgagagtaaacttgcagtctcaacatccaattttagaagacaagtgtgacgaggaaggatttatcaactgaaaaatgtttactgacacagggaatctagaaatgtaccttccagatacatacaaatatttaagcaaaaactgttccaagggtatttcctgcagcacctgcccaaaaggagcaaactggtcttaacaaaatcaggtgtacatcaatgttacgcagtcagaatgagacacatctgaatgcctaacataaaaagatctacagtaactaggtatctatacacattgatgtataaactgtttatggaaagaagcttcttatacagtgtttctggaaagggagactgctatcctgctgtctataatgtgtgtatggattactaagaaaggattgagtaattctccactactgccactagcctctggaggaagagggcacacagtttttacctctaagaattattataagacattcagccttatttggttgtatgaaatactatgctagaaaatgatccataattacaccttgtactactcatgttgtactttaatgattaaaataaataccatgttgctgcctggtctggaggacaagacacaccatcaactgactcagtgttcttcacaaccagactacaggcaatttttttccaaaacatacatctttgggaagcaaacaaattatttatggaagaaaaaaggaggaatgtttcacattcaggcaaacataatactgtcagtgtgtttggactagagattttattttagaagtataaaggatggaggcgcgatatttggcatttttaatttaggtttgttttatttaagtttaatgttaattccatgctgtgtttcagtaagaacaatacagattctgtatctgtggctccagtcagatatccagtagtacaaattagcttcaagttacacatactgaacaaaagaggttgagcgagcgaaggaggggaggagtgaggggaaggaggtagggggagggggaaggagaagaaacaaaagaattgaacaggcatgcaggcttttccataccaccttcaacgctaacctgcttcagtgggagagtaaagtaggcaagaatgagcagccacggattgttgaactgttaccagcaccatgcttttcagcaacatttcagcggagttggaaacattttttacagcaaaaccattacaacgaagtccctccccaaaccacctttaaccatctcaagctaacacccaattacttgcaaacactggtataaaacacagtttaaacaattagaaaaatgaaaactgataccacttatgcctctatagtgtgattaacctctctcttagatgcttgcatcacctataagtctaatggctttcaaatgtaatttccatttgctaatggtgatcttgccacatctggcacggagacgacacagtaatgctgaaaaagcctctatgtagtcctgttagtgtcttaaagaacctaaaagctgggaccagtaaaatccacagaaattcactcttgcctttaagaacttttgaaaactgtttaaaaaaaaaaaaaaaaaaccaacagggcaggaacctaaattctgagaccaaatgtaaaagtcagatttggtggttctcagtgacaatggggagtttccaaagggtgggatggggaggagggggtggtcagagatggtttctcttgttggcttatgtctcactgattttcgtcttccacgtcctgcagcgcttctttattctgctcttcacctgttaaaaaagaaaaaaagtcaattatttcgtattgactacattaggctatggcagccacaaacaaaggtgtcattccaagcataaagactcttctacttgctacaattggtattaaacgcaggcaaaggacttctatcatccttgacacctgagatgcctaagccaagaagggattatggtcctgaaagtatttattggtcaacagaatgaaaaaaactgatgcgcagtacaactcaatgtttttacgctaaataagctcttgacgtagacagccaaggaaaccatcttactaaaatgacattcaagctttcacataaatcttgggtcaaaatactctttctcaataacctcacctcttcaagaatcaagagtattttgcaaactttttgcaaaatctaatttacccacaagctaattatcagaaatgcttcaaaatagttaactgagcaataaactgttgccaagaagttctatcgtattttattgtggggttctgctgttataaatatttcagcttttgtatcttggccagatacaccaaactataatcagattttacttcagagtgaaacacagcatgctcaaagtaaatcagaccactgaggttattaaagaatggcatttggaccacttcactcatgctatttgtcttttgcctttaaagagggtgattaccctaaggagtttcaactgcactatgacatgcaacagaaagccacctattggttggagggtcatctacctattagtatgcattaaacaagtcagccaaaataaagaagcatgcaggcttttcccttaaaaatgatgtaacaggtaaaagttacattcacttgtacttttttaaaaaaaccacttacaattactacacagttaactagtttgaaacaaaataaatgaaaaatcaacccaagaatcataaatgttcaaatgactatccattcataatgcttgttaaattatttaattaggatggacaaataacaccaaactagctgcctacacacatgaagcatttacactgagtacagctttgaaacagcctaaatgatctcaaaatgacaaatgtcacagcatcaaggtttcagtagttttcaaatctcttctgcggcggaaacgcttgacattgctgtgtgacttcaaaacccacttacagcctcagcaacacagtgaagccctgtctctacaaaaaatgaacataacgccgggcacggtggctcacgcctgtaatcccagcactttgggaagcaaaggcgggcggatcacgaggtcagaagatcaagaccatcctggctaacacagtaaatccccatctctactgaaaaaataatacaaaaaattagcctggcgtggtggcacatgcctgtaatcccagctacctgggaagctgaggcatgagaattgcttgaacccaggagacggaggttgcagcgagccaagaacatgccactacactccagcctgggtaacagagtgagactccgtctcaaaaaaaaaaaaaaaagaataaataaaactaaaagtaaaaaactatgtatgctggagccaggcatggtggctcacgcctgtaataccagcactttgggaggccaagagaggtggatcatgaggtcaggagatcgagaccatcctggctaacacagtgaaaccctgtctctactaaaaatacaaaaaaaaaaaaaaaaaattagccaggcatggtggcaggcgcctgtagtcccagctactcgggaggcaggagaatggcgtgaacccaggaggcggagctttcagtgagccaagattctgccgctgcactccagcctgggcgacaatcgagactccgtctcaaaaaaaaaaaaaactacatacgctgggcatggggccacatgtctatagtcccagctacttggggggctgaggtgggggagttctatttctgcagtgagctttgaacgccactgcactccaggcggggcaacaagagcaaaactccgtctcaaaaaaatgtataaaattttaaaactacttaaaatacatgaagatctttaattcataagacagaaaaaaaatatgcaaaggcaaaaaaaaattgcttagggatgaaagaactgatgggcacccaactgttctccaaaggacaataacgtattcaaacgtaggaaacatgataggaacattcactctaacagcaaatcactgccaaagtatcattaacacaaacactagaacacaactcgcttgtaagcaaccatgagatgtgccagaagttccaagtaactttggcataaaaatgtcactgtcatatacatcacatccaaccacagtaggcaggaggagcaggccggaaaaggcttaggtcagcgccctggaaggtggaacaggcagagtctgtaagcaacaggacgatcatacgcaggcatgattagtgaagaaccaaaactgaaagcggaattcactgtgccatgaacgtgacttacaaagtagagtttttaggaaaggaagagttgggttttcctttaggaatctatattgcaaggaaaaagggagggagaacaatcatatgaaagcaacattacaagaaaaataaaccaacagagcaggacaaaggaaaacaatgatacaggagccggactttggtcttacttcgtgtaaacttcactctaagcaacaatctgtctactcctcctcccttctactctgagaaggaagtaatatcctcttgaaagacatacagatattaggggaaaaaggattccttggctatgtttctttgcccagtgtatctacattttggagagaggggaacaggcagggagaacatgtatttcctacctatggattcgtatatgaaacaatcctcttaccacagggtgaagagactaaaatcacttgagaaaaagcaatgatccctccctttaaagaaattatgttccaacatgctgggacagacattaacatattctaaaattaaaagacataaataccgtctctttaaaaaacaaaaaaatctaaataatccttaaactaaatgcaaagtcacatcctagtaaactgccactttcatgacgattctcctatattcaccacggaacccaagtcacaaaagtagtattttattttgtgagatgaagttttatcttgcccaagctggtgtcaaactcctgggctcaagtgatccttctgcctcaccttgctgaacagccgagattacaggcaggcaccattgcagtttcaaaaccaatttattaaaaaatgtaggccgggaacagtggctcacgcctgtaatcccagcattttgggaggccgaggcaggcggatcacgaggttaggagattgagaccatccgggttaacacggggaaaccccgcctctactaaaaatacaaaaaaaaattagccgggcatggtggcgggcacctgtagtcccagctaccaggaaggctgagacaggagaatggcgtgaacccgggaggcggagtttgcagtgagccaagatagcaccactgcactccagcctgggtgacaaagcaagactctgtctcacgaaaaaaggaaaaaaaaaaaagatgtaatactaggccaggtgcggtgactcgggcctgtaatcccagcactttgggaggctgaggcaggtggatcacgaggttaggagattgagaccatccgggctaacacggggaaaccctgtctctactgaaaatacgaattattgccaggcgtggtggtgggcacctgtagtcccagcaactcagagaggacgaggcagaagaatcgcttgaacccgggaggtggaagctgcagtgagcagagattgcgccactatactccaccctgggcaacagagtgatactccatctcaaaaactctaatttttgacaaattcaacttctcaaactgatgaacaatttctttgtacccacaattatttgtgtattcagagtttgttagttgtaccggaatgtcaacagaccacctgaatttttcactgttgaactatttcatgactggaagcattatataaataaaaagtatttcacctaataaaaattaagtgaaaattactcttcttaaccaaatttaatcaactgatttacagactcaataaggaattgaacacaaatgaatttcactagattttttttttttttgagacggagtcttgctctgtcgcccaggctggagtgcagtggtgctatctcggctcactgcaagctccgcctctgggttcaccccattctcctgcctcagcctcccaagtaaatgggactacaggcgcccaccaccacgcccgggtaattttttttgtatttttagtagagacggggtttcactgtgttagccaggatggtctcaatcttctgacctcgtgatccgcccgcctcagcctcccaaagtgctgggattaaccggcgtgagccactgcgcccagccgaatttcactagatttttaaaaactgcgaaagtattaccctgtattttttttttttggacgaagtttctctcttgttgcccaggctggagtgcaacggcgcgatctcagttgatcacaacctccaactcccaggttcaagcgattctcctgcctcagcctccccagtagctaggattacagacatgtgacacgacgcctggctaattttgtatttttagtagagatggggtttctccatgttggtcaggctggtctcgaactcctgacctcaggtgatccacccgcttcggcctcccaaagtgctgggattataggcgtgagccactgcaccaggccgtattaccctattttaagatgatccatttcctaaaactgtactcgacaaccaagaataaggattatctttagttctgtacatagactgacaggtagtctactttgattaatcaactcttggttatcagtgataatgagctacagaagtaatccagacttggttatgagttggtatcaaatgtgttttcttgttttgtttcgtttctttgagacagagttttgctcttgttgcccaggctggagtgcaatggagtgatcttggctcactgcacctctgcctcccgggttcaagtgattctcctgtctcagcctcctgagtagcagggattacaggtgcccgccaccacacctggctaatttttgtatttgtagtagagacggggtttctccatgttggtcaggctggtctcaaactcctgacctcaggtgatccgtccacttcggcctcccaaactgctgggattacaggcatgagccactgtgcccagcatatgtttttattaaaataataataataaaaaaaaatggccaggcgcagtggctcacgcctgtaatccaagcattttgggaggccgaggcaggtggaccacgaggtcaggagttagagaccagcctggccaacatggtgaaaccctgcctctactaaacaaacaaaaaactagctgggtatggtggcgcacgcctgtaatcccagctactcaggaggctgaggcaggagaatcctttgaacccaggaggcagaggttgcagtgagccgagatcgcaccattgcattccaatctgggcaacagggagagactccgtctcacaaaacaaaacaaaaaatcagccaggcgcggtggctcacacctgtaatcccagcgctttgggaggccgagatgggcagatcacaaggtcaggagttggagaccagcctggccaacatagtggaaccccgtctctattaaaaatacaaaaaattagctaggagtggtggtggcagacacctgtagtcccagctactagggaggataaggcaggagaatcagaggcaggagaatcacttgaacccaggagatgtaggttgcagtcagctgagagagcaccactgcactccagcctgggtaacaagagcaaaactccatctcaaaaaaaaaaaataaaacacacacacagaaaaaactttcaagtcaggtcactttcattacttattacttttactctcaaaaacatgtccccagaggtgagaggtgtatcatttcctgaagtcaatcccgcgccccaaactctccgcatgctttccctccatcaacaggcagagagatactagcatctgagctggggatgaccattacgagtccacagctgtttgaccattcttcttcataattgttgttacaactttttttcttccctgaagagatggcatctcgttcagtcatccaggttagaatacagtggcgcaatcgaagctcactgcagcctcaagatcccccaacctcagccgtctgagaagcatgcgttgtcacacctggctgttgtttttgttttttgttttgagacaaagtcctgctctatgaagcctcgctctgccacccaggctagagtgcagtggggcgtgatctcagctcactgcaacctccacctcctgggttcaagcaattctcctgcctcagccttgcaagtagctgagattacaggcacataccactgcacccggcattttttttttttttaaagacagggtcttactatgttgcccaggctggtcttgaactcctaggctcaagcatcttcccaccttggcctcccaaagtgctgggattacaggcacaagccactgcaaccggcataggacagattttccagctggaagccacttgttcacagttggtaaattatttctgagtcccaagggctgggagtagctgcctgaaatgctgcgctgggaagtgttctgtggctccatctggcactgttgcaagtgtgtaagtaagtcctacgtatgtgaatatctcatgccaatcctgatctagtcaaatcctaaacatatcataaagctagtaaatgttaaaagctgagtcacctaattctcactttagtaccataacccaaaagtcacaaatctgatttgatccttccagagaaaagacacatacgtgcccactttcagaagcattttcaaaaagtataacacttccaaagacaatacagcaggtccgtttccccaaaagaaactacagatagcctcaagcaacgcgacatatgttttatgtttcagcctaagaaacgttatctcttttttttttttttagatggagtcttcctctgtagcccaggttggagtgcaatggcgtatctctcagctcactgcaacctccgcctcctgggtttaagcaattctccggcctcagcctcctgagtagctgggactacaggagcccgccaccacgcccagccaattttttgtatacttagtagggacggggtttccccgtgttagccaggatggtctcgatctcctgaccgcgtgatccacccgccatggcgtcccaaagtgctgggattataggcatgagccaccgcgcccggcacagccttagaaacattcttaaaggaaccgcagctaaaactgacatcagactttgtttacaacctcctaccagcaccaccaccaccaaatgtaaaactatcctgtaatactcctatcacactaatttgtcctcttctccatccctgttcaacaatctaccatggatcaaaatgattctctagacagagaataaaatttcctttaaaatcaacaaacataacaaatttgggctcctgtatttaaagtaaacattaacacacactcaacatcacaattaagtttactaaaatactctgaagcgtttgcaatgaaaacctcttaagaataaaaacaggccgggcacggtggcttgcgcctgtaatcccagcactttgggaggccgaggcgggtggatcacaaggttaggagatcgaggccaacctggctaacacagtgaaactccatctttactaaaaatacaaaaaactagccaggcgtggtggcaggcacctgtagtcccagctactcgggagactgaggtgggagaatggtgtaaacccaggagacggagcttgcagtgagccaagatcgcgccactgcactccagcccggtcaacagagcgagactccatctcaaaaaaaaaaaaagaaaagaaaagaaaagaaaagaataaaaacagcagggcgcagtggctaacgcctgtaatccctgcactttgggaggctgaggcgggcagaacacctgaggtcaggagttcaagaccagcctgaccaacatggagaaatcccgtctctactaaaaatacaaaaactaggtagtcgtgataacgggtgcctgcaaccccagctaccctgggaagctgaggcaggagaatcgcttgaacccgggaggcagagtttgcagtaagccgagattgagccaccgcactccagcctgggtgtcgcagcaagactccgtctcaaaaaaaaaaaaaagagacccaagggccaacattcaatttctctacagaatcccagagggaaatgggaaaccagttcccttttagataaaatatttcaacaaagagaaaaacttcataaatacctactgataccatctggatttaaatacacttaacttcagccccctaaaattgaattgaatgaagataaaataaactgcttgctctccactcctcctgtcctcaacctttgaaacagtgtaaaggaagagctaaactaagttcccaaaatggaactccgtactgtagcaccatttcctataaaggcagcaattacaatttcatagagggcaggcggtgaatctaaattctagcttgatataacgacaagccaaggaatgtctaaagagagtacaaacaaatcctgcaactgaaagaggtgcctgtttcactccgtgcttgcttaccgtcaccctgcatgtctgaagtccatagtgtcagattatcacgtaacaactgcatgataagtgtagagtccttatagctttcttcactcagcgtatccagttctgcaattgcatcatcaaaagctgcttttgccaacctaaaggtatttcaatagaagtgttataaaaattaagtccaaaatcagaattagaaatgacatgctagacagcaatcttttcttcagttattccagtttgtaatagtcacaatgataatgcaaagaaaaagcaaatacaataaaaattaacttaaaggtatgtggaacactacttcttactatgctttaagcctgctactgatatgctataatatacatatcgactaataaaatacatagaacaacttccatcctaaaccatcaccaaaaaatatacctccaagttctaggcaatagttcacttatttcaaaaagttttgtttgtttgtttttaagacggagtctggctctgtcgcccaggctggagtgcagtggcgtgatctcggctcactgcaagcttcgcctctcaggttcatgccattctcctgcctcagcctcccgaatggctgggactacaggcgcccgccaccacacccggctaattttttgtatttttagtagagatggggtttcaccgtgttagccaggatggtctcgatctcctgacctcgtgatccaccagcctcagcatcccaaagtgctgggattacaggcgtgagccaccgcgcccagcctagtttttttttttttttttttttttttttttttttaagggattcgttatgttgcccaggctggacttgaactcctgcgttcaagcaatcttccgaaccttagcctcttgagtggctgggacaaacggtacacactaccacccccaagattttttaaaaaaaaaaaaaaaaaaaaaaaaaaaaaaaattttttttttttttttttttttttgggggacggggtctcgctctatcacccaggctggagtgcagtggcgggatgtaggctaaatgcaagctccgcctcctgggttcacaccattatcctgcctcagcctcccgagtagccgggactacaggcgcccgccaccacacccggctgatttgtttttatatttttagcagaggcagggtttcaccgtgttagccaggatggtcttgatcttctgacctcgtgatgtgcccgcctcagcctcccaaagtgctggattacaaggttgagatatttaacaaagtattaatgcaaaaagaaaatcttggacaatacctcaaagtttaaaaaaatttaatttcacgttaatggaggcagggaagcaaagaaaataaaaggcaacacagacgccatggaaatgtgattatgtaagccatttacagttttaaaagaaaatccacacttactgagtactgtgtactatgtccaacaaacgatacgatataccaatagaaaaaaaagagacataatctaagtccacatcaacttaaaaatttagaaatggagggtagacaaatacataactattttacaaggaggaggctggctgtggtggctcatgcctgtaatcagcacactttgggtggctgatgcgtgcgcgcagatcacttgaggccaggagttcaagaccagccgggccaccatggcaaaacctattaaaaacacaaaaaattaggccgggtgcagtggctcaagcctgtaatcccagcactttgggaggcagaagcgggcggatcacgtggttaggagatcgagaccatcctggctaacacagtgaaaccccgtctctactaaaaatacaaaaaaattagccgggagcagtggcaggtgcctgtagtcccagctacttgggaggatgaggcaggagaatggtgtgaacccaggaggcggagcctgcagtgagccgagatcacgccactgcagtccagcctgggcaacagagcaagactccgtctaaaaacacacacacacacacacacacacacacacacacacacacacacaaaattagccgggcatggtggcgtatgcctgtaatcccagctactcaggaggctgaggcagaagaatcccttgaacctgggaggcggaggttgcagtgaggtgaaactgtgccaatgcactccagcctgggcaagagagcacaaaaacaaaagaagaagaagaatgaagtgctattccaaataaagtatttcagggacccagaaggaggagcaattaaagggaaagtcaaatttgaactaatctcaatggataaggagaaaacaaaacacacttcaggtttaagcagaagcatgagcaaaggcatgcgagtgactttaaactggagctacacgtgggacagctagactggagtctgacaaggaaaggtgcaaccaccagtattagctaaatagccacagcttcttcagttacgatccctatctggacaaactcaactagccatttagaatgtttttacattggctgggcgcagtggctcacgcctgtaatcccagcactctgggaggctgaggcaggtggatcacctgaggtcaggagttcgagaccagcctgaccaagatggtgaaaacctgtctctactaaaaatgcaaaaaaaaaaaaaaattcagtcaagcgcagtgaagcatgcctataatagtcaacattaaagttccaatgtatcagttaatcccctttcctcaaactttgaaaggctttcacttaaaaaccctactttgcttaagcagttgtcctcaaacaaaccaaaaaaaaacacatacaaaaaccaaaaggggccgggcgcggtggctcacgcctgtaatcccagcactttgggaggccgaggagggcagatcacgaggtcaggagatcgagacc

SEQ ID NO: 69 - DNA, 24412 bp, Homo sapiens
gtaaactgcatttctaaccgcttcttcttgaggcaataaaaaacacagtgccatctcatctttattttgtgctactagaagatgctatccgttaaaaatgactgtgttccccaagaatgtgttcatataattttggatgcaatgcaaaatactttttatggtggtcttctaccaaacacaaaaagcagtaccgaacctgtgaatgccgcaagctacacacaccctaggagagagcgcccccttgtgggaatcagtcacatcaacagattcagacacaccaacagctggctccaacgcggggagcactcaacaagtcttgacccttctgtgttctgatttcaacagctttgattgattgattgattgactgactgagacggagtctcactctgtccctcaggctggagtgctgtggtgcgatatcggttcactgcaacgtccgcttcccgggttcaagtgattctcctgcctcagcctcctgagtagctgggactacaggcgaccccccaccaagcctggctaattttttgaatttttagtagagacggggtttcaccgtgttagccaggctggtctcgaacccctgacctcgtgatccgcccgcctcggcctcccaaagtgctgggattacaggtgtgagccaccgtgcccggccctgcaattccttttctaatgaaaaaagtcattaggagaataaaatgaatttgcatggataaagcactttctatgaaaacataaaacatttgctacacaagtcaatgaattaataaacatggaaaaccacataacacacatatattcaataacacctgctttcaaaggtggtcacgttctttcaaaaatagttcagtccttccgttctttgctccagacccacttttatatgacccaggacaaaacagaaaatttaaaaacatttttggcagagaatacaaaatcagattaagtgacagaccatagtgatactgaaaatacataacttgagccacttcacagttttgaatgaacagagtgtgtaatccttttcatttccccctaaaaatgatatctatttaaaatagataaatattaatgcctctctatttggggcctaactatttactgtttttcacccaaataactcaacattctgaaacaaacaaacaaaggatcttacttttcctttgtctattatccctgatatcttcattttctccaagtagaagtattttctccaagtggaagcaatttagcatctggcacatggggtgggaaagctattgaaatggaatgtttttccctcgcaatagtacatgcagtcaaccaaccaaagtctgaagaacactgaaatcgagccaacaagtttctttttttttttttttttgtttttaagacagggtctcactttgtcacccgggctggagtgcagtggcacagtctcggctcactgcagcctcctcaacctcccaggttcaagtgatcctcctgcctcagccccacaagtagctgggactacgggcgcccgccaccacacctgactaatttttggtattttttatagagacagtgtttctccatgttgcctaagttggtcttgacctcctgagctcaagcagcacttcccaaagtgctgggattacaggcgtgagccaccatgcctggcccaaaatacttaaaattcaagttagctgcacaaatactacagtaagacaaaagaggccgggcgcattggcccggggtcacgaggtcaggagttcaagaccagtctggccaatatggtgaaaccccatctctactaaaaatacaaaaattagccgggcatggtggcgggcacctgtaatcccagctccttgggacgctgagacaggagaatcgcttgaacccgggaggtggaggtcgcagtgagctgagatcatgtcattgcactcaaacctgggcggcagagcaagactccgtctcaacaacaaaaaaaaaaagacaaaagacagtcgtgctgttaaaacggaaatactgggtgacaggcagtgccactgtgtgaagcagaagcaccagcaaggaaagcagaatggtctcaccaagaacacactggactcgggagactgatgacctgatgacctggatttaaatctattccgcatcatttcacacccacttcaccttcgacaagcgtctcaatacttaattttgtaaaatgagactgataatttctatcttaaccaaaagattattatgaagccaaaaaacagataatacatgaaaaaatactgtgtaagttactatagatctgttatccatatacaatgttacgtgttatgactgcacctcatctcactaatcatattctgccttgtatcatactaacctgagtatctgccttaattccctcgagcaccgagattagaaactcgtatggggccatgttggtctttttgaggcaggaaaatagggtctggagtcagggaacataaggcacattcacacttcagctatgacaggaaacatcccctccgtggggcgtaagccaagtaaatgactttgtaactttcctacctcctctcctttcacatacggcgtaccccaagtagagggtattcaaactcacaaaaactctgcaaggcggcctctgagcccctgtgcccgggctgcccccacactgtggagtgtgctttcatttccaataaatccctcactgctcccttgcttgctttgtgcgttttgtccagttccttgttcaagacgccaagaacggctgggcacaggggctgtcacctgtaatcccagcactttgggagaccaaggcaggtgggtcacctgaggtcaggagttcgagaccagcctggacaacatgatgaaaccctgtctctactagaaacacaaaattatccagctgtggtggcgggcacctgtaatctcagctactcgggaggctgaggtgggagaatcgcttgaacccaggaggtggaggttgcagtgagcccagattgcgccactgcactccagcctgggcaacaagagtgaaactccatctcaaacaaacaaaaaaagtgggcaaaggacatgaatagatatttctagaagaagatacacaaacaggcaacacatatgaaaaaaatgctcaaaatcactaatcatcaaggaaatgcaaattaaattaccagaaggagagaccaccttactcctacaagaatggttgtaatttaaaagtcaaaaagcaataaatgttggcttagatatggtgaaaagagaacacttggccgggtgcagtggctcacacctgtaatccccacacgttgggaggccaaggtgggtgggtcacttgaggtgaggtcaggagtttaagaccagcctagctaatctggtgaaaccccatctctactaaaaatagaaaaattagccaggtgtggtggcacacgcctgcagtcgcagctactagcgaggctgaggcaggagaatctattgaacctgggagccggaggctgcagtgcgccgagatcgcgccactgcactccagcctgggagacagcgagactccgtctcaaaaaaaaaaaaaaaaaaaaaaaaaaaaaaagagttcgagaccagtctggccaatatggtgaaaccccgtctctaataaaatacaaaaattagccgggcatggtggtgtgcacctgtagtcccagctactcaggaggctgaggcaggtgatccacccgccttgagcacccatgtccagcccagaaaaacaaattttaaaaagaatcagggccaggcacagtggcttgtgcctgtaatctcaacactttgggagactgaggcgggaggatcgtttcagcccaggagttcgagactagcctgggagaaactccatctcaacgtggagaaactccgtctctacaaaaaatacaaaaattagctgggcctggtggcacgcatgtagtcccagctactcgagaggctgacgtgggaggatcactttaaccggggaggcagaggttgcaggagctgagattgtgccactgcactccagcctgaataacagcgtgagaatccgcctcaaaacaaagaaacaaaaaccacacacacacacacacacacaagttgtactagtggttccagccagtgcaagtgggcaagataaacgcataaaagaattaaaactgtatagattcatagacatgattatgtagaaaacctgaaggaatttacaagcaaaagaaagcagcccactagaactaatacgtccgtttagcagggttgcagactaaaatattaatagacaaaaataaattatatttctttaaagtagcaacgagcaatcaaaagaaagctttgaaatgtaaaaagcaagcatttgcagtcccatcaaacattattaaatgctcaggggaagatgtgagacaatcattgacagacctgtacacactgaacagcacaaaacattacttaagttaaagaaggcccaaacaggccgggcgcggtggctcacgcctgtaatcccagcactttgggaggccgaggcgggcggatcacgaggtcaggagatcgagaccaacctggctaacgcggtgaaaccccatctgtactaaaaatagaaaaaattagccgggcgtggtggtgcgctcctgtagtcccagctacttgggaggctgaggcaggaaaatcgcttgaacccaggaggcggaggttgcagtgagccgagatcgcaccactgcactccaggctgggcaacagagcgagattccgtctcaaaaaaaaaaaaaaaaaagaaaaagaaaatatagagatggcaaatggcacataacaagatggtcaatatcaattcctagtcactagaaaataggcattaaaagtgcaagataccaccataaacctatcggagaggcaagatgtcaatgccggactatgctgagtgctggagatgatgtggaggaatgggagcgttcatatgcactggtgaaaacgtcaaatggtaccaccttgtaaaactactggatagtttccaaaaaagttaaatatactcctgccatgccatccaaccattccgccatttatccacaagaaaggaacgacatgcccatataaagacttatacgcaaacacttacaggtgctttatttgtcatggacaaaaactggaaacacccaaatgtccatcaaataggtgaataaacaaattgaggtatatcaaacaatggaatacgtctcagcaataaaaggaatgaaaggaataaaaggaataaactactgatacgcacagcttgcagtgagccgagatcacgccactgcactccagcctgggagacagggtgagattccatctcaaaaaaaaaaaaaatgttaatagctccccagatcgatttatagatttaataaaatcataagcaaaatcccagcaggtttctgttgttgctggtctgttactgaaatcgacaaactgattcttaaatgtatgcggaaatgcaaaaaccaataaaatcttgaacagcaaacctggaggcctcacgttaccgaatattgaattattttaaatctagtgtggcactggcattaggacaaatagaccgatgaggaaatacattgtgctaggaccattggatctctatatggaaaaaattttaaccatctccctcataccatgcacgaaatagattctagatgattctacatctagccatgacaggcaaaccattcctagaaaataacataaaagattcatgacctggccgggcgtggtggctcacgcctgtaatcccagcactttgggaggccaaggcaggcagatcacctaaggtcaggagttcgagaccagcctggccaacatgatgaaaccctgtctctactaaaaatacaaaattagccaggcgtggtggtgcatgcctgtaatcccagctactcaggaggctgaggcaggagaatcgcttgaacctgggaggtagaggttgcggtgagccgagatcttgccattgcactccagcctaggcaacgagagcgaaactccgtctcaaaaaaaaaaaaaaaaaaattagcctggcgtggtggagcgcacctgtaatcccagctacttgggaggctgaggcaggagaatcgcttgaacctgagaggtggaggttacagtgagccaagatggcgccactgccctccagcctgggcataagattgagactccgtctcaaaaaaaaaaaaaagatttatgatcttagaatagacaagtattttttaaataggacatagaaagtgcttaccttaaaggaaaagatggataaactggactgtattaaaattaagggcttctgttcctcaaaagacatcattaagagaatgaaaaagcaaggcacggcatggaagaagacagtaacaaaaacaactccaaaaacatactaaataaagacgcttagaaatcggtatcaaaacgacatcccaacagaaaaccgggcaaaaagtgtgcatgtaacaacagagatatccaaatgttcaatatattacaaagtgcttaacctcattagtaatcagagaaatgcaaactcaagccagaattaaacctcctacatacccacctacatacccaccagcatcactgtaactaaacaatgatcaggctgatatagtggctcatgcctgtaatctcagtgctcagagaggctgaggctggaggatcgcctgagaccaggagttcctgaccagcctgggccatgtagtgagactccatctctaccaaaaaataataataaataaattaaattacccaggcatggtgacacacacttacagtcctagctactcaagaggctgaggtggggctggtggctcacgcctgtaatcccagcactttgggaggccaaggcaaagttgggaggcaagatgaactgaggtcagcagttcgagaccagcctggccatcatggccaaccccgtctctcctaaaacacaaaattagccaggtgtggtggtgggcgcctgtaatcccagctactcgggaggctgaggcaggagaatcacttcaacccgggaggcagaggttgcagtgagctgagatcgcgccactacactccagcctgggcaacaagagtgaaactccatctcgaaaaaaaaaaaaaaaaagaggctgagatgggaggatcatttgagcccaggagtttaagaatgcaatgaactattaccatgctactgcatgctcaccagagtgatagagtgagaccctgtctctctaggaaaaaaaaaaaaagtgatcttatccaacgtcagtgaggatgtggagtagctggaactctcaaacccagctgataggactgtaaaatagtacaactcatttaaaaaacttttatagtttatctactgttcatctctaatgacccagttaattacttataaatgcacacatgtatatgccaaaatacatgtccaagaatattcgtaacattatttgtaacatccaaaacatgaaaatactccaatgtccatccacagaacagtggtatacaattgccacagaatactacatagctatgaaaacacgctattatcacaatgacatggattcataccacaaacacgctgacagataaaactccagaaaatactgtatgattccatttctatcaaattcagaaactaccaagactaactgaagttgataaaacactagtttccattttgggggtaagagagtaaacactgggagggggtcataacggggtcttataggatgctggtcctgttctatttcttgatgtgggcggtggttaaatggtgcattccctttgtgaaaatgcatgaagctatacacctttggtttggtttatgtttctacgttacacttgagtaaaagtttactttaaaaatacaggaacagcatacaagaacacttccaggccgggcgcggcggctcacgcctgtaatcccagcactttgggaggctgaggtggacggattgcttaaacccaggagttcgagaccagcctgggaaacatggtgaaactccatctccacaaaaaatacaaaaattagccaaacgcggtggtgcacgcctgtggtgctagcgactcgggaggctgaagcaggaggatccctggagcccaggatgctgaggtcagtgagccatgatcgtgccactgcattgcagcctgggcgatagagcaagaccctgtctcacataaaaatgaaaaaataactttctgtctccccttatacacagcaggccggctacctccagtccagcacagtgaactggtgctacaagggccaacccaggctctgccccaaagcaggagctgagaccgtttcctagaaggcaggcccactggaaatgtctccaccaaaagcagctacaaacgaatatgaccttcaggtattaaggctttggttctctagaaaactgtcacggcactgaggtaacttgacaacccataatcgctgttctccatgtaaactgtggctctatttgtccaaggtgaagtatcgtaaattgaaatgaagtactcaattgtaaattttttttttaaatttccaaattaagctaaattaaaaaaacaaaaattgccaaaaccttaacctacaaaataaactttttggacagtagccacctgagctctaaataattgtatcatttatatttcaaatctaatacactggtgaatatgcgtattgcagcttttccaagacacgtattaatcatgaaacatgtactgacctcgaaaatgtggccgcgcgcggtagctcacacctgtaatcccagcactttgggaggccgaggcaggcggatcacgaggtcaggagatcgagaccatcctggctaacacggtgaaacccggtctctactaaaaatacaaaaaattagccgggcctggtggcgggcgcctgtagtctcagctactctggaggctgaggcaggacaatggtgtgaacccgggaggcggagcttgcagtgagccgaggttgcaccactgcactccagcctgggtgacagagagagactctgtctccaaaaaaaaaaaaaaaaaaaaaagtttaaatactttaaatgatcactttagaatatattaataagggggaatatagtatttcaagaaaatagttttaatgaagagcaaaaggtagtatggcctaatgagactcttcagtgacacagatgaactgaattctgtatttgaattattagccatgcagctttcagcaagttccttaactacttcccattcagcttttcccatctgcacaatgcaggctcacctgattattattgagcgcttacgtgtgagattccagacattgcttagtaacgagcacagtgcctggtgcaaagctggtacgcaatgttagcaaaactattattattttttttttgagacaagaatctcgctctgtcgctcaggctggagtgcagtgctgcgatctcggctcactgcaagctccgcctcccgggttcacgccattctccggcctcagcctcccgagtagctgggactacaggcgcccgccaccacacccggctaattttttgtattttttagtagagacgggatttcaccgtgtcagccaggatggtctcgatctcctgacctcgtgatccgcccacgtcggcctcccaaagtgctgggattacaggcgtgagccaccgcgcccggccaatgttagctaaatattaacagtatctattacaatcctacgaactcaaagaaacaggataaaacaacacagggcttggttttcctgatccaggttggatctgggagcattcccatttcctctcacagtgctcacaaaggcttcctttaatgacacactctaggatttcaccagttttccatgaactattacttgttacaattttcaaaagaacacaggggtcacacctttatcccgctttttcagcaagcctcactctcctctattgtcctaggatcaggaagcagctaatttggggtctcatttataaggctcaaggcatttgtctgggacagaagccaattaatgtctccatttatcccaccagtttcccctttcagtgatggaagttcatccccatcttcctataggaccgaaatttaactttgcagacgtgctgttctgaggacccacccggaacagagcatgtacacaaacccacttactgtcgcttctaacattgtaggaagcctttgggttttccaaggcagcaaagtactgagatttgtaattaaaaacacatattagctacattcaagttgtaactaactaaaaacttctacttaagtcgactgatcctcaaagtaagactcaaatcaaaaccagaaaagtttgggggcaattccctttccagcccacaaatacaggaactgggagtgacaccgtcctcacagggctacggcacctttctgcagcttccctggctccctttcaattttttttttttttttttttttttgagacggagttctgctcttattgcccagattagagtgcagtggcgcgatcttggctcactgcaagctccgccttccagtttccagcgattgtcctgcctcaggcctcccaagtcactggatgttaattacacccagcaaggtcgcccgccaccacgcctggctaatttttttgtatttttagtagagacagggtttccccatgttgtccaggctggtctcttaactgctgacctcgtgatccacccaccacggcctccgaaagtgctgggattacaggcgtgagccaccgcacccggcctttcaatttttgataaggatctttccttttttttttttttgagacagtctcactctgtcgcccaggctggagtgcagtagcgtgatctcggctcactgcaacctctgcctcccgggttcaagcgattctcctgcctcagcctcccgagtagctgggagtacaggcgtgcgccaccatgcctggctaattttttgtacttttagtagagacggagtttcaccgtgttagccaggatggtctcaatctcctgacctcgtgatccgcccgcctcggcctctcaaattgcagggattacaggtgtgagccaccgcacccagccgagtggtttctttaaactctgcaacagacttgacgaattccttggattttgacctttaagtgtagcaggtgtgctggaaacagagcaaatcaacttgaaagcttcttggaggttgctccaaacagcagcatataattatattcaatggtctccctatctctcggaaaagcaactcacaaaaacatgtttattctcattgccagcactcactaaacgctactaggatatcgctgatctgttcatttcctaaatctctgctactaacactttaaaccgagagtaaacttgcagtctcaacatccaattttagaagacaagtgtgacgaggaaggatttatcaactgaaaaatgtttactgacacagggaatctagaaatgtaccttccagatacatacaaatatttaagcaaaaactgttccaagggtatttcctgcagcacctgcccaaaaggagcaaactggtcttaacaaaatcaggtgtacatcaatgttacgcagtcagaatgagacacatctgaatgcctaacataaaaagatctacagtaactaggtatctatacacattgatgtataaactgtttatggaaagaagcttcttatacagtgtttctggaaagggagactgctatcctgctgtctataatgtgtgtatggattactaagaaaggattgagtaattctccactactgccactagcctctggaggaagagggcacacagtttttacctctaagaattattataagacattcagccttatttggttgtatgaaatactatgctagaaaatgatccataattacaccttgtactactcatgttgtactttaatgattaaaataaataccatgttgctgcctggtctggaggacaagacacaccatcaactgactcagtgttcttcacaaccagactacaggcaatttttttccaaaacatacatctttgggaagcaaacaaattatttatggaagaaaaaaggaggaatgtttcacattcaggcaaacataatactgtcagtgtgtttggactagagattttattttagaagtataaaggatggaggcgcgatatttggcatttttaatttaggtttgttttatttaagtttaatgttaattccatgctgtgtttcagtaagaacaatacagattctgtatctgtggctccagtcagatatccagtagtacaaattagcttcaagttacacatactgaacaaaagaggttgagcgagcgaaggaggggaggagtgaggggaaggaggtagggggagggggaaggagaagaaacaaaagaattgaacaggcatgcaggcttttccataccaccttcaacgctaacctgcttcagtgggagagtaaagtaggcaagaatgagcagccacggattgttgaactgttaccagcaccatgcttttcagcaacatttcagcggagttggaaacattttttacagcaaaaccattacaacgaagtccctccccaaaccacctttaaccatctcaagctaacacccaattacttgcaaacactggtataaaacacagtttaaacaattagaaaaatgaaaactgataccacttatgcctctatagtgtgattaacctctctcttagatgcttgcatcacctataagtctaatggctttcaaatgtaatttccatttgctaatggtgatcttgccacatctggcacggagacgacacagtaatgctgaaaaagcctctatgtagtcctgttagtgtcttaaagaacctaaaagctgggaccagtaaaatccacagaaattcactcttgcctttaagaacttttgaaaactgtttaaaaaaaaaaaaaaaaaaccaacagggcaggaacctaaattctgagaccaaatgtaaaagtcagatttggtggttctcagtgacaatggggagtttccaaagggtgggatggggaggagggggtggtcagagatggtttctcttgttggcttatgtctcactgattttcgtcttccacgtcctgcagcgcttctttattctgctcttcacctgttaaaaaagaaaaaaagtcaattatttcgtattgactacattaggctatggcagccacaaacaaaggtgtcattccaagcataaagactcttctacttgctacaattggtattaaacgcaggcaaaggacttctatcatccttgacacctgagatgcctaagccaagaagggattatggtcctgaaagtatttattggtcaacagaatgaaaaaaactgatgcgcagtacaactcaatgtttttacgctaaataagctcttgacgtagacagccaaggaaaccatcttactaaaatgacattcaagctttcacataaatcttgggtcaaaatactctttctcaataacctcacctcttcaagaatcaagagtattttgcaaactttttgcaaaatctaatttacccacaagctaattatcagaaatgcttcaaaatagttaactgagcaataaactgttgccaagaagttctatcgtattttattgtggggttctgctgttataaatatttcagcttttgtatcttggccagatacaccaaactataatcagattttacttcagagtgaaacacagcatgctcaaagtaaatcagaccactgaggttattaaagaatggcatttggaccacttcactcatgctatttgtcttttgcctttaaagagggtgattaccctaaggagtttcaactgcactatgacatgcaacagaaagccacctattggttggagggtcatctacctattagtatgcattaaacaagtcagccaaaataaagaagcatgcaggcttttcccttaaaaatgatgtaacaggtaaaagttacattcacttgtacttttttaaaaaaaccacttacaattactacacagttaactagtttgaaacaaaataaatgaaaaatcaacccaagaatcataaatgttcaaatgactatccattcataatgcttgttaaattatttaattaggatggacaaataacaccaaactagctgcctacacacatgaagcatttacactgagtacagctttgaaacagcctaaatgatctcaaaatgacaaatgtcacagcatcaaggtttcagtagttttcaaatctcttctgcggcggaaacgcttgacattgctgtgtgacttcaaaacccacttacagcctcagcaacacagtgaagccctgtctctacaaaaaatgaacataacgccgggcacggtggctcacgcctgtaatcccagcactttgggaagcaaaggcgggcggatcacgaggtcagaagatcaagaccatcctggctaacacagtaaatccccatctctactgaaaaaataatacaaaaaattagcctggcgtggtggcacatgcctgtaatcccagctacctgggaagctgaggcatgagaattgcttgaacccaggagacggaggttgcagcgagccaagaacatgccactacactccagcctgggtaacagagtgagactccgtctcaaaaaaaaaaaaaaaagaataaataaaactaaaagtaaaaaactatgtatgctggagccaggcatggtggctcacgcctgtaataccagcactttgggaggccaagagaggtggatcatgaggtcaggagatcgagaccatcctggctaacacagtgaaaccctgtctctactaaaaatacaaaaaaaaaaaaaaaaaattagccaggcatggtggcaggcgcctgtagtcccagctactcgggaggcaggagaatggcgtgaacccaggaggcggagctttcagtgagccaagattctgccgctgcactccagcctgggcgacaatcgagactccgtctcaaaaaaaaaaaaaactacatacgctgggcatggggccacatgtctatagtcccagctacttggggggctgaggtgggggagttctatttctgcagtgagctttgaacgccactgcactccaggcggggcaacaagagcaaaactccgtctcaaaaaaatgtataaaattttaaaactacttaaaatacatgaagatctttaattcataagacagaaaaaaaatatgcaaaggcaaaaaaaaattgcttagggatgaaagaactgatgggcacccaactgttctccaaaggacaataacgtattcaaacgtaggaaacatgataggaacattcactctaacagcaaatcactgccaaagtatcattaacacaaacactagaacacaactcgcttgtaagcaaccatgagatgtgccagaagttccaagtaactttggcataaaaatgtcactgtcatatacatcacatccaaccacagtaggcaggaggagcaggccggaaaaggcttaggtcagcgccctggaaggtggaacaggcagagtctgtaagcaacaggacgatcatacgcaggcatgattagtgaagaaccaaaactgaaagcggaattcactgtgccatgaacgtgacttacaaagtagagtttttaggaaaggaagagttgggttttcctttaggaatctatattgcaaggaaaaagggagggagaacaatcatatgaaagcaacattacaagaaaaataaaccaacagagcaggacaaaggaaaacaatgatacaggagccggactttggtcttacttcgtgtaaacttcactctaagcaacaatctgtctactcctcctcccttctactctgagaaggaagtaatatcctcttgaaagacatacagatattaggggaaaaaggattccttggctatgtttctttgcccagtgtatctacattttggagagaggggaacaggcagggagaacatgtatttcctacctatggattcgtatatgaaacaatcctcttaccacagggtgaagagactaaaatcacttgagaaaaagcaatgatccctccctttaaagaaattatgttccaacatgctgggacagacattaacatattctaaaattaaaagacataaataccgtctctttaaaaaacaaaaaaatctaaataatccttaaactaaatgcaaagtcacatcctagtaaactgccactttcatgacgattctcctatattcaccacggaacccaagtcacaaaagtagtattttattttgtgagatgaagttttatcttgcccaagctggtgtcaaactcctgggctcaagtgatccttctgcctcaccttgctgaacagccgagattacaggcaggcaccattgcagtttcaaaaccaatttattaaaaaatgtaggccgggaacagtggctcacgcctgtaatcccagcattttgggaggccgaggcaggcggatcacgaggttaggagattgagaccatccgggttaacacggggaaaccccgcctctactaaaaatacaaaaaaaaattagccgggcatggtggcgggcacctgtagtcccagctaccaggaaggctgagacaggagaatggcgtgaacccgggaggcggagtttgcagtgagccaagatagcaccactgcactccagcctgggtgacaaagcaagactctgtctcacgaaaaaaggaaaaaaaaaaaagatgtaatactaggccaggtgcggtgactcgggcctgtaatcccagcactttgggaggctgaggcaggtggatcacgaggttaggagattgagaccatccgggctaacacggggaaaccctgtctctactgaaaatacgaattattgccaggcgtggtggtgggcacctgtagtcccagcaactcagagaggacgaggcagaagaatcgcttgaacccgggaggtggaagctgcagtgagcagagattgcgccactatactccaccctgggcaacagagtgatactccatctcaaaaactctaatttttgacaaattcaacttctcaaactgatgaacaatttctttgtacccacaattatttgtgtattcagagtttgttagttgtaccggaatgtcaacagaccacctgaatttttcactgttgaactatttcatgactggaagcattatataaataaaaagtatttcacctaataaaaattaagtgaaaattactcttcttaaccaaatttaatcaactgatttacagactcaataaggaattgaacacaaatgaatttcactagattttttttttttttgagacggagtcttgctctgtcgcccaggctggagtgcagtggtgctatctcggctcactgcaagctccgcctctgggttcaccccattctcctgcctcagcctcccaagtaaatgggactacaggcgcccaccaccacgcccgggtaattttttttgtatttttagtagagacggggtttcactgtgttagccaggatggtctcaatcttctgacctcgtgatccgcccgcctcagcctcccaaagtgctgggattaaccggcgtgagccactgcgcccagccgaatttcactagatttttaaaaactgcgaaagtattaccctgtattttttttttttggacgaagtttctctcttgttgcccaggctggagtgcaacggcgcgatctcagttgatcacaacctccaactcccaggttcaagcgattctcctgcctcagcctccccagtagctaggattacagacatgtgacacgacgcctggctaattttgtatttttagtagagatggggtttctccatgttggtcaggctggtctcgaactcctgacctcaggtgatccacccgcttcggcctcccaaagtgctgggattataggcgtgagccactgcaccaggccgtattaccctattttaagatgatccatttcctaaaactgtactcgacaaccaagaataaggattatctttagttctgtacatagactgacaggtagtctactttgattaatcaactcttggttatcagtgataatgagctacagaagtaatccagacttggttatgagttggtatcaaatgtgttttcttgttttgtttcgtttctttgagacagagttttgctcttgttgcccaggctggagtgcaatggagtgatcttggctcactgcacctctgcctcccgggttcaagtgattctcctgtctcagcctcctgagtagcagggattacaggtgcccgccaccacacctggctaatttttgtatttgtagtagagacggggtttctccatgttggtcaggctggtctcaaactcctgacctcaggtgatccgtccacttcggcctcccaaactgctgggattacaggcatgagccactgtgcccagcatatgtttttattaaaataataataataaaaaaaaatggccaggcgcagtggctcacgcctgtaatccaagcattttgggaggccgaggcaggtggaccacgaggtcaggagttagagaccagcctggccaacatggtgaaaccctgcctctactaaacaaacaaaaaactagctgggtatggtggcgcacgcctgtaatcccagctactcaggaggctgaggcaggagaatcctttgaacccaggaggcagaggttgcagtgagccgagatcgcaccattgcattccaatctgggcaacagggagagactccgtctcacaaaacaaaacaaaaaatcagccaggcgcggtggctcacacctgtaatcccagcgctttgggaggccgagatgggcagatcacaaggtcaggagttggagaccagcctggccaacatagtggaaccccgtctctattaaaaatacaaaaaattagctaggagtggtggtggcagacacctgtagtcccagctactagggaggataaggcaggagaatcagaggcaggagaatcacttgaacccaggagatgtaggttgcagtcagctgagagagcaccactgcactccagcctgggtaacaagagcaaaactccatctcaaaaaaaaaaaataaaacacacacacagaaaaaactttcaagtcaggtcactttcattacttattacttttactctcaaaaacatgtccccagaggtgagaggtgtatcatttcctgaagtcaatcccgcgccccaaactctccgcatgctttccctccatcaacaggcagagagatactagcatctgagctggggatgaccattacgagtccacagctgtttgaccattcttcttcataattgttgttacaactttttttcttccctgaagagatggcatctcgttcagtcatccaggttagaatacagtggcgcaatcgaagctcactgcagcctcaagatcccccaacctcagccgtctgagaagcatgcgttgtcacacctggctgttgtttttgttttttgttttgagacaaagtcctgctctatgaagcctcgctctgccacccaggctagagtgcagtggggcgtgatctcagctcactgcaacctccacctcctgggttcaagcaattctcctgcctcagccttgcaagtagctgagattacaggcacataccactgcacccggcattttttttttttttaaagacagggtcttactatgttgcccaggctggtcttgaactcctaggctcaagcatcttcccaccttggcctcccaaagtgctgggattacaggcacaagccactgcaaccggcataggacagattttccagctggaagccacttgttcacagttggtaaattatttctgagtcccaagggctgggagtagctgcctgaaatgctgcgctgggaagtgttctgtggctccatctggcactgttgcaagtgtgtaagtaagtcctacgtatgtgaatatctcatgccaatcctgatctagtcaaatcctaaacatatcataaagctagtaaatgttaaaagctgagtcacctaattctcactttagtaccataacccaaaagtcacaaatctgatttgatccttccagagaaaagacacatacgtgcccactttcagaagcattttcaaaaagtataacacttccaaagacaatacagcaggtccgtttccccaaaagaaactacagatagcctcaagcaacgcgacatatgttttatgtttcagcctaagaaacgttatctcttttttttttttttagatggagtcttcctctgtagcccaggttggagtgcaatggcgtatctctcagctcactgcaacctccgcctcctgggtttaagcaattctccggcctcagcctcctgagtagctgggactacaggagcccgccaccacgcccagccaattttttgtatacttagtagggacggggtttccccgtgttagccaggatggtctcgatctcctgaccgcgtgatccacccgccatggcgtcccaaagtgctgggattataggcatgagccaccgcgcccggcacagccttagaaacattcttaaaggaaccgcagctaaaactgacatcagactttgtttacaacctcctaccagcaccaccaccaccaaatgtaaaactatcctgtaatactcctatcacactaatttgtcctcttctccatccctgttcaacaatctaccatggatcaaaatgattctctagacagagaataaaatttcctttaaaatcaacaaacataacaaatttgggctcctgtatttaaagtaaacattaacacacactcaacatcacaattaagtttactaaaatactctgaagcgtttgcaatgaaaacctcttaagaataaaaacaggccgggcacggtggcttgcgcctgtaatcccagcactttgggaggccgaggcgggtggatcacaaggttaggagatcgaggccaacctggctaacacagtgaaactccatctttactaaaaatacaaaaaactagccaggcgtggtggcaggcacctgtagtcccagctactcgggagactgaggtgggagaatggtgtaaacccaggagacggagcttgcagtgagccaagatcgcgccactgcactccagcccggtcaacagagcgagactccatctcaaaaaaaaaaaaagaaaagaaaagaaaagaaaagaataaaaacagcagggcgcagtggctaacgcctgtaatccctgcactttgggaggctgaggcgggcagaacacctgaggtcaggagttcaagaccagcctgaccaacatggagaaatcccgtctctactaaaaatacaaaaactaggtagtcgtgataacgggtgcctgcaaccccagctaccctgggaagctgaggcaggagaatcgcttgaacccgggaggcagagtttgcagtaagccgagattgagccaccgcactccagcctgggtgtcgcagcaagactccgtctcaaaaaaaaaaaaaagagacccaagggccaacattcaatttctctacagaatcccagagggaaatgggaaaccagttcccttttagataaaatatttcaacaaagagaaaaacttcataaatacctactgataccatctggatttaaatacacttaacttcagccccctaaaattgaattgaatgaagataaaataaactgcttgctctccactcctcctgtcctcaacctttgaaacagtgtaaaggaagagctaaactaagttcccaaaatggaactccgtactgtagcaccatttcctataaaggcagcaattacaatttcatagagggcaggcggtgaatctaaattctagcttgatataacgacaagccaaggaatgtctaaagagagtacaaacaaatcctgcaactgaaagaggtgcctgtttcactccgtgcttgcttaccgtcaccctgcatgtctgaagtccatagtgtcagattatcacgtaacaactgcatgataagtgtagagtccttatagctttcttcactcagcgtatccagttctgcaattgcatcatcaaaagctgcttttgccaacctaaaggtatttcaatagaagtgttataaaaattaagtccaaaatcagaattagaaatgacatgctagacagcaatcttttcttcagttattccagtttgtaatagtcacaatgataatgcaaagaaaaagcaaatacaataaaaattaacttaaaggtatgtggaacactacttcttactatgctttaagcctgctactgatatgctataatatacatatcgactaataaaatacatagaacaacttccatcctaaaccatcaccaaaaaatatacctccaagttctaggcaatagttcacttatttcaaaaagttttgtttgtttgtttttaagacggagtctggctctgtcgcccaggctggagtgcagtggcgtgatctcggctcactgcaagcttcgcctctcaggttcatgccattctcctgcctcagcctcccgaatggctgggactacaggcgcccgccaccacacccggctaattttttgtatttttagtagagatggggtttcaccgtgttagccaggatggtctcgatctcctgacctcgtgatccaccagcctcagcatcccaaagtgctgggattacaggcgtgagccaccgcgcccagcctagtttttttttttttttttttttttttttttttttaagggattcgttatgttgcccaggctggacttgaactcctgcgttcaagcaatcttccgaaccttagcctcttgagtggctgggacaaacggtacacactaccacccccaagattttttaaaaaaaaaaaaaaaaaaaaaaaaaaaaaaaattttttttttttttttttttttttgggggacggggtctcgctctatcacccaggctggagtgcagtggcgggatgtaggctaaatgcaagctccgcctcctgggttcacaccattatcctgcctcagcctcccgagtagccgggactacaggcgcccgccaccacacccggctgatttgtttttatatttttagcagaggcagggtttcaccgtgttagccaggatggtcttgatcttctgacctcgtgatgtgcccgcctcagcctcccaaagtgctggattacaaggttgagatatttaacaaagtattaatgcaaaaagaaaatcttggacaatacctcaaagtttaaaaaaatttaatttcacgttaatggaggcagggaagcaaagaaaataaaaggcaacacagacgccatggaaatgtgattatgtaagccatttacagttttaaaagaaaatccacacttactgagtactgtgtactatgtccaacaaacgatacgatataccaatagaaaaaaaagagacataatctaagtccacatcaacttaaaaatttagaaatggagggtagacaaatacataactattttacaaggaggaggctggctgtggtggctcatgcctgtaatcagcacactttgggtggctgatgcgtgcgcgcagatcacttgaggccaggagttcaagaccagccgggccaccatggcaaaacctattaaaaacacaaaaaattaggccgggtgcagtggctcaagcctgtaatcccagcactttgggaggcagaagcgggcggatcacgtggttaggagatcgagaccatcctggctaacacagtgaaaccccgtctctactaaaaatacaaaaaaattagccgggagcagtggcaggtgcctgtagtcccagctacttgggaggatgaggcaggagaatggtgtgaacccaggaggcggagcctgcagtgagccgagatcacgccactgcagtccagcctgggcaacagagcaagactccgtctaaaaacacacacacacacacacacacacacacacacacacacacacacaaaattagccgggcatggtggcgtatgcctgtaatcccagctactcaggaggctgaggcagaagaatcccttgaacctgggaggcggaggttgcagtgaggtgaaactgtgccaatgcactccagcctgggcaagagagcacaaaaacaaaagaagaagaagaatgaagtgctattccaaataaagtatttcagggacccagaaggaggagcaattaaagggaaagtcaaatttgaactaatctcaatggataaggagaaaacaaaacacacttcaggtttaagcagaagcatgagcaaaggcatgcgagtgactttaaactggagctacacgtgggacagctagactggagtctgacaaggaaaggtgcaaccaccagtattagctaaatagccacagcttcttcagttacgatccctatctggacaaactcaactagccatttagaatgtttttacattggctgggcgcagtggctcacgcctgtaatcccagcactctgggaggctgaggcaggtggatcacctgaggtcaggagttcgagaccagcctgaccaagatggtgaaaacctgtctctactaaaaatgcaaaaaaaaaaaaaaattcagtcaagcgcagtgaagcatgcctataatagtcaacattaaagttccaatgtatcagttaatcccctttcctcaaact

SEQ ID NO: 70 - DNA, 12937 bp, Homo sapiens
aaaatacaaaagttagctgggtatggtggcaggtacctgtaatcccagctactcgggaggctcaggcaggagaatcactgaaacccaggaggtggaggttgtggtgagctgagattgtgccattgcactccagcttgggaaacaagcgcaaaactgtgcctcaaaaaaaaagttatttccttctgaaattgttcttcaaatgtttcttgtcacatacatgcagcagtaatttggtagaaacatgagaaattgtgatcctctgtcttgctcagcttggctcccctccccaaccagcattatctgcccgcacccccaatccccaacaactgatgtgtccttatctccctgccccctaccgcgcccccgtagcataattgtatgccacatatgggcacaccatcacatatggctaaaatgggatcactccgtaatgaatgaatatatatatatatatattttttttttttgagatggagtctcgctcttgttgcccaggctggagtgcaatggcgtgatcggggctcactgcaacctccgcctcccgggttcaagcgattctcctatctcagcctcccgagtagctgggactataggcgcacaccaccatgcccagctaatttttgtattttttagtagagacggtgtttcaccatattggtcaggctggtcttgaacttctgaccttaggtgatccacctgccttggcctcccaaagtgctgggattacaggcataagctaccgtgcctggccaatgctaggcactttttatgggccagggactgatctaagtacttttcatgcacactgcttttcttttctttttttctgagatggagtctcactctgttgcccaggctggagtgcagtggcgcgatctcgactcactgcaacttctgcccacagagttctagcgattctcctgcctcaacctcccgagtagctgggattacaggcgcccgccaccgcacccagctaattttttgtatttttagtggagacggggtttcaccatcttgggcaggctggtcttgaactcctgacctcgtgatccacccgccttggcctcccaaagtgctgggattacaggtgtgagccaccatgacccacctcatgcacgctgcttttctaatttagtgtcttataattgtggagctatgtcttgtgaaaaggtatttccaacaagattctctgagatagttttcccatgtgctttcagtgcctcaggggtggggtagtccataggagcccctgttacccattcaggagtgggtgaggggagaccccagggaccaatgccagcaggaagaggtggggtggttgggaggatggagattgcacatgcttggggacagcttggaggtgcgtgttagaatttttctgagaggggttaaggtgctgttttgtgaagcacaacgagttagtgagtgctaaatctccatgacccctgccgtctatatggcttggatacgtcatgtcaacctgacataaagccatgggtgaacattctctgggaccccacctgtgtgtggggaaaagcaagagagatcagattgttactgtgtctgtatagaaagaagtagacataggagactccattttgttctgtactaagaaaaattcttctgccttgagattctgttaatctatgaccttatccccaaccccgtgctctctgaaacatgcgctgtgtcaactcagggtgaaatggattaagggttgtgcaggatgtgctttgttaaacaaatgcttgaaggcagcatgctccttaagagtcatcaccactccctaatctcaagtacccagggacacaaacactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggcatgcctcttgcagttgagacaagaggaaggcatctgtctcctgcccctccctgggcaatggaatgtctcggtataaaacccgattgtacgttccatctactgagatagggaaaaaccgccttagggctggaggtgggacatgcgggcagcaatactgctttgtaaagcattgagatgtttatgtgtatgcatatctaaaagcacagcacttaatcctttaccttgtctatgatgcaaagacctttgttaacgtgtttgtctgctgaccctctccccactattgtcttgtgaccctgacacatccccctctcagagaaacacccacaaatgatgaataaatattaagggaactcagaggctggcgggatcctccatatgctgaacgctggttccccgggtccccttatttctttctctatactttgtctctgtgtctttttcttttccaagtctctcgttccaccttacgagaaacacccacaggtgtggaggggcaacccaccccttcacatgtgtgattaaatagttgaagttttggcatccttttacaatgagagaatagcacaggatttacatacaatttttggacatccaagttcaccacaatacccatattgtctgaaattatgtgccatggccctgaggggagtcatgatccctcccccaaagatggttgtggctgtcaggacacagcaagtacccacaattccctcctggtgaagagtgcctctgtcctacccagcctgtgcctcactcctgagcaaatccgctgtcagcagtgtgaatgcaggagacacccttggtcccccaaagaatctgaggaacctaggggcatccagtcctgggacaaggatctatgtagacatcatacaagtttagcaccacccatagtggagtgctgggctaagcctacttagacagatatcaccctcctcacccagtttcccctgtccttgtgaaaaggaagaaaatgatggttcctggtctgtcttgtgctcaaatctgacccggctcccaaccagctgtggctctggatgagtcccttaccttctttgatcctcattcctcctcccagggtctggttgcaattcagaggatctgaaaacctagagtgtgtgtgaaaccatctctaaagtgtgtgtggaggtgagtgggaactcgggaaacaccgagtttcatatattgaactgttcctcccacttgcatgatggtttcacaacacagtttagtggctaaagaatatgtgacttggagccaggtctgtgggttggatcccagctctgttacttaagagatgagaccttggccaggcacagtggctcacgcctgtaatcccagcactttgggaggtcgaggctggcagatcatctgaggtcgggagttagagaccagcctgaccaacatggagtaaccccctccttactaaaaatacaaaattagccgggcgtggtggcgcatgcctgtaatcccagctgctcgggaggctgaggcaggagaatcacctgaacctgggaagtggagataatgttgagccaagatggcaccattgcactccagcctgggcaacaacagtgaaactccgtctcaaaaaaagagactagaccttggcaaataacagggacactatgctctcctcattttagtatgggaacagtagtattttgataggattaccatgaggattaaattagtaaatacaaagagcatacaaatgtttacagaagtcacagggctgttagaagtcagaatggccacccttgggtgcagacaggagaggtggtctgagagtgatcagagggagcagcaaagacacttcaagatcccagaaactggcccggtgcggtagctcacgcctgtaatcccagcactttgggaggccgaggcgggcgggtcacctgagatcaggagtccgagatcagcccgggcaacatggttaaaccccgtctctactaaaaatacaaaaattagtcgggcgtggtggtgggaacctgtagtcccagctactccggaggctcaggtaggagaatcgcttgaacctgagaggcggaggttgcagtgagcccagatcacaccattgcactccagcctggggaacaagagcgagactcaggctcaaaaaaaaaaaaaaaagtcatactaaacaatgtcataaatttatatgagaccgaccctggccggacgcccccgctccgcccttcctgcgggtccgggagtcgatcccccaccgtgctccccaacccccgcaggccacccgggggcagagagtgggcgcaaggggtgaacgttcgctgcctccgatcccgggggaaacggagcgccgagaacgtcgacgcccttccgcgcccgtcgggcctgggactgatacccggtctggcccggaaccccccaggcgcgcccctagctggggccctggcgaccgccgcgccgcaggggctagaagccgtcgagacgcgagcgccatcgaggcgcgcggtcctccaggcctcccagagcggcgcagcggccgtttccgggggcggggaaggaaccggagcctgagagccgggcgccgtgcgctcctccccgcgctgtctcggcggcccagggtgagtcggccgcggccgcggggcggggactgggaggggcgcggtcctccgagcccggcctggtggaggctgtagcccccgcagtgggcgcgcggagctcggcagggagcggacccgcagccgtcactgtcgcctccgctcgccttgggttccgaacccttatcggggcgaagggccctgcgccccggtccatgctggctgtggtcgggggcgtgcggccgggcccccgagacccgctccgccgagccggacggttgcgcagagatgaggctgcaggcggggaggcctggcgaggtggggctgctccggggaggaccaggctctgcccctcgcttccgtccgatggcgggctcttcccggcagcctcgctccccggcggacgccgtttcccgcagcgttcatttaccctgcgcagttttgccccctccccgggttggggcatttattggaccaacagtcatttcgtaaatagctgttgggtatttaactgtgagcgttccggtgctggggaccccgcagtgagcgaacagcccgcctcgcctccaggagcatgaattgtaatagaggtgaggcgttagtgtaacaggcaataacgcagcaaaataacttctggttttgacaagggcctcgcacagaataaaccaaggaaataaaattgtgagagttagggggttagggtagccttggcggtcaggggaggctctgtaaggagttaacatttggccgtgcgcaatggctcacgcctgtaatcccagcactttgggaggccgaggcgggcggatcacgaggtcaggagatcgagaccatcctggctaacacggtgaaaccctgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactggtctccaggctgggcaacagagggagactctgtcgcaaacaacagcaacaacaaaaaagagttaacatttgaactgaaacctgctggaggagagaagcagccacagatccctgaggagaaactcccaggcgggggaacagagagaaggctggcatggctgcggcgtagtgagccgggtgccccaggtccccgaggaacagggcttattctgcgtatggaaggaggtgacccctcctagtcttccagaccccagttaaatgagttcccccagtaacatttcttggtggtccttcatctaaaattagcaccctcctccccttgacattttctgtctcagcaacagcttgatctgttgtcatcatatcactgctccattatttttagctcagtgctgtttaatctgattgaaggtttacttcctaattccgaagatagaactaaaagcaggtttttttcccctctaaccaggtagcccctccctgaggacatgcactccctagacatgagcaaacacaaagcagcagtaacttaccgctcctagtccaagtcctaccctagtcctgggttgcagttcttaccagagtggagggtggtatgtgttgaggggtcggggatcaagtcttctggcagcctcataccctgagatactctggttgccttgttggggtgaggacaacacgtgtggccatcgcagtggcccaggtgggtcctgccacagactgccctggacagacagtgagtgggggctgggtgggggtggtgtggccctgctcttccatgcgtttgcagtctgtgccctctgtgcaggggtgattcacgaatctgtctgatccacccccatcgcccttcgtaccctaacatgtcaaaagggctctgctgccaaatgtcacttcatagcattgtgaccaagcagccctcctgcctctaaacgcactctttatttttatttgagagagaacctcactctgtcgcccaggctggagtgcagcggggcacacttggctcactgcaacctctgtctactcaagcagttctcctgcctcagcctcccaagtagctgggattacaggtgcgtaccagcacactcggctaatttttgtatttttcgtagagaagggtttcaccatgttggccaggctggtcacgaactcctgacttcaaatgatccgccctcatcggcctcctaaagtgctggaattacaggcatgagtcactgtgcctggcctctaaacacatgctttttgttaactgatgcctaaagggaaacatctctttacaaagtggcagctacttagacggctccagctctacagaaatggatagccccggagaccttcacccaaacacaagagctcaagtgtctgttgaagggaagagtgaggagaacagggcctcatgcctactctgtatacgtctgcttagagcaaaattattgttttgttttgtttgagacagagtctcactctgtcgcccaggctggagttggtggcatgatctcggttcactgcaacctctgcctcctgggcttaagggatcctcccaggatgaccaaggttgcaccattgcactcccgcctgggcaacaagagcgagttgtcggagtctcactctgtcacccaggctggagtgcggtggcgcgatctcagctcactgcaagctccgcctcccaggttcacgccattctcctgcctcagcctccctagtagctgagactacaggtgcctgccaccatgcccggctaattttttgtatttttagtggagatggggtttcaccgtgttagccaggatggtctctgtctccaccgcacctggccaaaaaagtgttaaattagaaaaatagaaagaggccgggtgtggtggctcacacctgtaatcccagcactttgggagaccgaggcaagagatcacttgggtccaggagttcaagaccagcctgggcaacatagtaagacctcatcaataataaaaacttttaaaaattagctgggtgtggtggcatgcgcctgtagttccagctactcgggaggctgaggtgggaggattgcttgagcccaggaagttgaggctgcagtgagctgagatcacaccactgcgctccagcctgggtcacgcattgagaccctgtctcaaaaaaaggaaagaaaaataggagaaaaagaggaaccactcataattctatgacgcagagagagctagagttttatgctaccagctttatttttctgcttacagtctgcttgtttcatgtagtaaaatgcaagaatgttttctgatgttcccacaacatggttttattggttgcagagtcacccattgttcatttcataatgagcaatgttgcccaggccggagtgcaatggtgcaaccttggccatcctgggaggaaatcttaagcccaggaggcagaggttgcagtgaaccaagatcacaccaccaactccagcctgggcgacagagcgaaaccccgtctcaaacaaaacaaaacaataattttgctctaaccagtcacgctttgttcatttcataaatcctttctgagcacatgctgtgtgccaagcccttcctcaggccctaggggtacagaccagaggccttgtctaattggggaaggcagataaggagcaaggaagttaacttgtcttatgtcagatggcatagtgctatggagaaaaataaagcaaggagcgaggataaggaattcccaggcaggaggggaggtggcagtttaaaaaatggtggtcacagaaggcctcccagcaaggtgagagccaaaaaacattggaaggagtgggtgttcccatggagaagcttggatacacctccttgggacgtgaaggaggcggctgatgtgattgccctagcactttaccctctcctgctcccttctggatctggaggggccttctggggggctggagggccttaggcctgggctctttccactcatggctctatgttccctcagaattcactgtctgtagcatctgctcctccacagagggaccctggaatggcgatggcactcccgatgcctggacctcaggtgagcaccccctgagcccgtccattgccccaggagactgcttcgcccctagcctcagcttttcagccctgagaaccttacagcttgcctcacacccacccacatcacaggatggagtctgcaagccgaggacagcctcctcgctctatggccaggcctcacacatggctctgccaaatccttccagcctttgggcagaagtgggcttcctgcggcctcctctggcccctgagcttctatggtcagccattgagggcagggtccctgtccttccccagtgcctgcctccttcctggtgtgaatggtcagcccatcctccctctcctgatgctgactcactgctggtgttagaaattgagacccagagggtggggatgctccccacagtgcaggtgctccttccccaaatccctgatagcctgtggagagggcgaggccaaggttgggacccccttcctggtaaatctctctccctcccccaagttcagtttttccctcttcctctctggggcttctgctgagaatgaggccgctcactcggggggtgttgggctgccctttctctgctgggccctgtggatgcagcagtgggcagcaaggagagaggcctctagcagatcatgcaaatgtttctcatctgctgggttctcaccgagcccttgactgcctggatagcagagtatgtggttgcaggaggcggttgtgttcgaggatgtggctgtgtacttcacaaggatagagtggagttgcctggcccccgaccagcaggcactctacagggacgtgatgctggagaactatgggaacctggcctcactaggtgagggcttctgcctttggtcctggggccgggaggtgcgtctgtgttagcttcaaaggaagttggttccattgcagattcaaggtctgacacatttttgaggggaagctggaggctccccaaggagcccctctctgcttcctgttgggcacccactgccagcgtcagcctgcctgaggcttctctcctggggcaggccccccatctccccctggccacctagctgcccccttctgggatagtgaatgttcctgacccactccaagcactctgtgccctgatggcctccagccaggcacctgggcgtcccttctccctcctgtactgatacgtgctgctttccttctctgagcttaggctttcttgttgccaaaccagcactgatctccctattggagcaaggagaggagccgggggccttgattctgcaggtggctgaacagagcgtggccaaagccagcctgtgcacaggtgagtacaaagcacccacagggcgtgtcctgtgctgccaatgtggcctggcctccgggcagctctgcaggtcccttcttctacagtgggaggtgtgtatgtttagctcctcacagcagggccagatttcctactaactgccttgcttgtaggtctaaggtcaaaactaacttatgcaggaagacccaagtgcgagagttttccattttggtgtccccaaggtgtcaggggccgggtctgtgctcacagtgccattacccttgggttgtgtagggaccagccctacagggtctgtgggtttttctcctcatgtgcagagacgagagatcatagaaataaagacacaagacaaagagatagaagaaaagacagctgggcctgggggaccactgccaccaagacatggagactggtagtggtcctgaatgcctggctgcgctgttatttattggatacaaggcgaaaggggcagggtaaagagtgtgagtcatttccaatgattgataaggtcatgtgagtcacatgttcaccggacagggggtccttccctgtttgacagccgaggcggagagagagacaggacagcttacgccattatttcttctatgcattttaatgacttttagtactttcactaattctgttactgctgtctagaaggcagagccaggtgtacagggtggaacatgaaagtgaaacaggagcatgaccactgaaacacagcatcacagggagacggtcaggcctcagcatggctgtgggcgagtttgactgatgtcaggccttccacaagaggtggtggagcagagtcttctctaactaccctggggaaaggaagactccctttccaggtctgctatgtaactagtgccttcccaggcactggggttactgctagaccaaggtcaactaagtaacgggcgtcttcccaggcactggcgttaccgctagaccaaggagccctctagtggccctgtccgggcgtgacagaggctcacactcttgtcttctggtcacttctcactgtgtcccttcagctcctatctctgtatggcctggtttttcctaggttataattgtagaacagagattattattattattatttttgagatggagtctcgctctgtcgcccaggctggagagcagtggcgcgatctcagctcactgcaagctccgcctcccgggttcacgccattctcctgcctcagcctcccaagtagctgggactacaggcgcccgccaccatgcccggctaattttttgtatttttagtagagacgaggtttcaccgtgtgagccaggatggtctcgatctcctgaccttgtgatccaccgcctcggcctcccagagtgctgggattacaggcgtgagccaccgcgcctggccattatttttttttttgagacggagtctcgcactttggcccaggctggcgcgttctcggctcactgcaagctccacctcccgggttcacgccattcttctgcctcagcctcccgagtagctgggactacagacgcccaccaccacgcccagccaatttttttttttgtatttttaatagagacgaggtttcaccatgttagcgaggatggtctcgatctcctgaccttgtgatccgccgcctcggcctcccagagtgctgggattacaggcgtgagccaccacgcctggccagaacagagattattataatattagaataaagagtaatgctacaagctgatgactaatactattcatatatcatcatatctataatctctttctagtataactattcttattttatatattttctttattacactggaacagcttgtgccctcggtctcttgccttggcacttgggaggcttgcttgcccacaggttgctttggtttcctggttccctatggcccatgtgccagggactgagctcagggcagtggaggctgcagaaagaaccttgagctggggaggaggcccccagtcccagaggtctgcgcaggcacctgctctacgcacctgcccagacatgtttgctgagtgcaggaactgtgggtgaactctgaaggagagaggagtaaagaacatggctgtggggtgaggtacaacttgcacctcatgcctggcctgtcttccctgccagaccttgggcctctcctatgggctccccttgagctagcctcccacagtgctggagccattattagcctttttgttcccttctcacccgaaccctgattttattttatttttatttttattatttttttgagacaagagttttgcttttgtcgcccaggctggagtgcagtggtgcggtcttggctcactgcaacctccgcttcttgggttcaagcgattctcctgcctcagcctcctgagtagctgggactacaggcgctcgccaccgcacacagataatttttgtatttttagtagagatggggtttcaccgtgttggccaagctggttttgaactcctgacctcaggtgatcggcccacctcggcctcccaaagtgctgagattagaggcgtgagccactggacctggcctgaaaccctgattttaaaacctctggcaataatttctcaaacctccctacacgtctaacaaagactctgtcttcacttgattgtggtatcatttcacagtgtagatgtttattgaatcatgttgtacaccaaaaatatatacaagttttgttttaagacagtctcactctttcgcccaggctggagtgcaatggctcgatctcggctcactacaacctctgtctctgggttcaagcaattctcctgcctcagcctcctgtatacaagttttatttgtcatttatacctcagtaaagctgggtgttgggggaagacttgggaataaaaaggttatgtcttcaaacaagaagttcgtttgtgagtgtagaggctggatcatccttccgttttctgttccttctctcagattccaggatggaggctgggatcatggagtctcctctgcagagaaagctctccaggcaggcaggactgccgggcaccgtgtgggggtgcctcccctgggggcaccctgtgggggg

SEQ ID NO: 71 - DNA, 12937 bp, Homo sapiens; identical to SEQ ID NO: 70

SEQ ID NO: 72 - DNA, 57794 bp, Homo sapiens
tgcagacttccaaatcggcggacaactttcccaagcaggacataggcacaaacccctccacaggtgggggtgagcaaccgtcctcctccctcaagccaagggtcccgagaatgtcccgggtccttgtctcggcctctggggctaccccgaaacctgggccgcggttacctttgctggagcagtggacgatcgcgacacctgtgaacacgctgtgttctctcccactcaacctgtaagacaacaacgggtgaccacgtgaccatgctgtgacccgtgggagctacaaagcgagtttctcaaaaccaggggaggcagcgaggcgtccttaatcctggatccgtccccagcatcttctccccgatcgtcccgctgtggggtctccagggaaacctttacggagaggccgagggaaggggtcacaaatcccaccagcagtggccctgacgggaggcgccaggccaggcagctctcagctgggcctatggcgggcagggggtgcatctcttccacgtcctgggatggggatgacgtcccaggctacgggctcaggtccaggatgcccagtgggaaggacaggacactgccaacttctcatgaccccaacagtctgcagtgggcatgagacattctgggatcagtgctgcagaatcctagacaaggatgagcatggagggatagtgcctgcctccctgcatagctcagacagcacagctcagacagcacagctcagacggcagagctgacagagatccaccctgctccccaggacacccggccagataccacagctactctgtggctcagaacccgagagggctcagaggccaacatggtgcttaccgggacagcatcctgtaggcgtcctgcttgtccaccggcttctccagaatcagccccccgactgtctgtgagaggaagggacagagggagttggttcccaccggctgggtcaggcctgtgcaagtcccacggtcccattcgcagaagtcacttgttttatggaaatgaagctgacacgtcctgagagtcgccatttcaaacaactaaccagagttgccatgttgtaccaccactacctgcctggttccaggatgttctcttcactccagaaggagaccctgtccccacgcagctgtccctccccagtgcgcctccccagatcctggtaaccgcccatcctctttctttcaccgtgcgtttgcctgttgcggacgtggtgtagtcatggaatcctgcaacgtgtggtcctccggggctggtttctgtcactgaccgtgatgtcctcaacattcatccatgttgcagcctgtttcacagcctcgttcctttccttttcttgagatggagtctcactctgtcgcccaggctggagtgcagtggcacggtcttggctcactgcaacctccgcctccggggttcaagtgattctcctgcctcagcctcccgagttgctgggaatacaggtgcacaccaccatgcctggctaatttttgttattttttatttatttattttttgagacagagtctcgctctatcacccaggctggagtgcagtggcgcgatctcggctcactgcaagctccgcctcccgggttcacgccattctcctgcctcagcctcccgagtagctgggactacaggcgcccgccaccacacccggctaattttttgtatttttagtagagacggggtttcaccatgttggccaggatggtctcgatctcctgaccttgtgatccacccgcctcggcctcccaaagtgctgggatgacaggggtgagccaccgcacccggccagcctcattcctgttcatggctgcataatattccactgtgtgtggatggaccatgttgtaatttcccatttacccactgacagacacttgagctgtttctgccttttagctgttgtgaatagtgctgctgtgaacattcatgtagaaggttttggtggaacacctgttttgaatccttttgggtacatacaagagtagatgtattagtctgactgggccaccatagcaaagtcctacaacccaggtggcttaaactacagacattgattctcccatcgtcgtggagactggaagggcgagatccaggtgtgggcagggctggttcctcctgaagcctctctcctgggcttggagatgccatcttctccctgtgtcctcacagactcgtccctctgtatctgtgtcctcatctcctcttcttatgagatgctttagtccatctcaggctgctgtcacagaataccacagactgggtggcttataaacaacaggcagtgattctcccacagccctggaggctggaggtctgagatccaggtgtgggcagggctggttcctcctgaggcctctctcctaggcttgtagacgccgtcttctccctgtgtcctcacagggtcatccctctgtgtgtgtctgtgtccttatctgctcttcttatgaggtgtcttagtccatttcaggctgctaaaacaatactatagactgggtggcttataaacagcagacattgattcttccataatcctggagtctggaagtctgagatccaggtgtgggcagggctggttcctcctgaggcctctctcctgggcttggagacgccgtcttccccctgtgtcctcacagggtcgtccctctgtgtgtgtctgtgtcctcatctcctcttcttatgagatgtcttagtccatttcaggctgctatcacagaataccatagactgggtggcttatgaacaaaagacatgggccgggcgtggtggctcacgcctgtaatcctagcactttgggatgccgaggcgggtggatcacaaggtcaggagatcgagaccatcctggccaacatggtgaaaccccgtctctactaaaaatacaaaaaattagccacacgtggtcgcgcgcacctgtagtccccgctactcgggaggctgaggcaggagaatcattgaaacccgggaggcggaggttgcaatgagctgagatcatgccactacagtccagcctggcgacagagtgagactccatctcaaaaaaaaaaaaaaggagaaatgggtctttgcctaggtaattaagatgcggttggacagaattaggatgcgcattttatgagtggtgttgttaaaagaaggggaaaatttcagccgggcgcggtggctcacgcctgtcatcccagcactgtgggaggctaaggtgggcagatcacttgaggtcgggagtttgagaccagcctggccaacatggtgaaaccccgtctctactaaaaatacaaaaatcagccgggcgtggtggcgggtgcctgtgatcccagctactcaggaggcaggagaatcgcttgaacccgggaggcggaggtcccggtgagccgagatcacgccactgtaatccagcctgggcaacacagtgagactctctctcaaaaaaaaaaaagaagagggaaatttggccacagacacccagaggggagaaggccacatggagatggaggcacagataggaaccacagggccatgagccaaaggagacaatgggttgccaacagcctctaggagctggagaaagaccaagaccaacttctcctcagtacctctggaaggaagaaaccctacagacaccgtgatttgtggttgctggcctctagaactgcgtaccttcctgtgccttttgagacggagtctcgctcttgtcacccaggctggagtgcagtggcgcgatctcggctcactgcaaccccgcctcctgggttcgagcgattcccctgcctcagcctcccgagtagctgcgattacaggcggagtctgtattctgtatcattgatgatatagaattaatgtagcttatctgttactatgtgttataatattctcttgcaattgatatcatatagtatcacttatgatactatcaattagccaccacgtctggctaatttttgtatttttagtagagatggggttttaccgtgttggtcgggctgatctcgaacccatgacctaaggtgatccgcccacctcggcctcccaaaatgctgggatgacaggggtgagccacggcgcctggccccttcccgtgcccttaggcccctcatctgctggtagtttgtgatgggagtttctggaagcgagtccactgctgtcttaaggggaatgtacaacatccacaagaggcagaatcaccaagcacaggaaaaccacatcggacattagaaacgaggcaccctggccgcactcaccacgatcgtgtccgctccaatgaccacgtcgggggcccgcaggtctttctgtaagaaaaccagattccggtttaccggtgacgtgccgtgggtctcacagagaagttttcccgtcggtacgggcgtgaaagagcaccgcaggggcgaagccaggccgactttggaagtgaaggctgggggtgctcaaggtcacgagcaaggacacaagtgggtcccgccggtggtcgccctgcaggggctggaacgtgggtgaggccggggcccacgggggctgcgtgatcaggggtcaggcactcacggagcatctcacgggcactacgggaaacgcaatgcctgttccgtaagcttttgttcttccgggcggcaggtaaggtttgattcaggggccccaaacctccctgagttacccagaattaaggccaaaaggtttttgatccgttcaatgtaatttcagaaaaagctacttagggctgggcgcggtggctcacgcctgtcatcccagcactctgggaggccgaggcgggcgcatctcctgaggtcaggagttcgagaccagcctggccaacatggtgaaaccccgtctctactaaaaatacaaaatatcagtcgggcacctgtaatctcagctactcaggaggctgaggcagcagaatcgcttgaacctaggaggcggaggttgcagtgagccaaggttgcgcacctgcactccagcctgggtgacagagtgagactcagtctccaaaaaaaaaaagaaaaaaaaaaacaaggaaaagaaagaaaaagaaaaaggtacttaggacgataaaacaaatccaggttgaaaattcagcctcagagcaacaggcagtcacaggacatctgtgtgcagctttgaccttagctcagccccgcactggcctccctaagctgtgcactgccaaaacccacaatcaatactcctgtcttgatagcacgactcacaacagccttacctctaatgtatttctttctttctttttttttttttttgagatggagtctcgctctgtcgcccaggctggagggcagtggcgcgacctcggctcactgcaagctccgcctcccgggttcacgccattctcccgcctcagcctcccgagtagctgggactacaggcgcccgccaccgcgcccagccaatattttgtgtgtgtttttagtacagacggggtttcaccgtgtgagccaggatggtcttgaactcctgacctcgtgatccgcccgcctcggcctcccaaagtgctgggatgacaggtgtgagccactgcacccggccccgaatgtatttcttatattaacagtaatggtatattgtgtggtaacacacagcagcagggaagctacattaactctatatcctaaatgatagcattatattcattgtaacagcaagttaaaacacacagtaatagctatgttaattttatatactgtgactgacattatgttagagtcatatataacatatagtaattgataagctacattaattgtacatcctaaatgacagtagtgtattaattataatagtgtattacggtggggtgcggtggctcacgcctgtaatcccaacactccgggaggccgaggcgggtggatcacctgaggtcaggagttggagaccagcctggccaacatggtgaagccccatctctactaaaataatatgtattacataggagcatatagtaacagataaatgacataattctacattatgatacaattatattaattgtcatagtatattacatagtatcacacagtaacatattaattctatgtatcacaacacatagtaatggatgttaattctatatcgtaactgatattactatattaattgcaatattatattcaaacatagtaacaagctacatgaatcttaaatcttaaatgatagtagtatattaattataattgtatattgcattgtagcatacagcaacagataaactgcataattctatattataaatgatattattttaattaaaatccgatattacttagtggcatggtaataagctacataattctatatcataaatgatactattatattaattgcaagagaatattataacacatagtaatagataagctacattaattgtatatcatcaacgagactattatattgattgcaagataatttttgttttaattttttattttttggagacgaagtcttgctctgttgcctaagttggagtgcagtgggatgatctcggctcactgcaacttccgtctcccaggttcacgcaattctcctgcctcagcctcctgagtagctgggattacaggcacccgccaccacgcccagctaatttttgtatgtttagtagagacggggtttcaccctgttggtcaggctggtctcgaattcctgacctcaggtgatctgtccgccttggcctcccaaagtgctaggattataggtatgagccaccgcgaccggccacaagagattataatacatagtaatagataagctacattaattctatatcataaatgatactatgaaatcaattgcaagagaatattataacacatagtaacagataatctacattaattctatatcataaatgatactgtgatatcaattgtgacaatattataacacatagtaatagataagctacattaattctgtatcatcaatgatactatgatatcaattgcaagaggatattataacacatagtaatagataagctacattaattgtatatcataaatgatactgtatcaattgcgagaaattattataacacatagtaacagataagctacattaattgtatatcatcaatgatactgtatcaattgcaagagaatattataacacacagtaacagataagctccattaattctgtatcattaatggtattattaggttactgcaatagtgcattacattataacatagcaatagctaagctgtgccaccaactgcatcttttgaatgacgtttatttgtgtcatgtatatttaccacccgcaaatcccctcatcacagcaaaggaattttcataagggccgaagggcaggggccccttgcctggtacagccggttggccacctccagggccttctgcttggcggtctccatggcgtacccatacggagtagcgaaggaggctttgtccagcttctctttaaacttggaggggaccacctcaaacctgagaccctgcaacagtagaaaaggggtcagaagggtcaatgaaagaccctatgaaaagtgaatgggacatgcaagatttgcaggacgcacatagcgtttgctacactccccgaccctgtcccaggtgagctcatccatccgccaagctttccctaagtgtggctggggagccggggactgaccagggctttccctaagtgtggttagtgggccgcggactgaccaggggccttcagggactgaccaggggccttcttggctctcgagggaagagattggcaaaggaagaagccaggaacaaagaggccagcagggaggtattgactcgggccttgaacccacgagccaacagtgtccgaggattcccagagacctgaaggttggggcagagtacaaaacccaacctgcccacaggaaattcaggaaaaacgccagcaatgatggctgtgggaagggagacaatgatggctctacgtcaatccctggtacccaggaagagacaacaccgcccctggggaggcctggcctagaggtagtgacccctgcagagaccgtggggtcaggaatgatggtggtaaatgcctccagtgggggagcccctggctgccacaccctgccagggtgcagggaactccgcatctcccctctgaccatctcccctctgacagagcaaaagcatcgccatcttggacacacaccgccatcttggagagacaccaccatcttggacgcataccaccatcgtggacacacaccgtcgtcgtggacacacactgccatctgggacacacaccgtcgtcgtggacacacaccgccgtcgtggacacacgccgccatcttggacacacaccgccatcgtggacacacaccgccatcgtggacacacactgccatctgggacacacaccgtcgtcgtgcacacacaccgccgtcgtggacacacgccgccgtcttggacacacaccgccatcatggacacacaccgccatcttggacacacaccgccatcttggacacacaccgccatcttggacagacaccgccatcttggacacacaccaccatcatggacacacgccgccatcttggacacacgccgccatcttggacacacaccgccatcttggacagacaccgccatcttggacacacaccaccatcgtggacacatgccgccatcttggccatcatggacacagtgtcattgtggacacacaccgccatcttggacagacacctccatcttggacacacaccgccatcatggacacacaccgccatcttggacagacaccgccatcgtggacagacaccgccatcgtggacagacaccgccatcatggacacacaccgccatcatggacacacaccgccatcgtggacacacactgccatcttggccatcgtggacacacacccccatcgtggacagacatcatcgtggacacacactgccatcttggccatcgtggacacacacccccatcgtggacagacaccatcgtggacacacaccgccattttggccatcgaggacacacaccaccatcgtggacagacaccgccgtcgtggacagacacccccatcatggacacacaccgccatcttggacagacacccccgtcttggacagacactgccatgttggacacacacttccattttaagttcccttgattaaaaactgcctaaatccagcccccaaacatcagcctaatggctaatgtcagcatgaccagaaacattccagccgtgggataaacccctctgtgaccagaaacctcccctccgaccagagacagtccaaccccgcaatcaattttccctcacacagaaacattccgagcctgcgagaagcccccttttccaaaaccctttgctgagccactttttgtatttttttttttttttttgaaacggagtctcgctgtgtcgcccaggctggaggggcagtgatgccatctcggctcactgcaagctccatctcccaggatcaagcgattctcctgcctcagtctcccgagtagctgggattgcaggtgggcgccaccacacccggctaatttttgtatttttaatagagatggggtttcaccatgttggtcaggctggtgtcgaactcctgacctcaggtgatccgcccgcctcggcctcccaaagtgctgggattacagatgtgagcctctgcgcccaggctcactttctatatttgtttcctccttcttaaactcttacatttggtgccgaaacccaggacaggtgttacggacagaggcccttttgcaacccaggatgcagtgggcaggggcagcctgtcccgggctaactcctggatcctttagagcctctggccctctgaccctgtcctttctctctctccctctttgagtgttgggagtggaggttctcttgcaacccaggaagctgtgggcagcagcagctcatcctgggctaactcctggatcgtgagggtctctggccacccctcccatcttttctctccattcaccttccaagcaatttgtgtgaggaagacaactcatgtaaaggggacttagaggctcaagctggagggttctcaaaaccctcaggtctcagaaatccacctctgaccccctgcaacaggtatttcgctccctaacccttgcttcgtcttcctctctcttcgtccgtcttcttccctcttctctctctctctctgtcttccctgcgcggctccagtttgggagcccctttgccaattccaacaggaacatccaacatcagacacaaatccagccgtctggtaagatctgccctcctctgacttttggtacccaggaaaagtcaggtcggccatcccagtcctcggaggaccagcggcactaagctagaagcgatcttgagggatgcccagtatcttctcagcttggccgtcctccttataaagaggattctgggtctctgtcttttgtctggggttgcctaaaacacaaacagacactctcggcttccttttaccagcccacgtgggtgccaaacaacccgacattcctatgtcctcctctctgggatgtctcctttccaacctggccaaacttggcttacagaggaacctaaagccagagtgttgaattttttattgcaatagtctggcatcaatacaaactacataatgacagcagatggcccgaacatagcacctttaacttgcaaattctcagggaccttgacaactttatcaccaggaaatggcaagaggttccctatactcaggctatcttctaccctccctatgtcaagttgcacctctcattgtgggcggcaagacacccaggtgctgaggcaagagaccgaggacacgagctcttccggtatatgataaaatataaaacgagaaagttataccagatatagatcttagatatggttatatatgaatatcattaatcattagttggtagtaattactctttataccaatcttataataatccttgctctagaatcataatgtaggaaaagccaggccatacagagataggagctgaggggacatggtgaggtgcgaccagaagacgagcgcgagccttctgttatgcccagacggggtcaccaaagggagtctccctttccctgggggggtttagagaagactctgctcctccacctcctgtggaggacctgacatcagtcagacccgcccgcagttatccggaggcctaaccctctccctgtggtgctttgcttcagtggtcacacgctcctagtccgccttcatgttccatcctgtacacctggctctgcctttagttagcaggagcaaattagtgaaagtactaaaagtgtctgataagcagaaataatggcgtaagctgtttctctccttctcctctctctctctgcctcggcggccaggcagggaagggccccctgtccagtggacacgtgactcacgtgaccttacctatcattggagatggctcacactccttaccctgctcctttgtcttgtatccaataaatatcagcgcagcctggcattcgggaccaccaccagtctccgcgtcttggtggtagtggtcccccgggcccagctgccttttcttttatctctttgtcttgtgtctttatttctacactctcatgcctccgcacacagggagagatccactgaccctgtggggctggtccctacatctcatgacatttttttttttttttttgagacggagtcttgctctgtcgcccaggctggagtgcagtggtgccatctcggttcactgcaacctctgcctcccaggttcaagcgattctcctgcctcagcctcccaagtagctgggactgcaggcgcccgccaccacgcccggctaattttttgtaattttagtagagacggggtttcaccatgttagccaggatggtctcgatctcctgacctcgtgatccgccaacctcggcctcccaaactgctgggattacaggcatgagccaccatgcccagcccataatttgtcttttaataaaagtgggaaaactggaaaaagaaaaatcgtgtttgaaaaactatagttacccctgtcgtgaaattctagtcttgcctaatggttttcagtttttattcttttctacggtttgaattaaattctaatttttctggctacatgtctccaagataatgttttgcattcttttcctttttctttttctccaatttttcctaactgaaaacctctgaaacccaagttctgctttcttaaagccctgtgaactaaaagctagatgtttcaacgggtgctgcttggaaggcccctaaagagtgctaccaggaacaaatcaacctcttcccctccagggctgtgtttggtgacccgtaataaccacctccctcagcaggaagtggccagaaagaacacaccacccctcgtcctgttataactagagggtctggattcacagagcaggagcattgccatcttcgacacacactgccatcttggacccattacaccatcttggacacacaccgccatcttggataagcaccaccatcttggacacacaacatcttggacacacatggccatcttggagaagcaccaccatcttggacacacactgccatcttggataagcaccaccatcttggacacacaccatcttggacacacacggccatgttggagaagcaccaccatcttggacacacaccgccatctgggagaagcaccaccatcttggacacacaccatcttggacacacacggccatcttggataagcaccaccatcttggagacacaccatcttggacacacaccgccatcttggataagcaccaccatcttggagacacaccatcttggacacacaccgccatcttggagaagcaccaccatcttggacacacaccatcttggacaagcactgccatcttggacatgcatggccatctttgacacacaccaccatcttggacacacaccgccatcttggataagcaccaccatcttggacacacacagctatcttggataagcactaccatcttggacacacaccatctgggacacacactgccatcttggacccataacaccatcttggacaagcaccgccatcttggacacaccgccatcttggatacacaacaccatcttggaaaagcaccaccatcttggacacacaccgccatcttggataagaaccaccatcttggacacacaccatcttggacacacaccgccatcttggataagaaccaccatcttggacacacaccatcttggacacacacagccatcttggataagcaccaccatcttggacacacaccatcttggacacacaccgccatcttggataagcaccaccatcttggacacacaccgccatcttggataagcaccaccatcttggacacacaccatcttggacacacactgccatcttggataagcaccaccatcttggacacacaacatcttggacacacaccgccatcttggataagcaccaccatcttggacacacaccatctgggacacacactgccatcttggacccataacaccatcttggacaagcaccaccatcttggacacaccgccatcttggacacgccaccatcttggatacacaccaccatcttggaaaagcaccaccatcttggacacacaacatcttggacacacactgccatcttggataagcaccaccatcttggacacatgccgccatcttggacacacactgccatcttggataagcaccaccatcttggacacacaccatcttggacacacacggccatcttggataagcaccaccatcttggacacacaccgccatcttggataagcaccaccatcttggagacacaccatcttggacacacactgccatcttggagaagcaccaccatcttggacacacaccatctgggacacacaccaccatcttggataagcaccaccatcttggacacacaccgccatcttggataagcaccaccatcttggacaagcactgccatcttggacatgcatggtcatctttgacacacaccaccatcttggacacacaccgccatcttggacaagcattgccattttaagttcccgtgattaaaaactgcctaaaaccagccccaaaacatcagcctaatggctaatgtcagcatgaccagaaacagtcaaagcctgaaataaaccgcctctgaccagaaacatcccaagcccaagataacctccttcagaccagagacattctaacacctcagtcaactttgcctcacagggaaacattccgagcctgcgataagattccccttcctaaacccttaaatacccttagtctgtaagagagaacactcctgacctaactcagccagaagccccgctcaggcttgttctccaaaataaacccgtctttgactgtgaagctgcttttcttttttcgtctttcttccactcttctacactcctcagcgctcctcacctcttgaaggtgcccccagatcctggccctgacgcccatcctggtcttcagggcaccagtcaccaagccctggacctgccctgcagatctcaaccccagatcatatagacccctgccctatgccctgtcacccccaatcatggagacccatgccttctgtgaggcaccctgaccactctcatccccgtcactaggaccaggcatgtggtgtcccccctcccagggtaccagacctccagtccgtagtccccaagagtagactcctgccccactgcaccatccataggcaaccagtaactaccctaccatcaccagtaacttctctgccatcaccagtaactacctcacatcaccagtaactaccccccatcaccagtaactatgccccatcatcaaacccagtaactaccccccatcaccagtaactatccaccatcaccagtaactatcccccatcaccagtaactatgccccatcatcaccagtaactatccccccatcaccagtaactatctcccatcaacagtaactatcctcccatcaccagtaactatccccacatcaccagtaactacccccatcaccaataactatgccccatcatcaaacccagtaactatcccaccatcaccagtaactaacccccaccaccagtaaatatgccccatcatcaccagtaactatccctcatcaccggtaactacgccccatcaccagtaactatctcccatcaccagtaactatcccccatcaccagtaactatccttccatcaccagtaactatgcccccatcaccagtaactatcccatcaccagtaactatcaccccattaccagtaactatcccacatcacctataactatccgcctgtcaccagtaactaccccccatcacaagtaactatcccttcatcactagaccgtctcctccatgtgattagggctccagagagaggcagacacccactacctaggcgtcctaccacccggaataagatcctcatgggggcaccaggaaacacttcccataccccagctacaaagtccaaccatcagtcacagggcccactccatccctagaagtcctgagtcactcacctccccaatccctaggggtcccaggtcactcccctcccccacccctagggggtcccgggttactctcccctcccccattcctaggggtcttggattactctcccctcccttatccctaggaggtcctggatcacactcccctcccccatcactagggcatcctgggtcactctcccctcccccatccctaggggctctgggtcactctcccctcccccatccctaggggttctgggtcactctcccctcccccatccctaggggttctgggtcactctcccctcccccatccctagggggttccgggtcacactccccaaccccatccctaggggttctgggttactctcccctcccccatccctagggttcccgggttactctcccctcccccaaccctaggggtcccaggttactttccccacccacatccctaggcggtactggatcactctcccctcccccatccctaggggtcccgggtcactctgccctcccccatccctatgggtcccgggtcactctgccctccccattcctagggggtcctggctcactctcccctcccccatccctaggggtcctgggttattctcccctcccccatccctaggggtcccgggtcactctgctttctccattcctagggggtcctgggtcactctcccctcccccatacctagggattccggatcactctcccctcccccatccctaggcggtcctggatcactctcccctccccattcctagggggtcctgggacactcctccctccccatccctagggggtcctgggacactcctccctccccatccctaagggggtcccaggtcactctccccaaccccatgcctagggcgtcctgggttactctccccacccccatccctagggggtcctgggttactctccccttccccatccctaggtggtcctgggtcactctcccctccccattccttgggggtcccgggtcacccttccctcccccatccctagggggtcctgggtcactctccccaaccccatgcctaggggttccaggtcactctcccctccctcatccttttgggtcccgggttactctccctacccccatccctagggggatcccggcttactctcccctcccccatccctagggggtcccaggttactctcccatccccattcctagggggttctgggtcactccctgcaaccccatgcctaggggtttcgggtcactctccccacccccatccctaggggggtcccgggtcacttgacctccccattcctaggggtcccgggttactctcctctcccccatccctaggggtcccgggttactctccccacccccatccctaggggggtctcggcttactctccctatccccaaccctggaggtcccgggttactctccccatccccatgcctgggggtcccgggttactctccccatccccatccatggggctccggggtcactctgctgtccccatccctagcggtcctgggtcactcctccctccccatccctagggggtcccgggtcactctccccaaccacatgcctagggcgtcctgggttactctccccacccccatcgctagggggtcccaggttacaggttactctctccaaccccatccctaaggtgtcccgggtttctctcccctcccccacccctaggggggtcccgggttactctcccctcccccatccctagggggtcctgggtcactctccccaaccccatccctaggggtcccgggttattctccccaaccccattcctgggggtctcggcttactctccccatccccatgcctgggggtcccgggttactctcctctcccccatccctaggggtcccgggttactcccccacccccatccctagggggggtctcggcttactctccccatccccaaccctggaggtcccgggttactctccccatccccatgcctgggggtcccgggttactctcctcatccccatccatggggctccggggtcactctgctgtccccatccctagcggtcctgggtcactctaccctccccattcctaggggtcccgggttacgatcccctcccccatccctatggggacccaggtcactccccacccccatgcctagggggttccgggttactctcccctcccccatccctagaggttccgggtcactctccccaaccctatccctggaggtcccgggacactctcccctcccccatccctaagggtctcgggtcactctcccatccctatccctagagttcctgagtcgctgggccctccggggttcagcccctccgtccccggtcccctgccccgcccaggcccaggccgtaccgcgttgctgaggatctcctgacggcgtggggaggcgctggccagcaccacgcgcttgtgcagcagcttcccaatcaccgggcacagcaccatggcgtccacgccgggagccgggcgtccgcacttctgagcccggagcccgcggtgcgcgcagcgcggctgcaaaaaaaacaggcggccagagtcccgcctccgcgaggccacgcccccgcccgcctccgcgaggccacgcccagtccgcgccttcagtggcctccccgcgagaccgcgcccaggccacgcctccattgaacactccgtcaggcctcgcccaggccacacctccattgccctctccaccaggccacgcccatgtcacgccccattgatctcccctgagaccacgcccagaccacgcctccattgccctctccgtcaggccacgcccaggccacacctccattgccctctccgccaggccacgcccatgtcacgccgccattgaccgctccgccaggccacgcccaggccacacctccttgccctctccgccaggccacgcccatgccacgccgccattgagctccccgtgaggccacgcccaggccacacccccgcccgcctcccccccgggcaccgccccggccgcttggtgaagcaccgcccccagctccgcctcccgggccccgtccccgcccccggcgctcgccccgcccctccccaccccgcctgcggcgccaagacctgcaatggcgcaggcagctgcggggtcccggggaggaaaggctggcgtggatacttggggttccttgcaggcgcggcgtggggagtggaaatgctgggtttccgcagctgcggttgtgggcagttgtgggggtggggggttcttacccgcacgtggaggggcccggcgcagagatgggggtcttgtgggagccgcgtcggggaaggtagagatagggggttccccgcggacccggtgcgagtggcgtggggatggggatgtcctcgtgcctggtgggaggggagtggagatgggggtgtccacgggcctggtgggaggggcgtggagatgggggtgtccacgggcctggtgggaggggcgtggagatgggggtgtccacgggcctggtgggaggggcgtggagatgggggtgtccacgggcctggtgggaggggcgtggagatgggggtgtccacgggcctggtgggaggggcgtggagatgggggtgtccacgggcctggtgggaggggcgtggagatggggatccccgcggggatggtgggaggggtttggagatgagggtccccgcgagaatgctcggaggggtatggatatgggggtccccgcgggccgggtgggaagggcggggagatgggtggggggggggtccccgcgtgcctggtgggaggggcgtggagaaggtgggggtccttgtgggaggggcgtggacactggggatccgcgcgggcgtggtgatgggcgcggcgtggggaccccctgggggcgcggtgctgggggcgcagggatgggaccagggcgggcgctgtgaggtgggggacgcccggctgtgccttccctccctaaacggagcccacctccagggcagcgggtcccttgcgcgccgcaggctgcagggggcgcgcgtgagctgtgcgaggatttttcttaaaccccagagcccagccgcacctgctccacataaacccagcgtggcgtggagactccgggcactgtttccccagcctttgtgactcaaaagattttaaaataaaatgtcaaaaataataatatacccagagcctatgccagtgatgtgtagatgcagaaaatggaatcctacagttaattttgttaactgtggaatgacatccgagggtgtccaacacattacggagaaaacgaaaaactgtagtcagagaagtcacagaagagccaaataaaagagaggaaaaaagcatctaaaccatgtgatgtctgattttcaatattgtgagtttttgaaaaaaaattttaaaaagcacatagattcacatttcagaattttggagaagtaactttcttcgttttgaagcgatagaaggaatcataagtttataaactgtactgcatataacataaactccatgcaggtgaaggtttttgtttgtttgtttctttcttttctgtttgtttctttctttgttttttgagaccgagtctcactgtgtcgcccaggctggagtgcaatggtgcaatctcggctcactgcaacctccgcctcccaggttcaagcgattctcctgcctcagcctcctgagtagctaggattacaggcacctgccatcacatcgagctaatttttgtacttttaatagagatggggtttcgctgtgttggccaggctggtctcgaagtcctgacctcaggtgatccacccgactcagcctcccaaagtgctgggattacaggtgtgagccaccgggcccagctgcgggtgagatattaaacataaagaaaaatagcaaaggaaattacagtaattctctatagaagatgaagtgaaggctgcctcttcctacacgggtacaggcaaagctggagggtttagtgacctacagtgggggttgctggtaactgtcactcaaaaccctggggcttaaaacagcaaaacttaattgtattacagctctggagcccagacatctgaaatcaaggaataggcagggccacgctccctccgaaggctctaggggagggtccttcctgcctctcccgctcctgggggctccaggcatccctgggcttgtggccgcatcactctagtctctgcctccgtctctacgtgggtttctctgtgtctgtgtctcctcttctgtctcttacaaggacacctgtcattgtgtttagggcccgtccttctccaggatgatctcatctccagattgttaatcatatctgcaaagatcctttttccaaatgaggtcccattcccaggctctggggcttaggacatggacatatggtttggagctcaccatctaaaccattgcaattgtgtttgcttccttctggaggctctaggggagggtgcttcctgcctcttccagctcctgggggctccaggcatccctgggcttgtggccgcatcactgcagtctctgcctccatctccacgtggccttctcctctgtgtctgtgtctcctcttctgtctcttacaaggacacctgtcattggacttagggtccaccttaatccagcatgatatcttgaaatcatgaactaattgcacatgtgaggaccctatttccaaataaggtgccattcaccaggtggacatatctatggggaggcacgaatcaactcagtcccccataccagcattccagaaggagtgctaaccagagatggggtccagcagcctttaacatgcctgtatttatccctataagttctccattacggccacatcattgaaaccccagcaggcagaggtttaactgctctggagccctgactactgcagcctcctcctgctctcaatgtgcccttccgtgactttcagatttttctttgctttttttttttttttttagactgactcttgctctgtcgcccagactggagtacagtggcacgatcttggctcactgcaacctccacctctcaggttcaagtggctttcctgcctcagcctcccgagtatctgggaccgccaccacacctggctaattttttgtattttttagtagagatggggtttctccatgtttgccaggctggtcttgaactcccgacctcaggtgatccgcccacttcagcctcccaaaatgctggaattacaggcatgagccactgtgcccagccaatgcctgttttttgtttgtttgtttgttttgttttgttttgtttgtttgtttttgagatggagtctcgctgtgtcacccaggctgtagtgcagtggcgcgatctgggctcactgcaagctctgcctcctgggttcatgccattctcctgcctcagcctcccaagtagctgggactacaggcacccgccaccgcgcccggctaatttatttttctattttttagtagagacagggtttcaccatgttagccaggatggtctcgatctcctgacctcatgatctacccacctcggcctcccaaagtactgggattacaggtgtgagccaccgtgcccgaccaatgcctgtcgttaataagcaacccagtctatggtattctgtgatagcagcctgcaatggactaagacatctgataagaagaggagaagaggagctgaagacacagacacacatggagggacgaccctgtgaggacacagggagaagacagcgtctccaagcccaggagagaggcctcaggaggagccagccttgcccacaccttgacctcagacctccagcctccaggactgtggaagaatcgatgtctgttgtctaagctgtacagcgtacaggactttgctatggcaaccccagcaaactcatacaccccgtcccaccaggctgggcttccatccttaatgttctgttttgcattgagccagcattgcatggttggaggttcaaagattctcaaatgtgtgcatgtgtgtgggttttgtgtaattcagttgccagcaactgaggagatcctaccgtccaggagacacctggcaatgtctgaagatatttttggccatcacgtctggaggtgtgcgtgcagtgcaggggtgctgctcccatctggtgggtggagcccagggtctctgctcagcaccgtacagtgcccaggatggccccaccacagagagtcctccagccccaaatgtcagctgtgctgaggtgggggaaccctgagtcagcatgagagggtttgtctatcatctatctatgtatccatgttatccatcatttatccagctattcatctgtcatgtatccatctatcttgtctatgtatctatcactcttccatctatttagccataatatctatgtatctctctatccatctatgtatgtatgtatgtatctatctatccatctatgtatgtatgtatgtatgtatctatcatctatctatccatctatgtatgtatgtatctatcatctatcaatctatgtatctatccatctgtctatgtatgtatgtatctgtcaatctatcatctatgtatctatccctctatgtatgtatgtatgtgtctatcatctatcaatctatgtatctatccatctgtctatgtatgtatgtatctgtcaaactatcatctatgtatctatccctctatgtatgtatgtatgtgtctgtctatcatctatcaatctatgtatctatccatctgtctatgtatgtatgtatctgtcaatctatcatctatgtatctatccctctatgtatgtatgtatgtatctgtctatcatctgtctatccatctatctatctatgtatgtatctgtctatcatctatcaatctatccatctatgtatgtatctgtctatcatctatcaatctatctatccatctatctatctatgtatgtgtctgtctatcatctatctatccgtctatgtatgtatctgtctacctatcatctatctatccatctatgtatgtatctatcatctatctatccacctatctatgtatgcatctatcatctatctatccatctatctatgtatgtatgtatctatctatccatctatgtatgtatgtatctatcatctatctatgtatccatctatgtatgtatgtatgtctatctatcatctatctatctatccatctatgtgtgtatgtatctgtctatcatctatccatgtatctatccatctgtatgtttgtatgtatctgtctatcatctatctatctatctatctatctatctatctatctatctatccatctatgtatctatcatttgtctatcatctatcaatctatccatctatgcatctatcatttgtctatcatctatcaatctatccatctatgtatctatgtattatcatttatctatcattcatctgtctatctatcatttatcaatctatcatctatgtatctatcatctatcattagatatatcatctatcaatctacccatctatcatctatctttctatctattctacctacctatcatctatctattgtatctacctacctatctcatctatcatttatcccctccttatgttgtctatgtatttattatccatctgtgtatccgttatctacctatcatctatctagctatcatctattatctatctatccatccattctgtttatctatgtatccatctatcatctgtataactatccatctattatctatctatctaactatcatctatctatctatcttctatccatctacccatctttctatctttccatcatcaatctattatctatctatcttctatccatctatctttccatcatcaatctgttatccatctatccatttatccatcatctatatattaatttatcatctatcaatctatcatctacctatcatccatctatctatctatgtatgtatctatcatctatctatgtagctatccatctatctatgtatgtaggtatctatcatctatctatctatctatctatctatctatctatctatgtatctatcatctatctatgtatccatctatgtatgtatgtatatatctgcctatctatcacctacctatgtatctatccatctatctatgtatggatgtatctgtctatcatctatctatgtatgtatctatcatctgtctatctagccatctatgtatgtatgtgtctgtctatcatctatttgtctatgtaagtatctatctgtcatctatctatccatctgtgtatatatgtatgtatctgtctatcatctatctatccatctatctatgtatgtatgtatctatcatctatctatccacctatgcatgtatctatcatctatctatccatctatctatgtatctatgtatctatcatctatctatccatctatctatgtatgtgtctatcatctatctatccatctatctatgtatgtatctgtctatctatcgtctatgtatccatctatgtatgtatgtatctatcacctatgtatccatctatgtatgtatctatcatctatgtatgtatgtatgtatgtgtctatcatctatgtatgtatctatccatctgtatgtatgtatgtatgtgtctatcatctatctatatatctatctatccatctatgtatctatgtatctatcatttgtatgtctatcatctatcaatctatccatctatgtatttagtattatcatttatctatcattcatctgtctatcatctatcaatctatcatctatgtatctatcatctatcattagatatatcatctatcaatctacccatttatcatctatctattctacctacctatcatctatctatttatctacctatctatctcatctatcatttatcccctccttatgttgtctatgtatgtattatccatctgtgtatccattatctaccgatcatctatctagctatcatctgttatctatctatccatccattctgtttatctatgtatccatctatctatcatctgtataactatccatctatcatctgtctatcatctatctatctatcatcttctatccatctacccaactttctatctttccatcatcaatctattatctatctatcttctatccatctatctatccatctgtctatctttccatcatcaatctgttatccatctatctatccatctatccatcatctatatattcatctatccatctatcatctatcattcatctatctatctatctatctatctatctatctatctatctcttatcacccatttatcaatctatcatctatctacctgtgtatgtacctatctatccatctatcatgtatccatttgtcttttttttttttgaggcagagtctcgctctgtcacccagactggagtgcagtggcatgatctcagctcactgcaacctctgcctcctgggttcaagcaatcctcctgcctcagcctccctagtagctgagattacaggtgcccgccaccatgcccggctaatttttgtggttttagtagagacgaggtttcaccatgttggccaggctggtcttgaactcccgacctcgtgatccacctgcctcagcctcccaaagtgctgagattacaggcttgagccaccacacccggccccagcctctagaactgtggcaagcaatgtctattgtttgtgagccacccagttgatggttgcgatggttaataccaagagtcaacgtgattggattgaaggatacaaagtattgatcctgggtgtgtctgtgagggtgttgccaaaggagatgaacatttgagtcagtggactgggaaaggcagacccccccccccttaatctgggtgggcatcatctaatcagctgccaacgaggctagaatataagcagggagaaaaatgtgaaaaggagagacgggcctagcttcccagcctccatctttctcccatgctggatgcttcctgcccttgaacatctgactccaagttcttcagttttgggactgggatgggttctccttgctcctcagcctgcagacggcctattgtgggacctcatgatcatgtgagttaatactgaatcaacttccctttatttatttatttatttttatttatttatttttgagattcactctgtcacccaggaagtttacttaataaacttccctttatttatttttatttatttatttttgagttgcactctgtcacccaggctggagggcagtggtgcgatctcggctcactgcaagctccacctcccgggttcaatcgattctcctgcctcagcctcccgagtagctgggattacaggcatgcaccaccacacccggctaatttttgtattttcagtagagatggggtttcaccatgttggtcaggctggtctcgaactcctgacctcaggtgatccacctgcctcggcctcccaaagtgctgggattacaggtgtgagccactgtgcctggcctgaaactcctctctctctctctcaatctctctctctctctctctctctatctatctaatatatctactatctgatctatcatctatctatctatctaatctatctatctgatctatctatctgatctatctactatctatctatgtaatctatctactgtcaatctatctatctaatctatctactatctatctaatctatctactatctacctatctatctaatctatctactatctatctatctaatctatctactatctatctaatctatctactatctatctactatctaatctatccactctctatctacctatctaatctatctactatctatctatctaatctatctactatctatctacctatctatctaatctatctactatctatctaatctatctactatctatctatctaatctatctactatccatctatctatctactatctaatctatctactatctatctatctatctaatctatctactatctatctaatctatcttctatctgtctgtctgtctgtctgtctatctgtctgtctatctatctatctatctatcctattagttctgtccctctagagatctctgagtaatgcaatggtgttttgtttgtttggttttttgtttgtttccagcaggataaatggaccaagacaaggagcctatgaagaggataagacattggatccagcataaaatgggatctgtgtttaaaatgcaagccctgcagaaatcagagacagaaacacatttgccctgtgcacttcaaagctcatgtttttttttaatgttttatttttattttttacagagatgagttctcactgtgttgcctaggttggcccttgaacacccggactcaatcagtcctcccgcctgagcctcccaaagtgctgagattaccggcatgagctgccacgccttgatggaggctgagactttttggaatccctccctctctccatgtcctgccaagaacagaagtaaagttttccatcttaaaacatgtgtgtgagtcaatagacctgtgttatcttttcactcaaagctcaaccagtgaacagactgagtcagcttccaggaaacatccacggctgtaagagggggtgtcggctgctctccatagccaagtggctgcaaaaatcatcatactgacaaaaaaaaaaaatcgacgcattttgcctgcttgcaacgtcttcctttgctgggggacgtcagggttctcgcacgttgtcgaggaaggatattgtctcggcttcctctgactcaagctctcatttttgtttacaaggcagtttagggatcgtccgtgcgttactgtgaagatgctactctgaggtttttcacagttttttttcccccatgagacacacccaaggcccacgctcagcacttgcgacctgtactcctgcagcctggatgcttctgtatcagctttgctttctagggttcagctttggaacagtctagagaagcaggaggttaattttcctccttctgtggaagttctgggtctcttacgcatcctccagttccccctggaggctctaggggaggatccttcctgcctctcccagctcctgggggctccaggtgtccctgggcttgtggccgcatcactccagtctgcctctgtctccacgtgtcctcctgctctgtgtctgtgtctcctcttctgtctcttggaaggacacctgtcatggcatttagggtgcttaataatccagcacaatctcatcttcatatccttaagtaattacacatgcaaagttccttattaccgaataaaatctataataatttcaggttctgggctttaaaacaagacatgtctttctggggcaactgtttagtgcactctgcaattgtatccagttccctccagagactctaggggagggtccttcctgcctctcccagctcctggggactccaggcatccctgggcttggggcagcatcacttcagtctctgcctctgtctttatgtggcctcctgctttgtgtctgtgtctcctcttccgtctctcatagggacactggattgggcccattgtaaatgcagtatggcctcgccttacttaattacatttggaaagacccgattttcaaacatggtcccatcctgatgttccaggtggacacgggtttgggaatgataattcattactaaaccatctctgttttcctgccatagtgatgacggcaggagagaggcaccaatagagggcctccgaacagcagcttcagcctccatcagcgtccccagtgcacagaaagggaggggccgggcatccaaggccacccactgcggagacgcagagcccgtgggcagacaggcagctctcccactcccacctccagaatggtctttctcgcccaagagagcctgggatccaattccacgtgatgtcccagcacccctggagagtcagagctcttctttgcgctaaaccagctcaggtgttggggctggtgcaggcacatgccgtgtagaagaagacagacaaagacccagcctgctcaccacccacacagcagggagggggctcagcggctgacacccctgtaggttcctggggtccacacctgcatctgctgcttggtctccaaacggtctcatgggtcaggccagttgcctgcttcctggactccagatggacttgccatggctgaggctctccatggggtaaaaggacgcggagaatgggcaggaggtggggaactcccgaatcaagctgcacccttgtgttgggatgggctggaccccatctcacggagcctcctttccgcacctgggcctcccgtggtccttgtcctgagtcagggaagcctgagtgtgttccaggggcctgatgggacctccttctctatcagggactcacagaagcagaataggggtggggtcccaccaagccaggccagaacaaatgtgccaaaaatcaccttggtcagcaacagggtggggtgtgtgtgtggggggaagtgggcacggagagtagctgacttgcaggagccccaggcgctcctctgaaagaagaattccaaccacagcaaccacagtgcccctgagtgaaataaacagaaatttcggcgtgcaccgggctacggagaccagaacccctggaggagaatggagaaggccagaaccacaactaagggacgatgtcagcagggagaagagctgggaatggggctcgcagttcgcccacggaggatatccagaaaccgagtcgggtaggcggtggggctggttgaatatccaccctcgggtatggacaggtgtgaggagtgtctaaggagctcgggggtgacagcccagctctactaaaaaaaatacaaaaattagccgggcgtggtgacacaagctgtcccctgacacagagaggcagaggcaccctctgcaggataacaagcaccctgtgcgctgctgggctttgcttgtttctctaccctgagtgaagcctggagacccttcctcaccggtgcctctgcagtgcctgggaggaataaagcctggagacccttccccaccgggcctctgcagtgcctgggagcaacgcagctgttctccctgaacctctggcaccgtggcctctccatgcgcccctggatctccaagctgcgcccccggctctccaagctgcgcccccgggactcagaacacactctcctgcctctggaggccgggcctggtggctccctccatcccttcagggtgcgcaccggcctcggagcgcacggacgtggtcctggcggagaagaggctctcgcggcgcgtgtccagggtgtctctgggcacccggcggcagcccaaatattcccgcaggcgcagctggaattcccgggacgcaaagtaataaacaaacgggtccagacagttgttgaggcagctgagacacagcgtgagcttgtacacgtggtagtagctcttgccgtagaacaggcggctcacgatgtgcgccaggagcacgaagttgttgggggcgaagcaggtgacaaaggccagcaagaccaccgcggccaggcccaccgcgcgcctccgctgctcccggccgtgcgcctcctccgtgcgcaacagcttgaggatggtggccgtgtaacaagccacggtgatcacgaacgggatgaggaacagcaggatgaagatggtgaagaggaacacggcccacatggccacgctggggagcatcgtccacttgaggacgtcgaagcaggtgatgatgcccagggcgtgcaccgggtaggtgagatcggtgcgcgccagcggggacagggcggtcaggagcagcagccaggtccctgcacacgcggccaccgcgtaacgacggcggcgccagcgcttggagctgagcgggtacaggacccccaggaagcgctccacgctgatacaggtcatggtgaggatgctggaatacatgtttgcgtaaaaggccacggtcaccacgttgcaaagcagcaccccgaatacccagtggtggcggttgcaatggtagtagatttggaaaggcaacacgctggccagcatcaggtccgtgacgctcaggttgatcatgaagatgaccgacggggatctgggccccatgcgccggcacagcacccacagagagaagaggttgcccgggatgctgaccgccgccaccagcgagtacaccacgggcagggccaccgcgatcgccgggttccgcagcatctgcagcgtcgcgttgtccgggccggtgctgttcgggacctgcatcctggaggggtcctcgcccgggctctgcaagggaaggagggaagggtgtacgggtcaggggcgcaggtaaagaggcggctgccgggagggctcctgagcgccgctccccggggaccaaggcgggggagatgctttagcagggcctgctgtctcctccctccctccctcccttagttcctccttccctctcctccttccttccctccctctctgcctcctttcttcaccctgtgtcattcttttcttctttcctgtcttctcccctttcttcttccttcctcctctctccttccttctcttcttccctccttccttccttccttccttccttcccgccctccctccctcccgtccttccttggatcagggaggtcattggagacctcggcccacgtcagaggctgagactcttagatgatccacagtggggctgtggctcccctgggcaggttgaatgcattgtcatacaaacctcaagactcagtgtcccccgtggacggaaaccacaaagccaccgtcagcccccagggtggtcttaatgggaattcttgacaccctggcagtattagtctgggtatgagtcctctcatctcaggggcatccacccacaaagtgtctatcagcagaaaacacacactccgagtgccaggagaccaacccgcagcctccaaagtctttccagcttttaacacccgcgtcaacccacggctcctccctgctctttcttcctccagaggagacctgcgacttcttaccaactgctctacaaacagcttcctcaagctggctttaaaatggcccggagttttcgtttcagtttcagggagaagttttctgacccgccggtccgtgcccaggtgtgaaacctacagttatgcacgagtcagcaccgctccccacggccagctgggcacctccagccacctatggcttcaggaggaaaagcagacccttccttctttgggttccgcttggtgtggccgtgggggacgtctggaaggagagacgctttatccatgagctggtgatgaaaaagtgtctgtcaaagggacactacttttattttgagaatgtaaagtggacagagctggaaacaggggtgccctggaattgttcttttgtttgtttgttttatagatatggggtcttgccttgttgcccaggctggagggcagtagtgcaaacgtaactcactgcagcctccaacgcctggcctcaagcaatcctcctgcctcagcctcctgagtagttgggactacaggtgagagtacaaccacgcccagctaatatttttattttttgtagatacagagttttgctatgtttcccaggctggtctcaaactcctggcctcaagcaatcctcctgcctcagcctcctgagtagctgggactacaggtgacagtacctccgtgcccagctaacatttttattttttatagatacacagttttgctacatttcccaggctggtctcaaactcctggcctcaagcaatcctcctgagtacctgggactgcaggtgcatgccaccctgcccagctaatatttttattttctgtagacatggggtttggctatgttgcccaggctggtctcaaactcctggcctcaagcaatcctcctgcctcggcctcccaaagcattgggattacaggtgtgagcaacacacctgggctggaatttgttgctttaactctccacgtaggcagcagtgcctcgcacacatttaaacaccacgtgctgttgaaagtcctacggtggcggcctcacccggccaccctcgtgtctgtacctgtgtggtctggggatccagcaagcagcctcttggcagccagatctgttgccatttcgagtctgtgccctgtggccaccggacagcccccggggaagacagacagccaggactgctgaggaacgcgcatgactaatcaagaaattacctctaactgatgccagctgccctgacacaggaggcacaggcttgcggtttgggccccgccggggctcagcgggcaggatggaaattttagaaaatcagcacaacggttgttcttggcggtgtctggcctgcagaggtggctgtccagaaatttctgggcactgaattgtctgaagcaacggacagaccacaggtgggcgctcaggggctgtaggtgggaccctcctctcctctctcctctctcctctctcccctctcccctctcccctctcccctctccctctcccctctcccctccccttccctctcccctcacccctccccttccctctcccctcacccctccccttccctctcccctctcccctccccttccctctcccctctcccctccccttccctctccttccctctcccctctcccctccccttccctctctcctctcccctctcccctctcccctctcccctctcccctctcccctctccttccctctcccctctcccctccccttccctctcccctctcccctccccttccttctccttccctctcccctctccttccctctccccttccctctctcctctccttccctctctcctctccttccctctctcctctccttccctctctcctctccttccctctctcctctcctttcctctcccctctcccctcttttcttttcgcagtctgtcatccaggctggaatgcaatggcgtgatctcggctcactgcaacctctgtctccctgcttcaagcgattctcctgcctcagcctcctgagtagctgggattacatgcatgcaccaccacgcctggctgattttttactttttgtagccccaaaaagagtttcaccatgttaaccaggctggtcttgaattcctgacctcaggtgagccaccagccccggcctcctaaagtgctgggatgacagtcgtgagccactgcacctggccaggttggaccctttttcttatgctttgcaggtaaatgcacacctgtctggcagcaatgcatccagcaatgtttctctcctcttgagggtctgtgtgtatctcctccagccctctcacttatttcttcttaaaacagctttgccagccgggcacggtggctcacacctgtaatcccagcactttggaaggccgaggtgggcagatcacgaggtcaggagatcaagaccatcctggctaacacggtgaaaccccatctctactaaaaaaacaaaaaaacaaaaaaattagccgggcgtggtggcatggtggcgagtcccagctactcgggaggctgaggcaggagaatggcctgaacccgggaggcggagcttgcagtgagccgagatcgcaccactgtactccatccagcctgggcaacagagcgagactctgtctcaaaacaaaacaaaaccaacaaacaaaaaaacagctttaccaagacgtgagttacgtaccataagctttcactcattcatacagttcaatggtttttaatatattcacagatgtgcaaacaacaccataatgcaattccagaaccatttttatccctaaacaaaactcaggacctggccgggcatcatggctcacacctgtaattccagcactttgggaggccgaggcaggtggatcacctgaggtcaggagttcgagaccagcctggccaacatggtgaaatcctgttgttactaaaattaaacaaacaaacaaacaaaaacaaatgggccaggcgcggtgactcacgtctgtaatcccatcactttgggaggccgaggcaggtggatcacctgaggtcaggagttcaagaccagccttcccaacatggtgaaaccctgtctctactaaaaatacaaaaaaaattaaccgggtgttgtggcacatgcctgtaatcccagctactccagaggctaaggcaggagaatcgcttgaacctgggtagggggcagaggttgcagtgagccgagatcacaccattgcactccagcctgggcaacaaaagcaaaactccatctcaaaacaaaacaaaaacccttcagaaccccacaactgctaatcctgttcgttcctgtccccagcccctgtgaacctcaaatctgcttcctgtctctgtggatctgcctattctagatattttataagaataaaattctacaatatgtggtcttttgtgtctagcttctgtcactgagccaggggtcttcaaagttcatccacgctgcagcctgggtcagagcttgagtcctttcagtgggtgcataatagtctactgtgtggatagaccacattctgtttattcattctcctgtggatggacatttttgttctttctgatttttttttttttttttgagatggagtcttgctctgttgcccaggctggagtgtagtggtgcgatcttggctcagtgcaacctccgcctcctgggttcaagcaattctcctgcctcagcctcccaagtagctggggctacaggaacctgccaccacgcctggctaatttttttgtaattttttttttgagagggagtttcgctctttttgcccaggctggagtgcaatggtgtgatctcggctctcggcaacctccgcttccccggttcaagcaattttcctgcctcagcctctggagtagctgggactacaggcatgcatcaccgcacccagctaatttttgtatttttagtagagacagggtttcaccatgttggccaggctggttgtgaactgctgacctcaggtgatccaccctcctcagtctcccaaagtgctgggactacagacgtgagccaccgcgcccagcccattttttttttttttttttttttgtaattttagtaacgacggggtttcatcatgttggccaggctggtctcaaactcctgacctctgatgtatgatccaccctcctcggcctcccaaagtgctgggattacaggcacgagccatcacacccagcccattttttttttttaataattttagtagcgacaagctttcatcatgttggccaggctggtctcaaactcctgacctcccatgatctgcccgcctcggcctcccaaagtgctgggatgacaggtgtgagccaccgcgcctggcgtgttcctgattcttggctattgtgcataaagctgctcttccctcattcccagccctgggaacccctttctaaagggttcagatgctgagtgcagtgatcactacagtcttgttccgggtggaccttacagggttgggatgagaaatagacaaaaggcatctcctcgtgggcagcagggattgcatgccggtgacagacccttttttgccagctattgtcttctggctataaccacccctctttcctgagtgctgggggctgtcccagctgttgaacacacaggggagtgagaggccccagccctaaggaaccacaagccagccccgtgcttgtcgtctgctctcctttctgttttctgggggtgtttgcaccacccagtttgtggttcttttgatagggctgcctcaggaggccctcaaccccaaagacagcaaatggcactctgttggagctgtggatttggaagacaaaacagacgctggcttcaattacctactttgattacgtagaaggaagttgtcgtgggccacaccctggctgatactctcggtattatggccatttcttacttagaaatagggtctgcgtctatgtcattagtgaagtcaaaatgtggtcataatagagtagggagaggccctaataaaattcactggcgtccttaggagaaagagaaatttaggcacagacacagagagaaggcatggaaagatgaagacagagacgagagtggatggatgggtagatggatgaataaatggatggatgggtgggtggatggatgggtagatgcatagatgggtggatgaatgggtacatgggtgggtggatggatggatgggtgggtgagtggatgagtgcatgggtgggcagatgggtgggtggatggatgggtggatgggtgggtgggtgggagggtgggtgtgcggatgaatggtaggtgggtttgtgaatgggtgggtaggtgggtgagtgggtggatggctggatcagtgtttagataggatgtgtgggtggatgaatggatgggttgatgggtagatggatgggaggatgtatggatgaatgcatggatgggtggatgggtgggagggtggatgtgtggatgaatggtgggtgggtgggtggatgtgtggatggatagatcagtgtttaggtggatagatgtgtgggtggatgaattgatgggttgatgggtagatggatgggtggatgtatagatgagtaggtggatgggtgggtggatggatgagtggctagatggatgagtgggtggatgggttggtggatggatgatgaatggatgtggatgggtagatggatgggcgggtgagtggatgagtgcatgggtgggcggatgggtgggtggatggatgggggtgggtgggagggtggatgggtggatgaatggtaggtgggtttgtgaatgggtgagtgggtgggtggatgggtggatggatggattagtgtttagataactggaagtgtgggtggatgaattgatgggttgatgggtagatggatgggtggatggatgggtgggtggatggatagatgagtaggtagatggatgggtggatggatgggtgggtggatggatagatgagtaggtagatggatagatgagtaggtagatgggtgcgtggacggatgggtgaatagatggatgagtgggtggatggggggttggatggatgatgaatggatggggatgggtagatggatgcatgggtggatgaatggtggatgggtttctgaatgggtgagtgggtgggtgggtggatgggtgggtggatggatcagtgtttagatagatggatgtgtgggtggatgaatggatgagttgatgggtagatggatgggtggatgtatggatgagtaggtggatgactgggtgaatggatggatgcatggatgggtggatggatgggtgggtgggtggatgaatggtaggtgggtttgtgaatgggtgggtaggtgggtgaatgggtggattgatggatcagtgtttagataggtggatgtgtgggtggatgaatggatggattgatgggtagatggatgggtggatgtatagatgagtaggtggatgtatgggtggatagatggatgactgggtggatgggtgggtggatggatgatgaatggatggggatgggtagatggatgggtgggtggatgaatggtgggtgggtttgtgaatgggtgagtgggtgggtgggtggatgggtggatggatggatcagtgtttagataggtggatatgtgggtggatgcattgatggttgatgggtagatggattggtggatgtatagatgagtaggtggatgggtgggtggatggatgggtggatagatggatgagtgggtggatggacggatgcatggatgagtggatggatgggtgggtggatgggagggtggatgggtggatgaatggtaggcgggtttgtgaatgggtgggtaggtgggtgaatgggtggatgtatggatcagtgtttagataggtggatgtgtgggtggatgaatggatgggttgatgggtagatggatgggtgggtgtatggatgggtggatgaatagatgagtaggtggatgggtgggtggatgggagggtgaatagatggatgagtgggaggatgggtgagtggatggaggatgaatggatgaggatgggtagatggatgggtggatggatagatgggtggctggatagatgaataggtgtatgggtgtgtggatggatggatggatggatggatggataagtgggtgggtggatggatggatcagtgtttaggtggatggacgtgtgagtggatggatgggtggatagatggatgagtgggaggatgggtgaatggatgtatgatgaatggatgaggatgggtagatggatgggtagatggatagatgggtggctggatagatgaataggtgtatgggtgtgtggatggatggatggatggatggatggatggatggatggatggatggatggataagtgggtgggtggatggatggatcagtgtttaggtggttggacgtgtgggtggatggatgggtggacagatggatgagtgggaggatgggtgaatggatgtatgatgaatggatgaggatgggtagatggatgggtgaatggatgtatgatgaatggatgaggatgggtagatggatgggtggatggatagatgggtggctggatagatgaataggtgtatgggtgtgtagatgggtggctggatagatgaataggtgtatgggtgtgtggatggatggatggatggatggatggataagtgggtgggtggatggatgaatcagtgtttaggtggttggacgtgtgggtggatggatgggtggacagatggatgagtgggaggatgggtgaatggatgtatgaggaatggatgaggatgggtagatggatgggtagatggatagacgggtggatggatagatgaataggtgtatgcctgtgtggagggatggataagtgggtgggtgggtgggtggatggatggatcagtgtttaggtggctggatttatgggtggatgaatggatgggttgatgggtagatggatgggcagatgtatggatgggtggatggatggatgagtgggtggatgggtaggtggatggatgggtggatggatggatgagtgggtagatgggtgggtgggtagatgggtggatggatgaatagatgatgcatggatggatgcttctatccaccatgaaatgccgattgtttccagaaaatcaccagaagctgcagcaaagcttggaacagattttccctcagagccctaatgaggaaccaaccctgccaataccttcatctcagacttctggtctccaggatggggagagaatgcattgctgttatttaagccaccacatcagtggtaattagttatggcagctgtcgcaaaccaatacaccgagaaaagagaggaaaagttttaaccaacagacttcaaagaaattagagaaagcgtcatcataccaaataaaagagaggaagaaccttaaaagaaagataaagcatgaaaagcacaagattataggataagagaaagaaatgaggaacaagccaatgggcctcagaaactcaatggaagacaaggatctcaagacttgaagatataaagacggcactgcaaagcaataacaacaacaacatgtattcatgcagtccccctttctttggttgacttactgttgagaaatgtccaacactagcagagtggagcatatagattatgatgtgatttgccaaagcccaggaggaatggctgcataggaccctctcctcacctgccatggttgcattgaaccactagggtagggaaggaagcaaggctcagagctccctgctcaagcatctccctgcaggggccaagacatcttcttgacctttgacatgtggatctatggcacaggggctgtccagagctctccatgacccaggcatcagaccccttccagctccaggagggaggaggtacaggtatacacctggtgctgacctacaagggtcacaggaagaatccagctttgggacacctcctatgaccaagttgttcaggattttacaatgtggtctcagggtcactgttagtgcacccagacctgtttgagcaagagtccttgatatcgatttagaaatataatgggtcggctgggcacggtggctcatgtctgtaatcccagcactttgggaggctgaggtgggcagatcatgaggtcaggagatggagaccatcctggctaacacggtgaaaccccttctctactaaaaatacaaaaaagaaaaaaaaaattagccgggcgtggtggcgggtgcctgtagtcccagctactcgggaggctgaggcaggagaatggcatgaaccccggaggcagagcttgcagtaagcctagatggcaccactgcactccagcctgggtgacaaagtgagactctgcctcaaaaagaaaaaaaaaaaagaaatataatgggtcatatagatgtttgagaggtagccaagggtggctgatgccaggtctagaagaacaagggtcacctagaaggcttcccctaccctcaagaatagttggaaatgtaggaaacatccctggttgccacaacttaaggaaggatgctactgggatctggtgggtggagcccagggatggtgctcaacaccctaccatgcacaggagggtccccaccacagagaagcatccagcctcaaatatctacagtgctgaggttgacaacctggcatgagcataagaacttcaccgtcagcctggagcagtggctcacacctgtaatctcagcactttgggaggccgaggtgggtggatcacctgaggtcaggagtttgagaccagcttggccaacacggtgaagccccgtctctactcaaaatacaaaaactagccaggtgtggtggcgggtgcctctaatcccagctacttgggaggctgaggcaggagaagcacttggacctgggaggcggaggttgcagtgagctgagattgtgccattgcaccccagcctgggcgacagagcaagactgcatctcaaaaaaaaaaaaagaagaagaagaagaagaaattcaccatctgtctatccatgaatccatttgttgatctaacccctgtcatccatctatcatctatcatctatctatatcaatcgtcttgcaacccttgatctatcatctatctatatcaattatctatcaatcgatcatctatctacctatcaattttctctctatcaattacttatctatctagcaatcatatctatcaattatgaatcaatcatctttctatggatctttcatctattcatatcaattacctaccaatcagttatctattaattacatctatcatctgtgaatcagttatctaacaatcacatatacgtgttcatcaatctatcaattatttatctatgcatcaattatttatccattcaatagtttgcaaatgtgaatgattcaggtatcataattgggaagatgcgtctggcatctggtgggtagatcccagggacactgctcaacaccctacagtacacaggatggccccaccacagaggatcatctgggctgaaatgtcagcagtgctaaggctgagaaacctgccctcaagcaactgtgtgacaagagcagccttcaacaaacacacagagctcaggagtactttccaaagaatgtctgcaagaggctttcggggagagaaaagaccccaggcagatgttcctagcaagaagctggtgtcgtggaaagggacagtggtctcatcatggttagtgaccagctgtggatgaagagcgattccttaaaatgcctgcacgtgcccctcattgccttgccgtcacggacctcccaccccatcacagaggaggagacctggtcttcaggaagacagatggaacatgagctaaagcatctcttgggcccctgagctggggtggggtcagacgtcagagctgtggccagaagcaataacaaagagaagttcttgactcatgtggaaccttccattggtatctcctgtttccaatcctaagcatttctctgtatgatggacaccaatgcttttaaaatgaaaaatggtgctggcaggcgtatgtgtgtgtgtgtgtgtgtgtgtgcccagcagggaagcagaaattattaccaacatatcttttgcaaacagggatcatataaactagagagattgcagaaggcagactgtagataagagattgcagagaggttgtagggtgacagacaggtccttttgggagggaggaagtaggaagagagttggtggttttcaatatgggaagctgaagtggcacaggtatcttttatttatttatttatttttttgagacagagtctcgctctgttgtccaggctggagtgaagtggcacgatctcggctcactgcaacctccgcctcccgggttcaagcgattctcttgcctcagcctcctgaatatctgggactacaggcgcctgccaccatgcttggctaatttttgtatttttagtagagatgggggttccagcatgttggccaggctggtctcgaactcctgaccttatgatccacccacctcggcctcccaaagtgctgggattgcaggtgtgagccactgctcccggtacaggtatctttttatgtgaacatagatagcaggggctgggaaaacagagaagctaggtggtgggctcatggtgcaaagactatcatggaatataccagaagcctcctgccccctgctgtctgcctttctggtggtccctccccactgaactgcaacttatcctaataaaaccggggttgataccaccacttccaggttcccacattccaagtcccctcagccacagaagcagatgcaacctcttctgaacttccagacaccattgagttttcaactttggtttaatttttagatcttccaattacagaacacacacacacacttgttatgagtaaaagaataaagagaaatagagagctctgtattcgtgtttgtctttggatctttcccctccaggtcccacttcccttcagaagtaacctctgggagttcgtttgctctggagcctcctttcatacacaggtaagttttattttgcatagtaggacatacacccgtcaccacttttgtgaatgtcttgtggtgtctctaaccatatgccccacagtgaggggatttggatggatcaactctgcttcagcctgtgtgcttacacacactcctctgtaagtatttttatgcatacctgtgagaacattttctaggatcgatttctaggagaagatctgctgatttgaagggtttgcatattttaaatggaatgcatgtattagaaaggaagtaagatctaaaatcaataatttaagtttccacctcgagaaactagaaaaagaagagcaaattaaatctaatggaagaagaaagaaataaatcataaatattagattagaggagaaatcagtggatttgaaaataggaaatccatagaggacagaaatcagtgcaattgaaaacagcaagtcaatagacaaaaatcaaaaccataggcttgttctttgaaataacaatcaatgagagtaataagcttctagtcaggctaacaacaacaaagaatgaggacacaagttactaatactgtaaatgaaagaggagacatcactacagatcccatggacattaaaaagatcataaagaaatattataaacaattctgtgcccataaaattgatcacctagatgaaaagaacaaaaggataaaatctgacaactcacacaagaagaaacagccaatctgagtgagcctatatctcttaaagaaattgaatcgataatttaataaccttcccaaacaaaaggctccaggcccagatgggtttactgatgaattttccccaacatttaaggaagaaattatattgattctctaccattccttccagaagatagaaacacagggaatatcaccaaatatccacccaataaatttcaccaatatgtgcttacagctgatagacaagggcaacactcattctcacaccctcatcaacaagggtgacagcaactagcctgaagggtgagaggtttcaactcatattttcatcacagcaacagaggttgacatgtttctttcttttctttcttttttttttttattggctgagtcagagtttccctctgtctcctgagctggactgcagtggcacgaccttggctcactgcagcttgcgcttcccgggtttttttttttttgagacagggcctttctctgtcaaccaagctgggggcagtagtgcaatgaccgctcactgcagcctcgaactcctggcctcaagagatccttctgtctcagcctcctgtgtaagctgggacatggatgaagctggaagccatcattctgagaaactaacagaggaacagaaaaccaaacactgcatgttgtcactcataagtgggagttgaacaatgagaacacatggacacagggaggggaacgtcacacaccagggcctgtcggggggtgaggggatagaggagggagagcattaggacaaatacctaatgtagatgacgggttgatgggtgcagcaaaccaccctggcacctgtacacctatgtaacaaacctgcatgttctgcacatgtaccccagaacttaaagtaaaataaaaagaaaataaaagaactttttttaaaacaaagaaccagtatgcaaaatgtgccaaaaaaaactcttaagattcaaccactggaaaaaaaaaaaaccatttaaacatgggccacctcacgaaagatgctttgcaggtggcaaattcacctacgaaaaatcactccatgtcgtagctcatcagggaattgcaaattaataccgccgagacatgccggccgacaggtctcagggtgactaagatctagagataccaacagatgaagtaccggaactctcattgaatgctggtcacaagaagacggtccctgcaccctctgacctttaggtcactctgcagcacgcaatacattttttttttttcttgaggctgagtcttgctctgtggtccaggctggagtgcaatggcacaacgtcggctccctgcaacctccgcctcccgggttcaagccattctcctgcctcagcctccagagtagctgacaggcacctgccaccacgcctggctaagttttgtgtttttagcagagatgggatttcactatgttagccgggctggtcttgaactcccgacctcaggtgatccacctgcctcgacctcccaaagtgctgggattacaggcgtgagccaccgtgcccggccaggtagtcacattttcttcaagctttgggtttaagggatcccagctttgggcttaagggatcccagctttgggtttaaggagcccagctttgggtttaggagagtccagctttgggattaggagagtccagctttgggattaggagagtccagctttgggattaggagagtccagctttgggtttagtggagctcagcttccaaccctcgcaccctcaaagttccccatctttgtagacccagtgacccctgtttctgtgataacacctgcctctgaacgaactctgtgttctactgacttcaaagtgacccaccagccccagtgaactggcagctggcaggcgtcaggggatagaggacctgctggcgtcggcctcagatcacaaggcaagaatcctcctagctaagcacaaaaacgcgtaggaaatgctctgagctctgccgctgtgtgttgattttcctgtattgcatcacccaacgaagcagaccgtttgcccagcgagatttgcatgctgtcctccgcagacgccccgtggagattttgatctgcgtcttctgcaaaggcagcggccgcgtttctctgatttctgtatctcattctcagagtatatagcacggggcttcatcgctggccagagagcagattctgagaaacataagaagcccctttttgaaacaaaattaatttgtgtgtgtggtgtgtgtgtgtgtgtgtgtgtgtgtgtgtatgggtgaggatgtctcaacagcagcaaaatcggcctcactctggaaggcaggaagccactgtacgtggaattaagctaattaacatgaaatgccatttggtgaaaaaaaaaaaaaaaacccaaagtggttgagtgtgtggctcctgccctgctgcaaaagaagagtgtggaaatagcacgtatgctgaaatttaagcacttctgccgttactgagccacagtgcccatggttttagcaggttatggcagacagattcatttaacagatgagagagaggtgacaggaaggttcgcaggcttgacttcctaacagctgctctctgtttaaagatcgttgctctagacatgaagtccttgcccatgcctatgtcctgaatggtagtgcctaggttttcttctagggattttatggttttagatctaaatttaagtatttaatccatcttgaattaattttagtataaggtgtaaggaagggatccagtttcagctttcaacatatggctagtcagttttcccagcaccatttatgaaaatgtggcacatatacaccatggaatactatgcagccatcaaaaatgatgagttcatgtcctttgtagggacatggatgaagctcgaaaccatcattctcagcaaactatcgcaaggacaaaaaaccaaacactgcatgttctcactcataggtgggaattgaaccatgagaacacatggacacaggaaggagaacatcacacaccggggactgttgtggggtggggggacgggggagggatagcattaggagatatacctaatgctaaatgacgagttaatgggtgcagcacaccaacatggcacatgtatacatatgtaacaaacctgcacgttgtgcacatgtaccctaaaacttaaatgaaagataaaatcaattattttaatttaaataaataaataaagatcgttgctcagtgtgagttgacgcggacttgccttaggatactttaattgtgatctggtggattctgctcatcctgtttccagccatgtgctcagcaaagcagtcaaagagaaagatccctggagaagaaaccgagacggtctcaactaccttgttcctgcccgaagtcaaagctgggctcccttagatccaaagcggggtttccttaaaacccaaacaggagccaggcgtggtggctcatgcctgtaatcccagcactttgggaggctgaggtgggtggatcacctgaggctgggagttcgagaccagcctgaccaacatggagaaaccccatctctactaaaaatacaaaattagccaggcatggaggcgcatgcctgtaatcccagctactcaggaggctgaggcaggagaattgcttgaacccgggaggcagaggtcgcggtgagccaacattgcgccactgcactccagcctgggcaacaagaacaaaactttgtctaaagagagagaaaaaaaagaaacaacccaaacaggagctccattaaaacccaaagctaccctcccttagactcaaaaacaggcttccttaaaacccaaagaggggctcccttagacccagagctgagctccccaaaacccaaagttggactcccctaaacccaaagctgagctcccttaaccacagagctgggctctcctaaacccaatgctgacctcctttaaacctgaagctgggctgccttagaccaaaagctgggctctcctaaacccaaacctgagctcccttaaacccaaagctgggtttccctaaaactcaaagctgggatcccctaaacccaaagctgggttcccctaaacccaaagctgggctcccctcaactcaaagctgggctcccttagacccaaagctggactcccctaaacccaaagctgggcccttatatacctaaaaagctgggttcccctaaacccaaagctgggctcccctaaactcaggaaagattttcatctttgaacacaaaggagtgtgtttttctcttgctccctggacccaaacccccaatgacgggaaccctcagctgtgacaagcctccagtatacgtatttccccacgtgtgagccagtttcaatctctctcctctgaaaggtgaaagggtcccaaggtagcagtgatcatagacagagactcatttctttgttctctttgtgacctaagggaggttctcaggcccacagaaaaggatattttaaaagatttcaaagcagtacccatcctaggctacccctcagcacaagaaattaacattacaggccgggcgcggtggctcacgccagtcatcccagcactttgggaggctgaggcgggcggatcatgaggtcggaagttcgagaccagcctggtcaacaaggcaaagcctcgtctgtactaaaaatacaaaaaaaattagccgggtgtcatggcaggtgcctgtcattccagctactcgggaggctgagacgggagaattgctggaacccgggaggcggaggttgcagtgagctgagatcacaccactgcactccagcctgcgtgacagagcaaaaccctgtaaaaaaaaaaaaaaaaaaaaaaaagaagaagaagaagaagaagcggcagctggggaaccttcctgagcaaaaactagaatcctctgtgtcccattcaagtcctgcgtgtttgcaaattgactccaaaaatcacctggtgtgtcctcaaatagttaaccatgtcatgcaccaattctcctcctaggtaaaagctggagacaaataaagacaggtggagaatttgttaagcaaacatctgattccttaatgatgtaataatgtctttttttttttttttttttttttttagagacaggattgcagtttgttgctcaggctggtctccaagtcctagactcaagaaatcctcctgcctcagcctccaaaagtgttgagattacaggtctgagccactgcacccagcccttagtaatgtcttttttcttcttttgaaggtggtttctcactcggtcgtccaggctggagtgcagtggcttcatggcggctcacggcaaccttcacctctgggcttcaagcagttctcgtgcctcagcctcccgagtagctggaactacaggtgtgcaccaccacgcccagctacatttttgaattttagcaaagatgggcattgtaccatgttgcccaggctggtctcaaattcctgaggtcaggcaatccacttgccttggccacccaaaatgctaggattacaggcgtgagccactgcgcccagccccttaatgatgccttactgtaaattatgggtaaatgtgtacacattaaattaaatattaccttattaacattttatttacttttgtttctcttttatattgtaattaaggctatatggatatgtaaatttaatatgtaaataatatacataatcatataaagtgatataatgtataaattattattatataatattacatatattatttatatatattattgttatataataatttatttacaacttattttattataaattaaacatgttatattgtatgtatatttaataattatatacgatatattgtatagtatcatttatatgttatatataatttgtgtattatatgtaacatattgaacatagcatatataaaattatatacaacatattttatagatcaccttatgtgtatatataattatatgtataatacattatttctgcatgtcattttggtaagtgaaggtagcattagaaaatgtataaaaaggggctaggtgtggtggctcacacctataatcccagcactttgggaagctgagacaggtggatcacctgaggccaggagttcaagaccagcctggccaacatggtgaaaccctgtctttactaaaaatacaaaattatctgggagtggtggcaggcacctgtcatcccagccacttgggaggctgaggcaggagaatcgcttgaacccgggaggcggaggttgcagtgagcggagatcatgccattgcactccaggctgggtgaaaagagtgaaactctgtctcaacaacaacaaaaaatggttgcacccataaaaacttgcatatgaacgttccctgcagcactcttcacaacagccaaaaggtggaaacagcccaagtgtccgtcaacagacagacagataaacacaacgtggcccccccatgcacacagtggaatagtatacagccatgaaaaggaagaaggctgtgaccgaggctacactgtggatgaaccttgaagacatcatgctcagggagagaagccagacacagaaggccacatggtgtaggactccatttcaataaaatgcccagaacatgctgatccatatagagagaaagcagatgaccatggctgggactggggatggggaaacggggagtgactttccccctaaagggggtgtttccttttgcaggaatgacaaagtggtggaaatagacagaggcggctgttgcccagcactgtgaaggtcctaaatgtcccccagttattcgctttaaaacggtgagttcatgtcaagcataatctcaacaagaaacaattgtctcttgaagcaggaaggacattcctcaggtttctggtttacttcctgcgtctgagctggcccttcccctacaccctcctggctgactccctgcccgcgctgagtcctgaatgctcctgcagtctcagtgctcccccgcttgttgcttgggtcttcctgtccctcagagagccccggtcacagccaggctgaccctttctccccgggacagggcagccccagggccgagcttccgcttttgggggatgcagtcgtcactggggccgtagccagcctggcctcctcatccctcaggtccctaccggggtgtctggggccggctgcgcaagccttccctgtctgtggtcactatggctgatttgagcttggctgggcctgagtggaggggaagcagtggccaccactgtgtgaaccagtgacctcacggtgtccctcagggagccacagtgaaaggcgtccaagttctcaagtccagcattgtttcaatttcctccttgtctttcccggccacacagagcttccttcctagctgcctggagatgacagggaaggagaaggtcaagtgtgcttgagtcctcaggtgacatcgcctgttcttagagcagacgtcacattgaatgtttgcaaacgtttttttgtgcacccgtcctaggaagacgcgcttatcatctttgctttacatatggggacactgaggggcagagggcataaggaacctgggccatgagtgacaaggggcgtggtgcttgggacccagactgtaggttttctgggcatgtagaagatgccgcactctgccttgcaataatctccaaatacacgcatctgagtggaaacacacctgcgcctctgagcctgaactctgcacctgtctctggctgcctgtctcatcctccctgccctcccaaggggatttcagggaccatactgcatactgagagctccccaaggagaagagacctgaagtgtatcatcctggtgctccctgaggctggagcatagtcctggcctgctgggcaggtgcatttgcacctgctctttgcaggggttggggacaagtcagaatacgggtaaaaaagaaggccgggccaggcgcggtggctcacgcctgtcatcccagcactttgggaggccgaggcgggtggatcacgaggtcaggagatcgagaccatcctggctaacacggtgaaaccccgtctctactaaaactataaaaaattagccaggcgtggtggtgggcgtctgtaatcccagcaacttgggaggctgaggcatgagaatcgcttgaacctgggaggtggaggttgcggtgagccaagatcgtgccgctgcactccagcctggccaacaagagcaaaactctgtctaaaaaaaaaaaagaagaagaagagaagtgggtctcaacagggtccccagtgtatcactaacagctgagcccccaggagcccctcagcctgcctgagttattcctggagaggcagaacgagctgaggaatctcactgcctggttctgccctaaaccaccctcctgggaaggggtgaatgcaaagctaccaagtgactactactcaaaggctggggtggtgtttcccctgctcgctgtcaggcacagatgatgtgcttatgccagtttccttggtacagtggtctacctggccctgcagaaagctgtgtccccacagcggtgggaccaactcacagatatctccttgccctagctcctgtgattcctctggcccatgcagctccttatgcctgtctgcacccagcacagtcttgagtgacaccttcaaccctccttcttggggcatcagcccaccatggacctgccagagcctcttggaagtctgcatttcattccagcccatgggtgccagctcctgcctccatgaagaccctctcctccccaccaggtacctgctgcaaactcctttgggtctgctgtccttagcttagagctgtgcacccaggatggtcttggtaaatgcagggtgtgtgtgtgtgtgtgtgtgtgtgtgtgtgatacaggacattcccaatgactgtggagggaatgaatgggtgcatgtatgaataacactcagagcgtccacacaaatgtggagagaatgaatgaatgacatccaggattcagttatgcaaatgtggagggaatgaatgaatgatacccagggttcactcccacaaatgtggagggaatgaatgaatgaatggcatccagggtacactcctgcaaatgtggagggaatgaatggatgatacctaggattcactcccacaaatgtggagggaaagaatgaatgacacccagagattcattcccacaaatgtgcagggaaagaatgaatgacacccaagattctcttctgcaaatgtagagaaaagtaatgaatgatgcccagggcttccccacaaaagtggagggaatgaatgaatgacacccaggattcacttcggcaaatgtagagagaatgaataaatgatacccagagattccccacaaatgtggagggaatgaatgactgacacctaaggattccctacaaatgtagagggaatgaatatcactcagagatttactcctgcaacagtggagagaatgaatgaatgaacgacacctaaggattcctcacaaatgtggagggaatgaatgactgacacccaggattcacttccgtaaatgtagagagaatgaatatcactcagagatttactcctgcaacagtggagagaatgaatgaatgaatgacacctaaggattcctcacaaatgtggagggaatgaatgactgacacccaggattcacttctgcaaatgtagagagaatgaatgaatgatacccagatattccctgcaaatgtggagggaacgaatgaatgacatccagggcttccctgcaaatgtggagggaacgaatgaatgataccccagattcacttctgcaaatgtagagagaatgaatgaatgatacccagatattccccgcaaatgtggggggaatgaatgaatgataccccagattcacttctgcaaatgtagagagaatgaatgaatgatacccagatattccctgcaaatgtggggggaatgaatgaatgacatccagggattctccacaaatgtggagggaatgaatgaatgataccccagattcacttctgcaaatgtagagagaatgaatgatacccagatattccccacaaatgtggggggaatgaatgaatgataccccagattcacttctgcaaatgtagagagaatgaatgaatgatacccagatattccccacaaatgtggggggaatgaatgaatgacatccagggattctccacaaatgtggagggaatgaatgaatgataccccagattcacttctgcaaatgtagagagaatgaatgaatgatacccagatattccccacaaatgtggggggaatgaatgaatgataccccagattcacttctgcaaatgtagagagaatgaatgaatgatacccagatattccccacaaatgtggggggaatgaatgaatgacatccagggattctccacaaatgtggagggaatgaatgaatgataccccagattcacttctgcaaatgtagagagaatgaatgaatgatacccagatattccctgcaaatgtggagggaatgaatgaatgataccccagattcagttctgcaaatgtagagagaatgaatgaatgatacccagatattccctgcaaatgtggggggaatgaatgaatgacatccagggattctccacaaatgtggagggaatgaatgaatgataccccggattcacttctgcaaatgtagagagaatgaatgaatgatacccagatattccctgcaaatgtggggggaatgaatgaatgacatccagggattctccacaaatgtggagggaatgaatgaatgataccccagattcacttctgcaaatgtagagagaatgaatgaatgatacccagatattccccacaaatgtggggggaatgaatgaatgataccccagattcacttctgcaaacgtagagagaatgaatgaatgatacccagatattccctgcaaatgtggggggaatgaatgaatgataccccagattcacttctgcaaatgtagagagaatgaatgaatgatacccagatattccctgcaaatgtggggggaatgaatgaatgaatgataccccagattcacttctgcaaatgtagagagaatgaatgaatgatacccagatattccccacaaatgtggggggaatgaatgaatgataccccagattcacttctgcaaatgtagagagaatgaatgaatgatacccagatattccctgcaaatgtggggggaatgaatgaatgacatccagggattctccacaaatgtggagggaatgaatgaatgataccccagattcacttctgcaaatgtagagagaatgaatgaatgatacccagatattcactgcaaatgtggggggaatgaatgaatgataccccagattcacttctgcaaatgtagagagaatgaatgaatgatacccagatattccccacaaatgtggggggaattaatgaatgacatccggggattccccacaaatgtgaagggaattaatgaatgacacacagagattcattcctgcaaatgtggagggaatgaaggaatgagtagcacacaggacttgcttgataaacgaatgggtgaatacataaatcaatgacgtgtagggttttctccctaaaagtggagtgaataaatgaaagagtgaatgcatgatgcccactagttcctgacaagtgtggagcaaatgagtaaatgagtgaatgaatgaatgccactctgagaatgcacagccaatgagtgacggaatgtgtggagcaaatgagtaaatgaatgaatgaatgaatgaatgccactctgagaatacagagcgaatgagtgatggaatgtgtggagcaaatgagtaaatgagtgaatgaatgaatgccactctgagaatgcacagccaatgagtgacggaatgtgtggagcaaatgagtaaatgaatgaatgaatgaatgaatgccactctgagaatgcagagcgaatgagtgatggaatgtgtggagcaaatgagtaaatgaatgaatgcatgaatgaatgcatgaatgaatgccactctgagaatgcagagtgaatgagtgatggaatggacagaaggcggcaggggcagtgtggacgttagccccaccgcctccctccggtccactttggtccagcttgctactggccctgacctctctgctgcatccatggaaactgtgcacccagcacccctcgcccctggggtcactccctgtctgggctgtgtggttctccaggactgccaatcaatgaggagaggggtgtggtccaagcctttcaatcactgaggataggggggtgtggtccaagcctgtcaatcactgaagatgggggtgtgtggccaaagcctgtcaatcacccaagagaggggtgtggcccaagcctggccagttagggggccaccctcaccctgttcataaaaattatctcaagcagtggtcatttgtttctgacatggctggtcggaacccttcaggaggtgtaacttgtgggtgccaggagagagagggtgtctcttttcccatttgattctgctctgaaaagatggggaccccaggctaccagagaccctctttccatccctatagagaaagtggtcttcctccagtgattccacaccctgcagctgagggaggcagaaaaaggtggggctgaaacgtgggaagagagaaagagaaagaggagaaactgacaaccatgtaagctcctggatccagccatgcctgaagcccccatagaaatcctaattatccaatttgacaatttccacc

SEQ ID NO: 73 - DNA, 9279 bp, Homo sapiens
tgagcccttgtgcccagccaaatcctttatctaaagacagtaccttattttcattgttgctctgaagattgaaatttaatatatggaaggacatggtaagagctttaaaagcaccatacagacatgtcagtgttcagattagaaatatatttattggttaacaaaggatttttctaaaataatctgaagagaaacttcagaacctcagtggcatgaatactttgatgttagaccgtgtgtattttaaccacttgaagaatctaaatgcacaaaattaacagattagattttcattttaaatgtgaaatatattttacccaagctgtccttttcaattttatctataaatcttaaagtttttatatgtactgggggcttaccttcttgctgtaggttccctttatatatactgttttatcatcctcatgaatgatcttaaacaactcaatctgttaactaagtgaataatgtacctgtcacatagaggtattgaatgaatgttataaatatgatagctatctatgccagaaatcgttggttttggtagacagacttcagcattcagcacgatcattctcagtaattctttataggtgttttgatttgttttgagggggttgtttggcatatattttgcaactaattaattcatttttgtaaaaccatcagacaacagtgctagatgtttaaaatattctacagcagaaattttcaaatgtttttggaatcattaatacaaccctgtctctccttcacttaaaccacagtagccattggtaattgagaactagattctttccctttgagtcctagttgatctcaaaaatcattctcaacactgcacttagctacaggtagctgttaatattttgagttgatgactaagctgaaacccatttgccacctgtgagttaatgggcaaggtctatccttgtctcttccaggctctagcctatagtgcaagtgttggcaaactttttctgtaaaggacctgataactattttaagccttgttaaccatacagtctcttatcacaaccattcacctctgctattgtagcctgaagccagctgtggacaagacacaacaaatgaactatgttccattaaaactttatgagtgtgactgtgttccaacaaaattttatttaccaaaaaaaacaaaaacaaaaaaacagggagcaaatgggatttggcctgggagttctagttggccaacctcccctctagggcaagaaactggttttgattcattcaacaaataattaggtgtcttccatattccaggcactgtgttaagttttgattatatagcaataatcattacacgtaggccccaggtcatgaggtatttaacccttaactgagtatggttttggggctttttgcttttttggttttggggtcttttttgtttttgtttttttgtttttttcaaggcaggttctcactctgtcacccaggctagagtgaagtggcgctgtcacagctcactgcaacctcaacctccccaggctcaggtgatcctttcacctcccatcctcccgggtaggtggaactacaggcgcaggccaccacgcctggctaattttgtgtatttttttgtaggggtggggtttcgccttgttgcccaaggattacaggtgtcaaccaccgcatccagcctgaatttgttttttttttcatgtactttggcagattcgaagtacttttttgagggaaaaatggagtctgccccatacatctgctttatttgttaatacatgtgaggttgtaggcaaataccctaagtgctatgttctgtgatagtggtataactaaatgtaacttcaatgtgccttagatattagatgccatggtatcaaaattaatatcctgttataaaaaatagggaagcaaaaatgtttgcatatgatacctaccctggctgcacatagcagatacttaatatccatataatattgaataaagctgaaattaccagtttcttaactatccttatgtcactttcttgcagtttcttccatttggtatgctatttctgacctcattttttgtttttcgccaaaaaattaccacatattactcatattttaatgaaatgcttaccatgcctagatgtattgttcagccttctactgttagaacttctttcgttaatttaaaagtatctttagttttctcagtattcatgtttatcttcaaaatgtctattgttgttgcttattaaatgagtcagagctcttcactgatactcagagatctccttaatcttaactgaagattactgctatttttattttcctattcctttgtgccctgtgagccagtcagactgctttttccgctatagtctaattaatgttcccatgttatgctgccttttgtgcctttgctctcacttttcttatccctggtatgttctttcctgttgaaatattgtaacttttttttttgccaccctcttcataaatctgatctctccttctgaactcccatagtattttgtacatctcatgatatttttcatatttttatgtctccatcttttcctacaaaattgtaagctttttgagagcaggtatgttttgtccatctttcagaatatgaaataagaagcaaattcctgtcagaacatattccacctaaaatggccaaccattcttgttttcccaggatggagagtttcctcagacatgagactttccgtgcttaaacctggaccgttggtcactctgattccacttcatgatgtagccatcttttttgcatatcagtgctttactgcaggttttttttttctttttctttttaaagaataaacacataaaatgaacatgaaggaaacagttttttgggttttggatttgttttttttttttttttgtttgttttttttttccagactgtttggctgtcacccaggctggaatgcagccacggtctcagctcactgcaacctccgcctcccaggttcaattcttgggcctcagtctcctgagtagctgggactacaggtgtgtgtgaacatacccggctaacttttgtatttttattagagacagggttttgccatgttggccaggctggtctcaaactcctggcctcaagtgatcctcctgcctcagcctcccaatgtgttaggattacaggcatgagccactatgcccagccaaacaaaaattttttttaattaacaaagcaaaattacttgtgccttttaagcaaatgtttggaagattatactcatatgtagaaatgtaaagatcagattcagatgataaaaaaggccaaaatgtgggaaaattttgactaaagttgaaaaagaatgatgtccttttcacaagcagagggactcttcagtaggtttggtttatggttagtagacacagtttttttttagagtagaccctgtaaaagaatgtggagtaaatggtggcagtggtttgaccacaacagtggtgtctattgctagagaaattaaaaataagatataagatacttaactctcctttttacaaaaggcttcagataaagaggaaatgggagcaaatccagagattataggcactgtatgggctaatgatttttttagagatgatgcctcactatgttgtctaggctggtctggaactcctggccccaagcagtcctcccactcaagcaagactgaagtaactgggactatagatgtgagctatcatgcccagttggcaggcgatttttatatgttatggtttattgtacaatacaagctattcactgcgtgttttattgtgagaagctcactaagttagaaaggttttcagttttgtgcagtatttttttctgttcctatttctatttctcataagctgggaaaaacatcatcagagttcattgggtgacatcttacatctaaaaccttaaaactaagttgagatttattatcacaaaataaattcccccatacctccactgaaccccccaccacccatgacttgatgacttcaatcatactcatcccgttccccagagcgccctcactttccaagtgaactcccctattccctaatgatttatatatccactggtctggtttaagtatccacttaggaagccttgcctggtagttctttatagatagacaattgttctcttctctgcatccacagcaagcactttattctgtagaccctgcttcattgtgagctaacacagcgcaaacactgtgaacattttaatttataaaacagagtgtcttctgggctttaatatgtagttgtcacatttgcttttcctcagatttctgggccacataacctctgtcacagttaaaactaatatctcggctgggtgcggtggctcaagcctgtaatcccagcactttgggaggccgaggcaggcggctcttgaggtcaagagtttgagaccagcctggccaatgtggtgaaaccccgtctctactaaaaaatacaaaaattagccaggcatggtggcgtgtgctcgtagtcccagctactcaggaggttgaggcaggagaatcacttgaacttgggaggtggaggttgcagtgagctgagatcgtgccactgcactccagcctgggcaatacagtaagactctgtctcaaaaaaacaaaaaaacttaacatctctaatctggtcattgaaattgaggtgtaaagcaaattaatgttttctcgttgcctcttgtatcctcctcttcccgtgtaagaaataataaggcccagtataaggtagtggagtagagagaatggaattgattccagaaataccaaggtagaatgaatcagacttgataatggagtgaagagagaagaatccatgacaactcccaggtatacagctacctattaaaataatatgctattgaagtcctttaggtgtcttaagcactataaacacctagatagatataattttaaaaaatagcaaattaacatttactggctacttcctatgtgttactcattgtgctacacattttgcatagggtaagttatttcatttgaatctttaagaactgtaagaagtagatacttttatttccattttcaaatgaggaaatgagacacagtttaaaataacgagaccaaagccactcaagtagaactgattccaacccagacaatgggatctaaagcctatactgagtcagtatgcatccctgtagattttactgctagttcagatgacagggaaaaaaggacatttttttaagtcacatctagagaattgggagcagggaggagttctacacaaatacagcctatttggaaagatctgatagaaactaataaggtgatcttgagcctatattattatttttttttttacctgtttttgaattgttggtctctccttttttaaaaaatcacttaactattttgcttatctcttgactcggctgagaaatctattaaactggttcttctgcatttgtcagattgttgataaattgttaccctctattctgtattctaccatacatgatcaaatactgaactgaaaaggtaactatagaaataaagctggaaaagctaaccttacgttgcatgtcaaattatatgttgttgaatatttcagggagaaagttggtgtgattaattgaaaaaacttgatttactagcagtattaatccatgaaaagggcaagggaatttttttctttcttgaggtattataaatatgatcagaatagagaaaatgctatacacagtttgataatctacaaattttgcactttctagatttagaaatcttgttcacaggagatctttcttggcagaatgagtaagattggaaacattttccatgtgtcctcattatgagagaggcagacaactcaaagtaaatatgataagcagtcttcattttagcagctttctatttattttatagttccttgttagaagttttatttttaaaagagggtaggagaggcagtgtttgggccccttattttttccttcaaaaagaatttttaaagtctgtcattgtgttaaacagattcataacaggtccttctgacagttgaattagttgattttatttgggaatgagaaaaggacacagttaccctctttagctgttaaagtattacttttggagttggagatggaaaggagaaatcaagtatcttctcttccagaaagtgcagtgggagaagtaatgttacctgacttcaggaaccagtatttaaggcctctttttttgagacagagtcactctgtcacccaggctggagtgcagtggtgcgatctcggctcactgcaacctccgcctcctgggtacaagcaattctcctgccttagcctccctaatagctgggattacaggcgcccgccacctcacccagccaatttttgtattttggtagagacggggtttcaccatattggccaggctggtctcgaactcctgacctcaagcaatccacccgcctcggcctcccaaagtgctgggattacaggcatgagccagcgtgcctggcctacttaggcctgtttttataatttagggtcacagaatttcaaactggggttagggggtgagtgtagtagttaaacaacttgagattggagaactgcttttgcaaaatttccattttggttatacccatgaaattttttttttgttacgaagtcttgctctgtagcccaggcttgagtgcagtggcaaaatctctacttactgcaaattccgcctcctggattcaagcgattctcctgcctcagcttcctgagtatctgggactacaagcgcccgccaccacattcgagtattttttttttttgtatttttagtagagatggggcttcaccatattggccaggctggtcgcaaactcctgacctcaagtgatctgcccgccttggcctcccaaagtcctggtattacaggcatgagccatgacagtcagctattttttttggcatattttaagggacagaaattatgctttttaaatgttgcttattgcttttcaaggatttgattcttataagctacttcttcatttattaatgagatttaagaaagaaatcaggttacaaagttatgagcaattgtctctggaacccagaagttggttttaacactagagtttctgctgcagggcatttttactggactgtgattcctagaaggcaagtataagcactgtttttttgttgtttgtttgttttagaaacaagttcttgcgtcacccatgatagagtgcagtaatgcagtcatagctcactgtaacctccaattcgtgggcttaagtgatcctcctacctcattcttttgagcagctgggactctaggcatgtaccaccacacccagctactttataaattttttgtagaagtgtggttttgctgtgttgtccagaatagtcttgagcagtcttcccacctcagcctcccaaaatgctgggattgtacaggtaggtgtgagccaccatgcctatccctgctgtttttttttgagacggagtctctgttcaagcaattctcctgcctcagcctccggagtagctgggattacaggtgtgcaccatcatgcccagctaatttttgtatttttagtagcgatggggtttcaccatgttggccaggctcatctcgaactcctgacctcaggtgatccacccacctcagcctcccaatgtgctgagattccaggcatgagccaccacacccggcctgtccctactttttttaatgccaagatttgtgtatttcatcttcagttgggattcatggcatctgtcaataattgatgtgaacttaaatggcaatttacctataaaaagataacttactactcttcttttaaaagtctatatacttctgtcatttgctggaaatgaattattagtctttattcagcaaacatttatagaccaaatagtgggtaccaaaataagtactaccctgcagctgcttgatgatggtaataactaacatgtaaatctttaataaacagtgtacattcttaatctgtccatcaactcggtacagtcagtattgttgtccgtatttcacagattaagacaccagcctagaggccgagtgcagtggctcacgcctgtaatcccagcactttgggaggcccaggcgggtggatcaccttaggtcaggagtttaggataagcctggccatcatggtgaaaccccacctctactaaaaatataaaattagccaggtgtggtggcacgcacctgtaatcccagctgctcgggaggctgagagaggagaatcagttgaaccagggaggctgaggttgcagtgagctgagatcacacaccactgcactccagcctgggtgacaagagtaaaactccatctcaaaaaaaaaaaaaaaaaaaaaaaaaaaaacaagatgccagcctagaaataaatgaccacccccctggtaaattacgtagctagttttggtctccttatttccagatttcatgttttatcaccctgagctccaaagatgatacagtatttacttttaagtgtataaggaaaaactgagtttgggcctcaaaccagccccaggatttctttatttaccaattatgaactagcctcactcagttcaggaagtctcttaaaatgtcagttatttggtttcatcttcttaaaatgtagaattgctttatgttatttaaatatgggtccttttttttaatgagttaatttgtttgcttttcaagataattttggattcaaagtttttaaggtaacctgggatgcaaattttgctaactggattaatacaaatttaagtttttaaaattccattgttcaactgtgttttatcctggataggattaaagcagtctttaaaggtaatctgttgttggctttaatgttttatagtacagtctggtgacacttggctcactagtccacattttttgtatatttggtatatagattttttccttggtagtcacttgtttttaacttctttttatattttacttcccagtcttaatctctgtaaccaatttgtataatcccttatacagttagtctctttatttgtggtattatttgaagagaagtgtgtttcctgagagaggatgtcatgtccgtgccctaatttttagttacatggcttttatttgcataaatagcatgcgagaaggtaaaggaaaatgtggttgcatcttgtcctggttgagtgcccactagtcttaatggattttcccagttgtgcatactttaggagtaaggatgttgtcttacgtttattttcactcctttttaaaatgtgtattgtttttgaaag

SEQ ID NO: 74 - DNA, 167984 bp, Homo sapiens
tttatttcacgatgagtcttcagaacactgttatccatgcatccaaatcacaaacatactctcctctttctcttggcttcccaaacttctatgaatattctgttcccctggcactgaaccagcaccataggaatggaacaaagacagagccctccttctgaaagaccaagctgtaaaattagcaaaggaataaaaaacagctggcgaaatgtgatagttgttattccgagcccatgaacctgaaaagatagtttattttagaagacaaacaaaatctgccttctgtttgatctgggatagcatccaccgtcaggagccgtcgactcgcatttagttactctggaggtttgggacaagcagtacaggcgttataaacaacgaaaagaaaggatcagtttccatcataatttgacagtaaacagtactaatttgactctgcagctgtttattgatatccaaaagaaagagttgcaattcaatagagagaacagtagccagtgtgctggggcagaattgttcgtaagatggcaggagccaggctgtcttgaatctctcgatgttagtaagaacacaatgtaaattgccacacaatgtggttttcatctggcagcagatccagcaatgggagcctatagtttttagcctccagagagggttctctgtagtggcttcatcttgatttatcttagtaactgccaatggattccctgtcaatcatttaatattttacagaaaaacaggtctggcccaaggcaaaattcactcactcactcactgactcgttttacgcgtacaatgtttattaagtgcttactatgtgccaaatgctgagctgtgtattgaagagaaaaatgatgcatagcgttcataccactgtgatcttcactttctagctatagagaaatctgcagactgataatgatgatacaataagataagcacaataatagacaggtactctggttatcaaagaatctggttagttgagttcccatgtgtatatcatccatgaactggtcatacagaactaggttaaatagtatcatagactagattcaaaagctgtggcccacattatttatttatttatgacattttaggtgattttaacaagaactaatataccagggaacttgataagtattttccatgcattatgcccattactcctcacaaccgcattataaggtaggtactatcgtcatcattcacttggccaataaacaagctatggcatggcataaaggttgaatttcttgcctgtggccatgaaactagtgagtggagaagccaggggtagaatcccagttcagtggactccctgtcccatgctttttataataatgcttctagttaaggtacttagaagtcgtgaatctaggagctcatcatggacatcaattatcattgtcatatatttttgaaaaagcataggttttgccaatgaatacaacattattctactaatttattacaatttactctcaaatttctccatataatatgaaattgccactttagtgatgctcagggccttttgcctaggataaacagaatattgggcttcagttctttaaaacttacttgttgggcacttactatatgtcaggagcaagcatgtgctctcccattactgggagtcacaagtccagtcaagatgttcctgtgacattatcctgattccctaccaggaacagttgtctgctttcccaatccaaaatttagaacaaacacaatcccacaacattttaaataatttccaagacatttaccattttctgtcaaatcagagagaagaagtaagagtggacagctgttagaagagaaaaccctgtcccatgttcagtttagtaagaatatgcacttttacaacttatattttaatttatcttcctttcagatgcaattgaatcttcatcattaggtcatatctggcctggccaaataaagcattctatttagaaaatggaacactttgttcagccagcatctctccatttcacttaaaaaaaaatagacgcagtggacttgtgacttccaaattatttcatgcagttggtttgcccatgttctgatgcacaatagatgtgagtgagctttggaaatcctgagggcaaaggagaatacacgtgatttggtagagtggcagaattttctccttatatgttccttacgtgtatgtgtgtatatatacatatgcatgtacacacacaaataacacacatatacaacacatatatatgctatatatagcatatataacacatattatgttgtatatgtatacacacatgtatgtagatataacatgacatgcatctataacatatataatatacatatgtgtatattaacatatataacatatatacatatataacatatctattatatgtatttaatttctttggtacattcatcatttgttaaacacacaaaaaatgagggaagtatagttctaaatatcattaaaggaaaataaactgtgaagctcagttaggcttcttcatgttataccttgattctatccccatcactgatctatgtcttgttacccgagtgccacaactctctctgacttttcttggtaatttgttaatatcctcccacttaaggagtgagtttggagcattcaatacaaataatagcttatatataactatatgtgtgtcatatatgtattatgtgtcggcactttacagcagcagaccacacagtagtgtatgtattaggatgctctcagtggcaagcaacacagtatcctgacttcactgcctttagcaaagaatacatttactatttcatgcggcagttccagagatacagcacattcagggatggttaattaagtgaatcaataatattatcgaagacccaagatctttccatctctctgctctgccatcctcagagaggtggcattatgctcaagcatgtcccctcacggtagcaaaatgtctgcagtaacaggaccagtatggtcatctagatatggctgtggccaggggaagaagataccacttctttttatgcctcctcgtaaaagcaaggaaaccttttgtccaacccctcaaagacttcccctcacatctcagtggtcagaattgcattacaggcccttctttccaccagccactagcagagggaaaaggaaccaccattatgagcttacaccaaccagaacacacctcctagagttcatgaccatgtggaagagatagatacctgaataaaattgaggtttgtttatcaagaagttggagtgaatggcttttatgtaggcaatcaacagtgtctgttacaagtggtcatgcctggcctgtctaaccttcaaataatcttgtatagaaggcaagtcaggcattacaacccccaagaagcagaagagaaaagcaaacattttagttgtttgtgcaaggccacctggaattaagcagcaaagtgaagatttcaaccaaagtcttcagtctcatattcaacgttctttgaattatctgtctcctggtcttggcatagtcagtgacttttcatcactttagtgcttgctatctttcctggcgcctgaactcagctaagatttgccttcttccaatgatggatgtgtagctgacacttagggagcacttactatgcactgtgctaaacactttacacaattaatctcacaaaaccccaaatcacacaactagtgtgaggaattgggttcaatctggtttaatcaagtctagaaaccatattcctattactacgtagtgggtgtactgtctgttgtcagggatgcaatgggcaggcatgaagttaattcaacattgcacaaaccaaggagtgctttcagatggaaattgatttacaacagtagatatgtgcctttgtggtagaagaaacttggtattcaatacagttaccctcggttacaggctattagaagctatggcacaaaggctgaatttctcacctgtggctgtgcaaccagtgactgcagaagccaggagtagaatcccagttcagtgggattgaaaaaaaatcccaactgagcctctgttttcttatttgcaaaataaggataaaagtaatttctgcttcacagccttgttgttgcaaagattaagaaagactatatgaagaaacactctgtaaattgcagactattaaaatgattattaataatttttatgattattggcatcatctgctttcagagatcagggtgttccatgcctgtgactcattttctctgccctctaagaaaggcagggattaagaaacaagaaactgtgaagtgatatcaacagttctgcagataggtgaaggctgtcataggcttaattctgccctgggctgggcatggctattcagtcccgataatccaccccccccgcccaggatgacttcctcacctctccttctattcctcactcctctcaccttttgccctggagctgtttagtgctctcctctatcctgtggtttttctctaggtggcagggaagggtaagattgtatgtaacactagcaaaatcagagaatgtgcataaatcaccatgtggataaactccggtatagggcacaggctgctctatgtgagctgagatgctcctgagagctgattttacatacgatgcagcagacatggagcatcaccctcgaacagcatgacatagacctgccagatgctacagctgggagagggagagaccctggcaatcacctaaacccttctgttccagatgttaatggatgtgattaagaaagagaattcatactcaaaagtgtctggcaagcacagggctaaacacagttaaacaagtttctttatttatggttggatttggggagtctttaataggctaacatgtattatggatgtctaagaagggatttcccaggatttacttgataataaaataattttttcatgaagcatctgatgaaacccattttccatagaacactgattaaattcagtcatattttatatttggggaaactgaggttcacagaggtgaactgagttgctcaagctagtggaagaggaaggctcccagttcatcatgtcctatataggcagttctcagtctttaccgtccatcaacataccctggagagcttgttgaaacagatttctgggtcccatccccagagtttctgattcagtaggtctagggaggggcctggaaacttgcacctgtagcaaattttggggtgttgctgatgctgctggtctgtggctcacactttgagaacccctgccttatagcacctgactcttattagatattatggcagaaaacagttgaatcgggtttcttctatatggagaggtgtgactgcctggaagcagaagaaacatgaatagatagagtaagcaggtgccctcatgatgggatttaaggagctctgggaggccagctcagccttccaaactcttctacccttcctgaaggttttccttccctttgtcaccttacctggaaccctacccaatggagattcatcatggttcttgctttccttgtttttatcttgttgcgttttacagtgtaaatctcctgggagagttgaaaaagatcatcagtcactcacacttgagtgagacttagttacatcagatttccctttgtacctggctgagaatactgtcaacagagaaagagatttttgactgggttggggaaattgcacttatgtttggaggatgaaaggggactttcaaatgggttgctgggtgcctggtgagtgagcgtgacaggagatggcatgctgctttgggttgagctgcgctttcacgctgtctcgtaagtatcactagctactgaactaggaaggaggggaggatgcagattttcctgttggatcccaggaggactttcctcattcccctatgggaatctggggtagtggggtagtggggcagatacaaatgactcccagggtccctgttgactagggaagctcctttgggtgacaaaatgccaggatctgatgttgtctgagtgctgggtggtctgtccctgtgctgtgccctgtgctcatgggaacatctgccagcttctttgctgaattctgtttactaaagagctgttggtttattccctgggactgtagcaaaagctgctgcttcctctttctgtctccctctggttttctttttctctttttcctcttgtcagcctctctgtgttttgccctgtttccagtcacagtctctctatggaggcagatgggaagaaacttctctggacaggagatttaacattttacatattctgcggcagagatggagcatcacccccaaacagcacgacatagacttgccagacgccacagcacctggactacaactgtgcccatttccaggggtgccatttgcatagagttgcatcaaaatgttaccctgcccaagtcatgatacttgggtggctgtggccagtgccttccctaatctctgcctttaactaatgaggaagaatgaggatgggatgagagtagaggtgggatgagaaagagtagagacccccttccgcagacccaataccaggaaaaattgcaattccctttcaatttcttctcagctgccccagggtaacaggtggccacccttaagatcaacctcaagtagcataaggatgggaaattcagacccctggaatgctgactgggaatatactctgggtccaagatttggggctgcccatagctttcagagtactcagctcactctatatctaggacagtgatatctggagggcaattgacatctgctaccccagttactgaatcctttaaagaagagttttaaggctgtcttctcctggtactcctgtcttttgtttctaaagtacagggtggtggacagcaaggactaacagccgaggagaagtgtggaaatcatttactacaagtctcccagaagaatgcagaatttcggatcaaagttagaatggacctgtcaggcaatatttatccttccctttctgagttctgatgactgacattgttctgttttcattattggccctcagaagcaattgttttaaaaaaatattgtctagacttgaaattgagtgaatatgacattaattacagaggctttcctctgaatgtctctttgccagctgtgttctctgtgcctgagctgctggtggctcccgggagatgtgcatggtgaagaagggaatggctggtgtcagagacctgctgtatgaaggttctggactctgccttgaacacaggtcccaggtcctcacatttcaccctcacaacaaccctataaagttggttcaattttccctgttttacagctgcagaaacccaggcttgggaaacttagatactatgctcaagttcagacccaggtcaacctagttctgagatgcgtgttctttccatctaccaggtagcaaggtagcttggagtgagacaggctccatttagtaatggattcacttacattactaattcatagtacacatctttaaggcagtttttcaaatgtgaatccctccattactaggccacaacctccatatagtgggttatgatggccagcattaaaaaaaaaaaaaaaaaaaaactaagaaagaaaccagcatgtgcaagtatgtaagtagtacaggttgtgtgggtctaaaccttacgtgattcagagggccctatttatgaaaaaggatatataattatggtactttttttagaatgaaaataaaatcacaaaaaatcaggagttttaaaaatctgaccacaaaatccagacaacagcatactatttttattaattaacagtttgacacactctatggtactagctatcctacatttgttggctgaatactttgatcatatcttcatacaataacaatgttgtaatgttttctatagaaagataatttgatctttaccttagcatcattgattgagacttttacagtcattggtagaaaagtttcagtatcacaacttgcattaatagtgtcattcaacattttaagactgttgtcagatttgggaaaatctatcaagtttccttcatacatgaatgtgagggcttggaagaattttccacagactagcttctggatttacacatttcaaaacctgtttctcctccactaccatgtatttttcagcgatgggtatcccagaacatgttcacatagcgctaagaccactaagcctgaacttttgcatcgtaacacttaagggtcagcatggtggtcaatggaaatattcccacaagtcattcctatcttgggaggtactagcagtaacttaaccatacaaagaagagactgtgaaatgtctttctctctgtctatttctccagatcccactacacccaggctacaaatatccccaatttcccatctcaacttctgtttagttggctcctcgaaattcccaagggcatcctagcactacccaacacatggaaaagactcattggggaaaaactggaatggaaagagacaacagtctccggatcttattttttcaaatgattcaaaaacagataactatatgaacacctcatatgggcccttcccaaggccttgtgcatgtgagtgtccctgaagcttagatttcactagctttgtcatgtatgtgcatgctgggagcctttctactaaggggtaagacagaattactgatgaaaacatgtttttttccctcagatgtgcaagggtgacagcaggattgtgaaccagagctttggagtttataaaatgccaatcttaatgctccaaagctggagctctttctagttcaggagcaagcaaaggatccttttctgtaaaggatcagatagcaaatatttcatgctttgtggccacatggtctcaagtgcaatcactcacctctacctttgtattgcaaaagcagccctagagaatacgtaaataggtagtgtagctatattccaatataacattacttagaaaaacaggggtagttggatggctcctgttctagtagatctcccttatgatgaaagttccctgtattgaggatgggaacgtcatcatggagagggtgtgtggcttccattgctgccatctgaggcagtcattgctggctctcaccatcttttggtgactttggagcaggagggttttaaaggagaaaagagagatggcttgtgagatgaacaaggtcaaggaatttttaagtgcacagattttgtttctttctcccatctttaagtcaatcatagactaagatatagagcagacatgtggctttttgagtccaagcatgagtcacttcactagatgtgactgaaatactaatattaagttaatctaatgtgttctttaagtttttgagagctccagtgaaccttctggtactgaaccttgtcattcatacccaccacctgtggtccacatccatttctacagcatacatgttcacattaccaacatcttaattttcctaggtcagaatattaaaatgattaaggtaaagtttctgaatttgtcttcttgaagagaagccttgcagaagaaacccaaaactattgttttttttgctttggaaacttcaaactatttcatcaaatcactatgattattgtatacttcagaattaaaatcaggaataaattttagtattactttccctctctcttttctcttctctctcattttaactgagttataagaaaggacttgattaaataaagtggaaggcatcatgttgtaatttaaagcattttggagttcaattttcctcctgtatacattctctttattatattatatttccactcccacagttagatgtttagcatcggtaacagatgcatatgttacatctaacatacactgatgagataatgtccaatattagtctaagaagttagataatgttcagtgtaaatagtataaaaatattttatttaaccctttaggcacaagaaatttcatttaccagccttaccaagaaaagtaggactggtaaatgattaaatgatcattgacatttaatttaaagcaaaaaagagtaagttatggataatgatgagttcagtagagaagcctactgattataacttatttgtgtttgctttttgaatttttgttttgttttgttttgttttttttttgggccgtaatttcacttgttgcctaggctggagtgcaatggctcactgcaacctccgcttcctggtttcaagtgattctcctttctcagcctcccgagtagctggaattacagatgcctgccaccatgacaggctaatttttgtgtttttcatagagatggggtttcaccatattagccaggctggcctcgaatccctgacctcagctgatccacccaccttgggctcccaaagggcaggggttacaggggtgagccaccacactgggccttgaattttttattctgttttttttttattttgtgtgttggcttttaactgctttcatggaaatgattagaaattttatatttcttctatgaattgtacaggacctatcagaaaggctgtgtctagaattacacttctgataaatggtagaattgggggcaatttgaggcttgagtaccctatccaagaatttcccccatgacaagtgagtaagggctcagtgttggttctcagatagcctgaggatagtgtagggtaaacagcagggcctctgaatcagcctgaactgggatcacatcctgtcctggccacttgctgatggtgtgactttgggctgtaacttatctttagaacctttgtgtatcatgtgtgattgggaacattaacattcacttttcttttgtctttaaatgagattatgtcagaacattcgataaactgttaacttaccgagttagctatactttttttccctctatctcagtttctttaaagcaggggttactgaccacattccagttacctgcatggctcttgatgatccaacagaccccagatgaatgaaatctaataaataattgaaaatcagattgcttgtctctaagatcatttgactgtccccacaccaacagtgggtacaagtgaaccagaaatcttagctctccactcaacagcgtttcatgtgtatatttagacatgtggagggatggagggggtttgtaacaatagattatattttcacagcccttttacattatgttttacagagctttttatatatgtttctgattttattatcttggcaactctgaaagattttcagcttcaaaaatattacaccacttataaaagtgcatgcagttttcaactggcaaaaccaaggctcaatcccaggccttcaaactccagctccttcccagtcttcagactttgcactaaaatactgccgaagaggctttgttatctgtttcatcaaggtttcttccctctaggcagaatggtgatgggaggagaagaggagcgggagaagaggaccagggaggtgattggtaggaagttacctgcttctatactgcagaataaagttctggctttccagacagctggaagagaggactaagttactcagggctgtcatctgcagcctgagagcccagggtcagtggttcttgggtgtgtggctttccagattagaaacattttccctaaaattggaggatgaacatgtgattgccaactttttattttactgaatgaggataggacataaaaacaaaaatgaaaacaaagcagacacttgttgtgtacagccaatatcatttcagtgaagacatttaacaccatgtcccagaaggcagaacatactctcatgatctatcaacaattctctccctctctctggccctccttccttccttctctctcttacttcctttctcctttcccttcccttcccttctctcctttttctgtttctttctctgtttccctccctctttctttttacctctttctcctttctttcttttctttctttctttctttctttctttctcagacttccttctcttctctttttcctccttctttctttccttccttccttctccttcttccttccttcctccctttctttctttctttctctctctctttctgtctttctttctctgtttccctttcctccctccctctcttcctccctcctctctctttccttctttatttttcttctttctttctttcttactctttcttttttccttccttccttccttccttcctccctccctccctctctctctctccctttctttctttctctttctttctttctttctttctttctttctttctttcttctctctctctctttcttctcactgcagcccactccatgaactggctgttgagagccaggaccagagctctcagtcctccctgggaatgcatgcctctccattttggtagaggctcctgtgtaggagtgaactaaacaaattgtgtgtttcttggagtctctgagatctctgtttccaagaaatgtaaaggatttaaaatactagtgcaccctgaagtaagaaagcacacagcagagcagagtcagccaccaaagtgttgaaatgtgcccactaaaaacaaaggggacctacctctgctcttcccaaaggaggtgcaaacagctcaacagccatagaaaacatgaagtctgagaactacccatgcacttgagagctctggaggggtccttggtgaaccgcctgggtaggtcccatcaggagagggtgaaggctgtgttgcttggagagcaacactccaagttggacgtttccctttgcagtggggagattgggtttcccgctgattgaatttaatgctcaggcaatcgcagttgagcatgaatcacttcatttcctttatgttgccccaccttcctatccacacccctctacacacacttaaaccacccccaaagtgcccagaaactctccaccagaaacttcctgcagagtttgtgaagacagtttgcatcctacagactcactaaagtgttgtccattgatggcagagttggctttacctggaggcttatgagaagtgccccaccccagaactagcaaatcagaatctgcattataactagattccaggtgactcatgtacacattagagtctgagagatgcttgtctacagcaccctgggtgttaaaagacctctgacactggcctctgcccataggtgaaatgcagttgatagttttcaagaaattaaaataaaaattcctttgcaagtatagagtgagcacgagtcaaacatttgttgaacttattaatcagggattctgcaggatgctaaaactattttaaaagagaatacaaaagatggcagtgtagatagtcaatgaaagaaaaattactgaaataagattaaaaactttaactgtaaaactagttaatgtgctacaagacaataaaacagtaacctttggggttaccttttctaacagacagaaattgattgcattgctaccagataaaattgtcatacaacctatcagccttctacagattagcatctgactttacagaatctgggctcttgatcaacactaaataagttaaaaatatatctctccaggacagaatcaaacaactccttggaaggcttgttagacaatgctctagaataactctgaaagggaaatgtgcttttttcacatttcaggtaactttttaaaacatggagtatgaccaaagaggtgcttacaagccgcctcctggcacagagcatcttcatctcccgcctccccaggacacgcatctcattccagtaggcatcaatactcctcacgggagatactttgtggttagaaaataagatcgaggcagtgctttcagagagcacccgtgaagatgcacgtggtttacctagaaaagaaatgagaggaatgaaagccttatctgtttctcttctttccacatgttgacatgggtttctttagctggttggctaccatcatagatgccagacagctcaactcttggagatgagatgcaagatggttaaataacaatgagaacctggattcacagaaaggacaagttttaggtgttttgagagcccccagttaatttgggattccagtaccagagtgacagggtggctagcagccctgccctaataggaaatgaggtagagctggacatagtatttatagtgtgcctttgatgggatgttttttttacttagtggagagcgcaacgcctatttgtcctgccccagatcaaagggtccctcacatgggaaccttgtttatactggcagatgcccttgtggctcttgtctgagctgggaccagttcatgcttgcctgaccatcattctggtgctaggagccccttcttttgttcctctccacaaggcattccatggtgggtggggggaattctagcctggggcagtccctggttctccaggtggaaagcgcaaattcagtcccccaccacaatggaaaacaggttcaaagactttcacttacagatctggacagggagggtgcaatgaatctggagggcagtgctccatccttgggtcatgcaaggcagaagtgaagagtcaggcagggagagagaagaaagctctgcaactagcatcacagataaaggagtagggtgtgggtcattcaaattagagggcaaatggccaaatgctctctttaaaggaaggatgggaaaatggggagctccatctgccaggtgggagagatgcctccgagttcttgagccatttgggtgctgtgttgaagtggaaactgtcaaggtgaccgagacctgtttcttgtacgagaaagtgaaatggcagaaatagatgtcaaggcaaaataattatcagaattcacaaggataggagcagaaaccacagatatgagcaggtcccatgagagtcttccacatgggcacctgggatccataggtaatgggagcctgtggcctaaggcaggcagattgagggaagtccctgagggccaaaaagtgagagagacagaattcattcttgtatcatccactcaatctttattgaccaattactgtgttttgggcattgggctactaagatgaataaaaatcagtctctgtcttcaaggacagtttagtcaaggcatttaaacctgggcttcatgagggaacatcaggagggttcctaaaattataagcataactttgcatttatgttaatttttctggggagagaatctgtaacttttgttagaatcctagaatttttgttatctgcaaacagaatctaatgagagttcaagcagaaataaaattttaagaagagggctcaaactgataaaatacgcatcgttagcaccagaggccagcaaagtgggcacatgaatctctgtggagtaggagtcgtgccgatttaagaagctctctcatggagagtccagtgagcctcctggtgttgagcacgtcgttgagaaccctggcgacctggctgagcaatcatcacagtctccctgctccttcttcctgaaaaagtgtttctccctcctctctgctttcccaaggccccattcatcctgcagggccccaatcctccatggggctttcctagaattctccagccctcagagaccccttttctctgaacttccatggcccctaacctgcctgcccttattaatatttcatgtctttcttctcagtacatttcaagcaattttagagcatggaatggaatggagggtgctgctcctttatgtctcaaagcatttggctcagtgctattcagcattgctattcaatggtattgtgattttattttttattttttggctctctggccccctgtgtaggagaagggagtctcttcctgggctcctactgacaggaacagaaaatagagaaagacatggacacaaaccaaagggagtaaagtggtaacgactagaaattcaccgttgtgattacagccgccattttactccatttctaacttgaaacatttcctttgcaaattgtttggcatggaaacacttcaaggctgcttgagggaggtggaaaaggagatacactaaagaaaaatgtagtttaaagaggcagaaactataaaaaggaatacaaacggaggattccagagtaaagcaagaggctgtgcaaataaagacgaggagaaacttctccagacaacacgggctcatcgttgtccatgcattgcccacaactatgtttgcacaaatatatcagggatatcaggaatgctataatgatactccatcacccatggttctcgttttaaccactgtaataagcaaaacatacagagcacactgctggccctaaagactataattttctctgaggagaaatattgcaaaaagggaaaaaaagagagagagagaagaaaacatgatattttgttcagtttctaaaaaaagcatttttcccctttctctgctgcgctttcctttcattaaactgtccttaagtgcttttagagaaaactaagtaggccacaattctgggctgctgactgaacaattataagtctgggagcctgctgggatggccagagagaggcccaggtccctctcctgaaatccagagacccttgggggttgtgccagttgcggctggactcctcacgttgaaatgatttctcattttgaaggaaaatcagggacattcttatccctattagtcctctgagaacttgggccactgccagattttattggaaaattgcaacaaaagaaattagagatagtgagttcttatatttgaagggttacactagaggcatatcgaagccagattatttccagatcagctctgcttcatgagttaaaatatattctctgcttttaaaatagtcacagttccttagattcagattcttactgttgactattgttagtttctccctctctgtctctctctgtgtgtgtgtatgtctataagaagttgttgtaagtttactgtagggaaagttaaacaatagaaagatgagtgagcacactaccactaaagttcaatgcaactggacatgcgtctgtttactagggcccaggagatggctgggcacatgaagggacaccagagacaccccagaggtcaggacacagaacctgctggaggataagacagattatatatactcaggcataaaataatcattgcaaaaggcctgacaacaagtatgtttgatgtttgagtcctgccatgatgtgaatgtctgatttccagggacagcccagcatggagaaagaatccaggcttgggagcaagacatacctggtgttgtgttctagctttattccttttggttgtgagctgggcaaattatgtaccctcgtttggtttttgagatgaatgaaatgtagcataggatctccaagttgcttcttattctaaaattcagcatttcctccttttctaacttttctgcaaatctggtagtctttgtccaggttataagtatagcctcaaggtggcaggggtgacgtgaagtaggtatgtaccctttctctgtccaaaccttccctctcttcccagtactcatatatcatcacattccaccctggcaattcttaatgtagtgtcctcatgttctgaaagaaaaactgtttttggtggtggtggggtaaatgttagaaatgtgaagaatgccactttgggaggctgaggcgggcggatcacgaagtcaggagttcgagaccagcctgaccaacatggtgaaaccccgtctcttcccaaaatacaaaaattagctgggcatggtggtgagcgcctgtaatcccagctactcaggaggctgaggcaggagaatggcctcgaacccaggaggcagagcttgcagtgagccgagatcacgccactgcactccagcgtaggcgacagaaaacaaacaaacaaacaaacaacagaaaaaaatgtgaaagaacacaaaccataattacatgtaaactcaacatagtgaattgggacatgtgttacatatgtctttgttctctggcagtgtaaagatcacaaatactaaaacagggatagaaactaaaagataaaggaaaatcatgggcacaatcttatacccacctctaagttaaagttaccctacacaggtaaagactaggtcttcctttctagtgcagtgttgggcacatagcttgggctaataattcttgttgattattggccaaaatcagcacttttgatctgatggaaccaaactccctcaggtacagccataagggaaaatacaggggacaggtgatggggtgcctattttcagggggtctttgagtggagttgcaattcctggagggactggaaggaggagaagtggttacctctggcccatacattcctagagactcaactggcccagccccacatgttagctgaggcttctcattctaaagttttgcccctttagttcccagaataatcgatatggctgcttttgcatgtttttctattatcatttaatggtaaaacaccaagtttcttatgatgaatttaagtggctagcataaagcattctaggcacaagaatgaaagctacttataccgtgttgatgatggacactttgaagaagagtgtactaatcatgtgaaaactgtttatcagatggagtcctgggtacttttttcttctaagggggtgacagggtagatttgtttctgggggtgtggttttgactagaatgtttgagcaacgaaaaaactgtagtgttaataaggaaatgtaggtgcttcaaatatagcaacaattaggtaggtcagtgcaaacattctctcctctcttcttccagcgtgtgtttttggagaagataaagcggttggctatgcttaggagcctcagctaaagacactccctcccatctccctagcccaggggaagcctggcgtcctgtccctgggctagggctggcgccgggaggcaaacgtcatgccttctctcaagtagatggtctgctcatctctgaatctcagtctctcccacaccaatgaattcagtgaacatgttagaattcccgtaaggagcagccccttcagccttgttatcaagtgctgtttccaaacttctgggcccctcccttcttgctctctttccaagaagcagttttcacttgaggatcccactttataaatgttaggctggcttctctcattgttccttcatggagagatccatgaaaggaggattagggccatattttatcttccttggcagggttcatgtgtgaactgtagaatgattctcccagtgtattacaaggcaggcatggagttatcgtgcttttggtccctcaagaagttgcgcaggagtaagtacagtgcccacacactttgcacagagtagacagtcaagaaatatttgttagatatataaaagcaattcatgaccctatttttgttacttcattttgcattaacaatgtttggaggtgatgaatgttggttaaaagattccatgttttatcaaacacctttcttcgccaactttttattggctgaaacttgagtccaccaacttgagacaggacagttgttgaagaatgtccctttttcctatgccctcccagcatcctctaccatgcctcctccctcctcacagggggcgtcccttctgtagctctccaagggcgggacagtattgcccccaccagcctgccaccatgactgagtttgtgcttccatttatacctgttctgtgactagcagccaaatcttgctaaaatgtaatatatcatttgagttctctctcctgggataatacagttgcatttaatagtagcctttaggagatcctgtgctttagtttccagaagtagttcacagtaaggattttgggcatagaaatttaacagcaacagtaatttacctctcctttaggactaaaagcatcttgggggcagtccccttttttacttatcttgtatccctggaaatactcactctggtcagttattaataacatttcatgaataaatattgagatgactagctaatgtaataaaataatttgagagatgatatacatgaattaatataaccctgcccatgtgacacatttgcatctttgacagttcttttcaatggcttcaatcccttcggttgagagagaaatttttcaatggcgaggactctgtgggaagttcagtatgggggttttttcaatatgggggttatagtagcagtctctaagaaggttctcaatgatacccatgtcctgatattcatgactttgggtaatcccttttccttgagtaatttgcttctaatcaataaaacacagcagtattgattaggttacaacagattgtcacttccttcctgctaattcacttctgtgctggctttgatgaggcaaattgccatgttagaagggtccatatggcaaggattggagagcagttttcagctaacagccaacaaggaactaaggtcttcaatctgaccacttataaaaaatggaatgctgctaacaaccttgtgagcttggaagcagatactttcctggtcaaacctttagataagccctcacccctagcaagagcacagccttatgagatcttggagcagaggatccagctgaacttcccacagagtcctcgccattgaagctgtgagataattgtattgtttgaagctgctaagtttgtggtgatttattacacaatagaagactaataacaagatctcttatctcatttgtcatccaagttgcccaggcttcccaaatgacattttaaatagaattagctctggggaaaatgaccaaaattgagtcgaatgataggctgggtcttgagagagtggcacatttccatcttgtctcattcctcaacatgatccttcaaggaaattcatagcattggccaaactgcccagtctctagaatcctaaagaactctgatggtgactgagctactgccaagagaaccctttaccctgtgccccctgtctaagcctactttcatgtctccacagaggtctgctttggtccttagagatgtccttctccctgtcctagggattctctacatgagccttatgtctgaaggaaatggcaacagtgggtaccccaccaccagctccagcagtgggtaccgatctttgcttcaccaatcatctgagaagtttgttcaaatatcagatttgagccttaccacttaattcagaggatctaaaataaggaccatgaaagatcatttttaataagttgccaggggttgctgatggtggtagtgaagtcccaggctttcacacaccctggtccagaggttttcccaagagcaccaagtgtctatatttcaatgatccgcaaacaggatgtcattgcatgcttatgacattggaaaagtcagaaaaattaacctctgtagacctcaattgtataagtgccataaaaattgagtaatcttgatattctcttttagtcctggaagctaaatagggaaagggatagtttaccagtaaaaagagaattcacagacagtcgtcagacaccactcaaaagttattttatattaacccctttggcccttacaacaatcctatgaggtgggtgccatagttaattctgctttacaaatgaggaaacagaggccccgaaagaccaagtgactttttcaaggtcacacatgtagtaatatacacaggactcaaataccagcagggtggctctagagtccatgcttttagctacagtgctagaccatctctacttcaaactatgagtgttcctgagtttataaaaagtggtatcagtgtggactgcacttatctgggaagacgagttgtgattgagctttattgtggagtagaattgtcattggcaaaaggcataaagagaaagatactataaacagagggaataccaaaaggaggacatggaagggagcctgagtgtgacacatgggtcaagtgatgaggagactggctggccagagtgtggtccatctggtgagcagtggagggtggggctgcagaggggagtgggctatgaggtggcagaggagtgggggcttgaatgccatgtagaggaattgttgactatccaatagccttttccccttcctccttgctaagaagaactccaatattcttcttgtctcatggttgttcaagttcaattagaggcactctcttcccttttgccagtgattggcctagggatgagtatgtgactcaattcagccagtgagatataagtagagccctgctagaggcctccaaaacagatttttgtccataataaaaaaagagaaattgtcatgtcttgaatgtttgactccaaaactcatgttgaaatttaattgccattataacagtattaagaggtaggacctgtaaaaggtgattaggccatgatgtctccatcctcatgggtgagatttggtttgttataaaaggcaagtttagccccctcctttttttctctctctctcaccctcttgcctttcgctgtgagataatgcatcaagaaggccctgcaagatgttggccccttgatcttggacttgccagtttacagaattataagaaattaatttctactcattgtaaagcacccattcacaggtattctgttatagcaacaaaaatggactaagacagagatgcctgaggtaaagcacttctgacccctgccttccttcttgggatgctgtggtgtgaagacatgatgtgtaggcctttgacagccattttgtagccatgaggggaaggtcagagaatcatggaaatgctaactcaaatacctgaattcatagagctacttatccaatcctagaaccacctccttctattcttgtttttgtttgtttgttttgttttgttgtttgtttgtttgttttgagatgggatctcgctgtgttgcccaggctggagtgtagtggcatgatcttggctcactgcaacctctgcctcctgagttcaagagattctcctgcctcagcctccttagtagctaggactacaggtgtgtgccaccacacctggctaatttttgtatttttggtagagatggggtttcaccatattggctaggatggtctagatctcttgaccttgtgatccgcccaccttggcctcccaaagtgctgagattacaggtgtgggccaccgagctcagcctgttcttgtttttatgtaaaataatgtaatgcctttatcacctgggccactggcagttgagcattctgttgcatgcagccacacacatcctaactaatagagagtatcttaggaagccaggatctttagtgaaatagtaataataagagttatcaacaggattgtacttccacacatattatttcatctagttagaaatgaaaaagcaccagctttggggttagagagcatgggtgtgagtcccagccctgatctggaagaaatcatcctcttgcaccttagtttcttcatctgtaaaatgcaaaataatatctcccccttcaagttgtgagaaccagtgaaataatattttatggcgtccagctcagcatccagcactaactacgtctagaagataagatacattgacaatgataataatagcaaatgattatgagttattactgaacaccagcctctgtatcaaggactttatgcatattgttttatttaatcctcttggaaatgggtattattaaaaacttcatttgaatttactgttcttaatcaccagagcccctttgaggaggaggcagggcagtgcaatgatagcaagtctcattctgtaattgagaaggtggtgcagtgagtggaagtggttctgatggcagaaccagggtgtagctggggtcgcctcaatctaaatcccaattcagagccatgacatgttggtgacttgtctcagaatcttggtggctcagtatcaagggtgaccatttggttttcactggctttgcttgttaataaacatggtagcatctgtgatagttactaacaatatctatcaccaaatatactaaaggaggggaaatttaatgctttgcatgtcccaggagagatttgtggcttctacctgatgtgcccagagcatctgtccaaaggtcatgatggacccaatttaattaggttgttagccagctccccaggggtggtaacaagaggccttgttaggcgaagtttcccctcactgaggagttctttgcagggtgatggaccaaattgttggcagtgggaggtctgaagaaagatgtggggctcttcttatgtggaaaaaaatcctttgagcaggtacgtgttcctttcaacttccctgtggagaccacccacatgtttgtgtgcactggaatggggaggggaagcggccatgtgtttctatttaggtgtgggttgctcatttgtgtaagtgtcactgcctacgttgtttcagcccatgtggcctgtggattctgaatggtggctctgactcctttggtctgtttttgatcttgcaagttgaaaaagaatcatgtaagttagagaaggaccgagtcattaatggaccttcctttgtgtccagagggtcgagtgagtttctcaaattcacacagctggtttggtggcagagccagaaccagaacctggagcagaagcacaccaaagtagaaagagctaggggtgccaaagagtgcccaggcctggattctgatttctttagaaaagagagggtcagagttgtaacactccaaatgacaacaatcatctgggataggtctctctccctctctctatccatccgtccattttccattcatctgacatttctctttatacaaatgttttcatacatgtaaacagataaacatatacacattaagatacacgcaatacatgctatatatttcagccattcgtcatctatgtgcatatgtccatatgtatacacatatatgcatagattatatttagaatataaatacaggtacttcacacatactatcaccctattcattcacacatatatttcatatatttattcatccatctatctatctatttgttttcttaacgctaataagtttttaatgggtgaaggggaccctaaaagtagtttctaaggatgcttgtatgactggtatccctccaagatgtctcaagattaggataggtccttatttggaaagtgattgtctgtgtggtccagtctgagggggttgtttcctgccttgccatattcacgtatgtgatgttggagaaaagaagatcagctggatgagctgatttgtgatgggactaacaatagttacaatttattgactgcttactaggtttaggagtatacatagcattattattcgcattatcttgattggtcttcatttcagcctacaaaccacatgctactgttatatatccattgcacagatgtttgtggcccaaagtcacacagccagtaggggacagagttggtttttccctcatggtgctcagagctagcctgatgtttgaacagattccaagtgttcccaggctgtcctgaagcctgcttcttcccttcaggtacgggctgtccatggtgggaatgctgctgtgctagacctgaaggtcctggagctatatggcaggcatccctgttaccatcagaactcatgttttgcccatgcccttttccccacactcaggaagttccatgcaaaggtaaagtgtgtactgacagcagtggcatgatttgaaagctgctggatggcccccagtcttgagtcccttccctggagtcttgttgatagctaaaatttgaagcatggctttcgctttcagtttcctttgattgcagaccttccttacggagaaggtgcacccgaaaattcttgaggattcaacttttctaatttgtatctgaagctttcccagctcccagactggaagactaacaatatgagaacatttggatctcaggggtgagggacaaactgaactgaggggggaaagagggataaacagagaagctgaggggctaaagttggacttcaaccacagtctcattgggccacatcagctccacatgaatctgaactccaagacgctcagcttccaatctggctagggccaaggcagagctctcagccatcaacacccagggagaagtcgcgtgaagagcaagggacctgctgtgtggtgggtgtttgcagagggcaccagggaggctgcctgtgggtggcacaagaaagagcctggctctggtatttccattcctgcctgatgaggccgaatgagctggtcttcccagggaaattgcagcacagctcatttgtgcatgttttacaatggtgttgataaaatccccatggagccccagagcatgtgtgaggagttcccaccagaaatctaaacaacgccctggcgttgctgacagcttaataatgtgacaaagttcagcttgttcaatgacagggacaggaatgcagctgggctggtctgacccagagctttgaaaatatcccccctttactctgacccagcatttgacaaataaccttttcttagcctccttgaaggcaccagacagaaccaagtgccatgcaggggccatatgccaccgttaaaatgttaaatggagtggcgagggccaccagagtcacttggggctgacatttatctttattattattattaataataatgcatatattgcttttttggtgcattccagagtttttttgcactcctaaatcatgtggctgtacatcacccagcccgataaatcacccaatgaacccaaattcaatgcagctgtcaggccagatctgagagaggcagagttagtttaattgaactgcagcagggaaccgacgggcgttgcccagaaaatcagaataatagcagtgttgccggtgacatttcaagagctagacatgaactgctagcttcagctttaattttactagagggaatggggggacgggtgcagggagaaatccagacttcaacaaatatttaaactcttaggtttttttttctgcctcaaagccagtacagacaatgagttccacatttagaaatttcagtagaaagaatcccatttttttcttctttctctagcttctccccatttcttctgcttgcttcttcctctactccatgccccctttttttcaacaaaaagaaagctgaaagtaaagaaacaacaggatttgagttggagccaatttaatgggccaagaggttacatatggagccaacaaatcatgcaagcatgaaggatattactgatttcaagttatgtatgttaaagcccaaatcttaacagcattcataaaggtaaaggtaactaatggagaggcttaactgacagaaaatgggcttttctccctggctgccctgcctccttcttaaaaattgcagtgcatctcagctgaagaaggccttccggcggcagattctccccgttaggtgatgagtggggagggcctcagccttactagccaagaaaggacaaagctcagctgggttctgtaccaatagaaggctccagacaccattgtttggtttatttttgtttgcattaagtgtgtctcttcatatgttttggggttaccagaaatacctttccctttacccctttaatttttaaaactgtgtgtaattttagggaaatttgatccatgtgtttcagattcatttgcacttaatcatgaaaatctctctggaaagagctattttctctcccagaagactttggtgcccttttaaataagccctgtaagtgtccttccaccccaggctgccctcttcaagtgcagaaggttgtgtttggccaaaggaaaaccaacctgaccaccaagggcatgggtctggtttgaaatgtcgaactcgtgaacttggactgtattctggaaatggggaaatgacttccccttagccccagtgtttacatagtcagagaaagaagacttcctttaaaaaaaaaaaaaagtgatgtgaatcaactctagagcattatagttccttccaacaagccaggcagggctcattggaaatgccccatggccatccacaggtgagtgttagcctcacaggatcaaaatgcacacttgcgacttttctttgaagttcctggagaaaatgcttttaccagagactcccaattaccaaaaacaccctggaaccatcttggatggctcccaagggccatggaatgactgtgtccaggatacacatctccccacccttcatccacagcaacccaatcactgcatagaagccacaatagcattccttcaatccaaaacaaacatgtcattaccaatctcagattaattgatgtcatttgtgtgccctgcctgttgggtttcagctggaggctgcccaatggcaatggccaccacccttgaaaacctcaaggcactcacaactgtggcccttggcagaacttccttagctgttcttctttaaccctgtgactccaagcctttcctccttcccactcttttcccactctgaggctttggacaattttgaaatgagttcccagtggaatgagaagatctgtggaactgagttttgctttgagtacatttctttactgtaactcattaatagtaagatacgcatgtgtttttgttttatcacccttaaaattagaatgctccttataattgatgataagaaatactgtggtgaggtgatggaaaacattttcctctttagtgatacaaaaattaatggtatatctgttctagtctctgaagagatgtgattactttccaaaataatgtggtaaatgtttaactccctcattcattcatgtactgttcattcttcagtcagagtatatcattgaccacatgcctgactatgcacagtgagaagactagaagagtattgaaaagacccctcccttttagaaagttataatttagctctagacataagtgcatacatgaccaaccatgcaaagtgctaaattagtggtgtggccagaaagtggtggagcagatcaagatggagccacagagtgggatggagattccgagctggtgggcaggcggccccattaccagcttggctctgggattcaagaaagtaaattcttacctgtagaacaaagggcttgtttcagatcagtgtcttacaacatattccacaggaacgagttccacagtgggggtggggtggagcattgagaaacattacctgccatttgccttttatcagagattcccaccacttgttagcatacaatgggttctgaggtgaagggcttgtttaaattttatttaatttagtgtttcccaaatatatttattcctggaatccttcattttactcactagccattccgataataaaccttaggaaaactctaaagtcttttccaactctaacattctaggaattcgttagacaaggtggaagtagagcatgggaggatgaaaggctaagagaagggcttgagctgtgctcacagagtgatgggctcctggcatggggaggcagtgtcatcactgaggagaaaggctttatctattgttcaatcaaggcacatttactaagaacctatagtgtactgtgctggttgctgggccctcagaaaaaagcaaaacactgcccctgacctcaagtggcttctaattatggagaagaccagggtgtaaacaaatagccacagtaaagtgtgtacctggcctgtcacacaggtagaaacacagtgccacaaggggactaaacatgcctggaggaaatccatggaggcttcttgtaggaagaaccatcagaactttgaagcaggggtataaatatatatgtgcctgaaacagaagcagaaggagagcattctaggcagtgagaggagcatgaataaagataaagaagcatgagactgttgaagtagcttgtagtggctggcaggcaagatatattgtgatgaagagaggaaactgaggctgacgagtcaggttgggaccagaccatgaagggtttatttcagcaagtaacaacaataataagagatttaattatcttccataataaggagtctggaggtacataatgagagggtctgggactggttcagaagctcagtgatgcctccaggggcctgggctccttccatccctctacttggctactcttcaacatgttggcttcccatcctctgtttgctgcctcacactgagaaggcagccatagaactgggcatacttctcatggatggtatgccttatccttaagcataggcatctaaaagtgtcccacaggtaggagaaaccagccttgtttacaggtgtttttataagatgattggcaggaatgtagacacaagagtgggagaggagaaaccagatgcaggagacagtttggagttattgaaattgtctagggaaaaagtactgcatgctgacaccagcatccctagcaggacttggaagaagggggcagcggaatatgtactttccgctgatcaggaaagacaattctcctgggcagcccccgcagcctcacctctctcattggctggaactgggtcacatggccaccctagtgcaaggaaggctgcgaaatggagtctgtggcaaaggagaatgcagcagtagccatgagaccctcagaattcagtcatggaagctgggctgtgtcctgagtgagaaattaatctatttggtgaagcactgagattgggcagttactggtcatggcaggtagactactttttctattacgtgtggataccgatgcccaataactgaggaagaccatgtggcctcccatgtggggaactggattaaaggctaaacaatgacaacaaaattttggggagagaggggatattgggggtctggtacccccaactccttcatctgtccggaggttaataatgatttgtaactgaacaaaatgtggtaaactgtcaagagtacataacacttgctgtatgcttcaggaaataggttttttaaaaaatcacaactttttcatcaagggccaaaaaaaaaaagacaattcagttgagagatctaattgagagactccccaccctaccaccgcccactacctaatccaaaaattaccctcctgcaattgactgaatgtttatgtgccccaaactcatatgttgaaatccaaagtccaatgtgatggtattaggaagtggggcctttgagaggaggagctctcctgaatgagattaggaccctttcaaaagcgatctcacagagctctctcgccctgtttctaccatgtgtggatacaatgagaagtcagccttccactacctggaagaggttatcaccggaacccagccatactggcaccctcatcttgaacttccagcttccagaactgtgagaaataaatttctattgtttataagctgcccagtcgatggtaccttattatagcagcccatactaaatacctcccctaaatattttagtcatgttatgcccataatgtcaacagaagatcgttattaaaaatatttttaaaaaataggtcaaattgaaagagtgggcggttatcagccacctcccctgaatagtgaaaatgtgtggacaatgctttcccattgcggatacaaatctgacagagaaaagatggaaagatgaggaacgtcaattctccggacatcttctgaatctcatttcggtgaaaaggaaaggctgattgatgaaacaaagtcgtagagaccttgggagaaagtggccctctcattctggagctcccaaatgctaagggaacactgggctttttaggatgtctgcagtagactttaggaacatatatattcaagaagttcagagaaacagtaaatgtgattccacagcaggaagcttcaaatgtggagatggcctaagaaggatgggagaccctccaagtcctgagagccgaatcaaaatatgagctccccatccagagaaactgatactgcacaggaacttctgtagcaaatttccatggatgaaagcagaaagtaactgaaaatggatactaaagggtgggaccaattggctagagcagtaactgaaagatgaaaccccaaatgagctcaacctttcctcattctaaggttaccagaaggaggaggcttctaccaataagaaggaggcttatttgggtcacttcagaatacgtcatgaaatgggttggtcggtggtcccagggcaggtggtagaagataccacgtggtgcgaaggagcagaaatcttgaaaaactccccagggtgcagccccagtcctgacactggcccaggctttgcctcagcatctggatcggtagccaaaggtgaagcacagaggaagaagcctgcctaatcctccaccgtcgggtgtgctcaccctgagcagccccaccctgcacaagtgcggcaggtctcatccgcctaagtcacacctgtgcatacccctttcatcagccctccttcaagtggcaatttaaacattttaaggccacctgttgagcacccatttggtaaatttccttttatcaccagctcacggggagtaagtgggtaatgtaattatggggcaggagaatggggcgtttgatttatgctttttgaggattagccaagtgccccaatgccaaatccgtgatcacctgaaaggaaatctgaaggaagaaactgccaaataagtaagtcctccaggtggtcttcagacaaatggttttgaaaatgggtatcttctgcctttagtctctggagagctcaaaggcttctggggtggacaaagctgatgtgtttgcctccttgtgtgatgagcccaaggagcaaaggaaaacgttttccaaatgcctgtagccagggcaacacaggattgggaagtgctgggaatgtggaggattgtgtgcaaaacaatgatagggagctaggcttctgatctcctgatcattcctgggatgctacctgtgtccactcagtgcataggatctggaatgtttctagatgatgccagagagggggcatggaccagtcacctggtctcaggctgcagggcacagaatgctaaaatcccacctttgacgcagcagacagtctctctgatgatacttggatgacattccattttgtctgggaatatgtggcaacaggtcagggaaggggcacatgctagacatttttagaaatgaacaaatgcatggtatatcagtttcctgtggctactgtaacaagtaccacaatctgagtggcttgggaaaaccaatttattccatttattctcttgcagttttataggctagaagtccaaaatcaaggtgttggtggggttacacttttctagtgcctctaggggagaatccttgtctcttcccccttctgctagccccaggttttccttggcttgtggcagcacttcaatttctacctctgtcttcacacggctgtcttccctctgtgtctacatccaaatttttatcctcttgtaaagacaccagtcatactggattaaggtgagccctaagcccatatgagacctcattttaacctaatgacatctgcaaaaaccctgtttccatatacaggttctgagctttatatctcaagcatagtttttggggggacacaattcaacctataaggtggatatatgaaaaaacagagtcaccatccctgatttgtcacatgaatacttggaaggtgatggaagttttgatctattgtcatctcagcttagggttcaccctctaaaacagacaatggctttttaattttttgctctaattctaaaaagagataatctggtatgatgtaacataacgcgtaatacactcacatgtaataaaatcataacgcaactatagaagagggctgtaagcctaaggacagggaagcctctgggtacctaattgtcacaagaagggctcttagaagagagagagaaaaaaaggaggaagaaaaatcaatgaatgttaatggactaaattttcaaacatctggcaattctaggatggcttgttgaagagacagaatagttaaaagaaaaatgaacaaagcagcttcagaatatagtgtatgaccctaaaatttctggaaggtccaagtaatgggagaatgttgggtgttaacagaagcagcagtccacagaagacgactgaagtgagagcagcttcacagcctgccccttccctggggtgggggggatttcctgtgaggcttgaagcacaaagcagtgtgtatttaaatttcacacatgagccaaatgagtggggtactataaaccaaggctgcccaggaattctccatagccataggtcatctttttacctaatgttggatctatgtgggatgtggggcattttctattaattacatttcttaatttacttctgtaaaaagaatctggtaactattatttctagtgttcctagagtttcagggaaagagagataatgctagcaatggtcaattaaccacctggggaaaaaattcatgaaaatttatgcttacagttatgctataagctaggtaaggaactatgggatgagtttggaagagaagcacatggccagttataattttgcttcaaaagcctaaagatgccttaaacagcctgtttttgaaaatgatccctcgtgaatttatctaagtctatcataaacatattttgatacatattacataattttcaaagtagttatgtagtactgtagcatatttacatgactcaaataataaaaacatgtaaaaaggtatacagagaacttcccactttgttccctttctgtaagttcccatccttcccagcaaggaatgttattattaggtctttgtttttacttctgatgaattattatatatttgctagccaacacagatatataattctgtgttcccttaattttttataagtggtagcatgacatctatttatatgagtataaaatgaggtatgtacatatttattcattgcagcattttttgtagtagcaaaaatttgaaaatggctttagtgtccatcagagggagactaatcaagttgaggaatatctacactatggagtagtatgcagttgtaaaaaggaatgggaggtgatccctatatacctataatgaaagatccgtcagtctgttagggctgctataacaaaatgtcatcagctgggaggcttatgaacaacagaaatttatttttcacagttctggaggtaggaaagtccaaggtgaaggtgctagcagatttgatgtctaggggcagagggaaattatttctggttgcagacagctgttatctccttgtatcctcacatggtggagggcagagagaatacttctttcatgtctttttttataagggcattaatcctattcctgagagctctaccctcatgactgaatcgtcttctaaaggcaccacctcctaataccaccacactggggattaggtttcagcatataaattttggggggaacacattcagtccatagccagatctccagaatacattaagtggaaaatgtaagatatagaacaatgtatacactatgtgctttcgggtaagaaggtggggcagtaagggtatatatttgcattttcttgcatctgaatacagaacaatctggaaaaagtacaagaaacaaataaagtcttaatttagatagggtgaaggaagtatgatgatcagggacaaggaagagtgtgacaatttccaatgtttactgtgttctagcatcttttgagtcatgcaaatacatttcctatttaaaataaaaaataaaaataatagttaattaaatgtacatccctgggatctgataatcacacctccaggaacctagcctaaaaatattttcttacacatgttcaaagacatctgcaaggatgtttgctgcagcattatttcaacagcaaaagactagaaatgacttaaatatctattaaaagtagaccagttaagtgagttaggttgcattcatagaatgaaacactatatagatgttacaaagaatgtgaaacatatattaatatggaaagctctccaagacacattaaagtgaaaaaatgcaaaaaacattgtgcttttttgagaaatgtccattcaagttctttgcccatttttaataagagtagtttcttgttactgagtagtttgagttcctttgtgtattttggatattagtcctttatccaatgtataatttgcaaatattttctcctaatctgtggtttgtgtcttcattttattgtttcatttgctgtgcagaagctttttattttgttgcaactccatttgtctattttcgctttcatttctcaaaagaagacataccaatggccaacagatatatgaaaaaaatgctcaacatctataattatcagaaaaaaatgaaaattcaaatcacaatgagatatcacatcagacctattagattggctattaacaaaaagatgaaagataacaaagatgagaatgtggagcaaagggaactcttatacactgttggtggtattgtaaatgagcacagccatttttggaaacagtatagtggttcctccaaaaactaaaaatagaatgactatatgatccagtaatcccactactgtgtatatacccaaaggaattgtaatcagtgtgctgaagagatgtctgcactcccatgttcattgcagcattcacaatagccaagatatggaaacaacctaagtgacccgaatcgacaaacgaatggatttaaaagatgtagtatataatcacaatggaatgccattcagccttaaaaaaacaaaacaaaacaggaaatggtgtcatttgtgacaacatggattagcctagaggacattatgttaagtgaaataagccaggcacagagggacaaataccacttaggtctcacttttatgtggaatcttaacaactcagaagtatagagtagaatggtggttaccagaggctgggggaatgaggaatgggtggacagggaagggggagacattgatcaacaggttcacggttacagataaatagaaggaataagtgttggcaatctattgcacagcacaacgattatagttaataataatgtatatttcaaaatagctgaaaaaagaggattttaagcattttcaccacaaatcaatgattaatatttgaggtgatggatatgcaagttagcctgatttgatcattccacaatttacacatgtatcaaaacataacattgcattccataaatacatataattactatttgtcaattaaaaataaaataagacaaaaaaagaaattaccaaaaagaacatacaaaacacattctgcttctattttttataaaataaataagatgtatgcatatactcccaccaacataccctgtattcttattttaaaagaatgtgtggaccgggcgcagtggctcaccccggtaattccaacactttgggaggccaaggtgggtggatcatgaggtcaagagatcaagaccatccaggccaacatggtgaaaccctgtctctactaaaaatacaaaaattagccgggcatggtggcacatgcctgtagtccctgctacttgggaggctgaggcaggggaatcgtttgaacccgggaggcagaggttcagtgaggcgagatcatgccactgcactccagcctggtgacagagcaagatttcatttcaaaaaaaaaaaaaaagaatgtgtatgtgccatatgatgcatgtgtaagtgtgtatatgtgcatggaaaatttctgggagcaaataaattgttaacagtggtgagctctgggaaggggatgagaatgtttagggtaggagagttgccttctttttattgcaatgacttttgaattgcatgacttttcttttactgtgtatgtgttttcctttttgaattaaaaaatataaataaataaatgtacaactgtacgatgaagattatacacgtgtaaaacaaacaactgagaaaactatatgtacttatacagaagtgtctccaagatacattgtgaagcaatttttatttttaattttagctactacagggtttcccatactgtgtgctacctgctttacattctatctggagatcaactcacaacatttttcatgactttatgtttgatcatatcacatctctgccttcctgaccgaggaagactattgtttgttgcagtctgttttcctcacctgtgagacttgatggcagtctttgggttgaaatcctagctcttattgcttatgaacataagcaactgttgtgggcctcatactatatctgtaaataagaaaatagatatggtacaggaatgttataagaatgtgagataatgtaagcatgtactacttaccatatgaggactgccattaacactacttgtgatatggcagttagaactgcagaaaggagtgaccacaccttggttttgcaccgggagaggtgaagttttttgtgtcatggccaagaatgttctagaggaagcccagcatttgactggctttttgggctcagtagtctcagaccagtatctcaaagaatgagccacaagtgatagttcagaattcatgatcctgtgggtgcagtgcgggctttgttcttgcctgtgtggaggcatttcactgcccctcttaggggagcttatttccatgatgcaaccatgtgttttatctggtggctttactctcaggatgcctcctgttgtcaattgttgccttcagtgcattaggcatatgtttgaatccatatttatgaacaatgtctttcaaaatagtgaattaaaatgtccatgttgtctttcttcatctttacgaggtaaaggaaaaatagttgcctttccatattctttccattttagagctactcagagctctcagtgcagctctaggtcaagtggtcttactgattatcaagttggctttctgccttgatgcatttataggagcttttattattgactttggagctccttgcaaggtactccaaaaaagcattttaaaatagtctccagtgggcagtttacattttaactgctcctttcattatcttcctcaacacccttatacagttcccttttctagaattaaataaccacacgatagcttttgggctccatgtctttttcggatgttgaacttggccctgttgttgtctttattatgttgtggttcagcgagagtctcatgctttttcacattcatcacctttctcctagtttttgttttcatgttgtatggcaacttgataaattaagggccaaatatttagtgccaccctggttttttttttttgttttaagaattcctttgagaatcactgtcaatgtgataagaggcagaatcgtgtgatacataagaatgtgggtgcaagaagaaagactgaagaccaacattttccaaaagtcccatggttccaggtgaatgtaaagtcttcttccaccattaattaatctatgatttaagactgaagatctgcctgtctcttgagtcttatttttgaggccacagtactttgcagaccatttttctagaaatatagactctgatttcaggttctcttgcttcactttcctatatcacacttccacaaatcccagagcagggcctgccagctctctaggtttctcttctctcatccacactcgtcgtccctaatggcagcctgattgatcttatgctgaaggccaagagctcaatgaattgtgagaatttctggtggaatttcttggtagaaaatagctcttcacaggtccaatactaatgtttccaaaactgtaagtcagagagaactccctaccccacaacacatatacatccctttccataatatgttcctagtacccttgagactatattgggggtggtatacactgggtttgacctaaaatggtaatccttatgtggactaaaaaaagaaatttttctttttctagttttcttgttttaattaaagaaagaacctatgttttgccatctacttcaaaatatgccaaaagggagcaacaactgccacaagaaccagttcatactcaactcatcccatggtgtggcagtctcgtggacacgtagctaagttacaggggatgaaactagcacacttgtgtctaagagagagagaaactaaagatagtaaagaaagtggaattgtatccttgggaaagatcttcaacacatggttaaataaagagacaaccatgaggtatatttcacttatcaatttgagtagaattgaaaaataatgcatctcaatactggtgatgatgtgagaaaattagcactcatagtctgctggtgagagagtaagttggaacaatctggaggtaaatttagcaatctatctcaagagccttacaataggtgcgccttttgacttagaaattccacttccagaaatctattctaagggaaaaatagacataatgaagaagctagcttattggtacttcattatagcatcaattgagtaaaaaattagagtgaccttaagggctgaataaagaaaactggttaaatgtattgtaatacacaagaataaagttatagatgaaaaagggcatggaaagatattcatgatgtatgcatgaaaaaaatcccattaacaaactgtatagagtgttggctaatgataattctcaaaaaagacagctagaaaaacttattgaccaagaaaagctaagtttatcagatttatttcaacaaagaagaacatcttcttgacagagtcttagtagcacatcagaagggaaggatatttacagggtcttagggccatttagggccaaatgattataaggtgggtcttgaaaggcagaaaacgggctgggattgggcaaagtttataatgtaaaagctttgaatccatgcgcactgtaaggtgaggtcttggacaattattgtcgagcaagctgtaggtcttgataagtaagcaaatattttctggagaaagtagcaagttgtttttgtctggtcctagtattgtttggcatagaaacagaaaaatatatttggccccagaattgtttatcatggggacaggaaggtacgttaggttcagttctctttttgttaaaaaaaaagtattcatatttatattcctatctcactagaaaaagtctgggaaaataattatttactaattaaaggtggttatctgtgggcagaaggattaccagtataatttattttttatttcttatctgtattttcaaaattttccctaatgaacctatatgcggaaaaaagatgcattcgtttaaaccttatttagtcagataattctaggattatagcacccagaatcaccctcccctcaaagcttctaacctgtttctaaatataacacctaatctaggcacaagtttgtggctaatttggacaactgactaaattattaactcatcaaaaccatgtgataaaatgagcttaggtagcttttcattttttcagccagacagataaatgctgtacacactgttttagaaggattcgttcttcagaagcaccttggaagcatatttaactaacacagacacctatttctctccttagctctctgttttcactctattttcagaattatggtacagtgggtgtcagggactagaaggaaatgaagagtgagatccaaggtgaacccagaagtctgcaatagtgtctcatgatctctccagtcaaccactaataaatacttttgagcatctaatatttgctgcgtcctagacaaggtgaggcacggcacaaaaattgaataacctacgctctatctcttaaaggagcttagtttgtaattggggacagggtggtaacagtgactaacacacaggaaacaattctagacagactgaaaatggtgtgaaaccaagcactgctccacagacggaatagtactgggttttaactggtctctattatggcatttgtattatgcatctcagcggtctagactccaaggcctatatggatttggaaataagagtgtttggggcattgagatattctacttaaaggaggattacattgaaacttgtttttctcatttccacatttttaaattaaaaatcttcccaaattttgagtatgctttactctttgcataaataaatgcagctgaatgaacccaattgcagggcctcagggtcatgtttattgcacgtggatgtagatttcagtgaatctaagtagaaggataggagacctatataatgtaaatcgactccaagtcatactctgaaatttactttaaaagaaaaaattcacatagacgaatacctgatggccatgtattttctggttattggcttctttccattaaagaagagcacagagagaccttccaatagattgaatgttccaattggttgaaatgtcattccacttaaaataaccctttattgccaaaaagtactcttcatcagagattgtataatctcatagacaaggagccttcataactcccttcgggaaactgaggcccagaaaggagccttgctcaagggcacatggtaatttaatgatggacctaagagtcaaattctcgtttctttgttttcagtcctgacttcctacctctccagtctaatactccatgccttttcccacaaggtaaaacttactgggggctctgggtaggttagctactagacataaaaacaaaagaaataaataaaagcagcataggtcacaacaactttgagtgtaatgagatactctcatttacaatgtcacttctctggaagcttctctggaacaggacttagtcttcctcaatactaggcacagtcactgccatcctgtgccccttggtttcttcacagaaccgttaaggaaaccaagacacagagagatgatgtctcccatgctcccagctcttggtcagcctggagagcagatgccctacattcacacagtggaagcctgggacgcctcctgggtgagcagtctaatgatctaactggctattaaaaaaacaaccaccacaaccaacttggctaatataccacttagaatgccttgggccactcgtggggtaaaagaaaatcaccatcaaacaatctgggatgaattacagaacaggaaatccagagttaggaccagtttcagggtttgttgatttagcaactctgtggtcacatcaaggacccaggttctgtctctgtctcttgctgcgttttgcagcatgttgcctttgccctgaggctgctaccctctcagggtccccagaggacggcagcacttccaggcctcatacccacaatcagaagcagtgacctaaggagtcactttcttaacaacaaggggatatttctcagaagttcctgagtaaatctgccttcacaatactgggcggaacttggtcaggagcccactttgaaaccaaccacagccagcaggatggcccagaccatttgtgctttactcttggaactggggatgaaatcaccctcgctccagtcatctgagggtgggagtgtgtgtgtagggtgggggagtagggaggagggaggtggtggactcctgacccaatcagagctctgcctgtggaagatgggagtcgggatggtggggtgaccaccagctgcatctactgcacctgtcctgagaccctagctgcccctcccatcaagatccacccctgggtctgctgtttcatttcttccaaggtaatgaagtgctgttatgactaccctttagcaatgtgaatgctcatagaagtcttcatcagacgtcacattggcttcaggtaaagcttactaaggactctgggaacctgaacccagagtcagtgatgtggtgttgagagtagggatttcagcctaggaacgcaagccactgagagccaacagagagctctgggcacaagaagaatgatattttaaggaattctttaaatcatacctggactgtcactgttgatctacctccatggatgacaatgcagatgggaaatatgagacactgaaagagcatcagtataattttttacctagcccaggtattatgaaagaatgtttatttagtcttgcaaaaaaaaaaaaattggttttaggatggctggttcacaaactttgtgcttttcgttttcttcttcctcttttccatttgcttttgatttttttgttttgttttgctttgtttgagagggagtctcgctctgtcggtgtcactcaggctggagtgcagtggtgcaatctcagctcactgcagcctccacctcccaggttcaagcaattctcctgcctcagcctccaaagtagctgggattacagtcgaatcacttgaggtcaggagttcgaggccagcctggccaacatggtgacacccccatctctactaaaatacaaaaattatccaggcatgctttgatttttaaaaagaatgaacattttcctttataatgggaaaataaattaacctttatgtggaaaaaaaaaaggtacttcatacttgtcatctaaaacagcacaggaaatccccacctcaaataagaagttagatgaccacttttgtaatatttgaaaataaaccaactttatttgaatcagtcaataccaatcaagactggaacacaaattggtaattggttcagattcatgaggaaaacactcagctgtatcttcattaaaaggcattttacatttattaaggcttgaaagcaagtcctgttattcatcaccatagttaaaggtctcgagaaaatcaagtaactatcatttggagtgtctttgtaaaatgaaacacttgttcttttacaaaagctaagcatcttttgttaagctagttaactccccagcttataaaataggacaacgaggtggccaggaaagtaagacaaattcaaacatcagctggataatttatattttaaatatatgtatagtcaatattgtgaaatctctaactctacataaaatacttcagatgactggatccttaaaagtacattttaccaaaaacagattgcttctatagaaacacagaatagcccaaaccttatattgaggcaacgtattttatttatttttggttgcaagaaaggaattggatctatttctttaacgttaaatgaaattatgcacactttggatcatacataattatgaatcgaaagtatcctgacactaagctgggagatgcatactgacaaaggggaagaatgtgtgttgatgaggagggcacatgttgcttgatttgaatgataaagagaaatggatagaagacaatggggctgtgtgcagcaggtcctgttcgcttaagttttcctaacatcagaatcagggtgcttcacatgcacatgtctttctctgatgctttcttaagattctccttaatgtcatttaaaaaaataagaaagtgatcccttgggaatcattgtacttagttttaaccatgagttaacatttcctttttccaaggaggatgacaccagcatcttgattcaccgtgcagttgagatggcccctggccagtgggaattgaggcgagtcacagaagtacttaccaaatactcacctgctgcttctagtttaatttaattttagacacacactctcacagtgatgctaaactctttacaagatagacccgcagcttcctgcctctgcctctctcttagttctatttgtccaggccttgctgatttctgggactctcatatggtcaagatctatttcaggcatgacctatcttatgacagttctaagatgcttggtattgtctgtctgtggagtggccatggggcacagaactgtgaagagcttctgttgtttcatttgataagggcctggaaagtcagcctgggaaaactcgcacttggtgtggcctttttctgataagatcaagacttcactggccccaccagcacaagaagggaatgctgaggacagggccatttcccaagataaaactagtttgggatcgtgtggccaaataagctgatggactctgtttccgacatttcagctcatttgcttagtgctaggtcactctacctctcgtttaaaagaatatagctatgctcacatctgtgactctgaatttatcaagcatttgactttctttatcaggagatgaagaaactgtgctttggatccatcatgattttacttatccagcttactttttacagttattaaaatcttactcaataccttctctctgggccaaactcagaagcaggcattgctgactagacagtgaattcaactcagtcattctgagtttgactcttgcttctgccttcgtctcccactaccctgcttcccccacccccaatagtgctgtgcaagtcaaagaagataaataaatacaaaataaaataagatctcaacacaaatacatcccctttctgtgccaccaaaatgctttctgagcgatttgtattcattcaggaccaatgaaaaggaagcctcctaccctatagctgtatagttgtggggtcccaactgcagaccctcccgtgctccctgagttgttcttgggacacctaaggacctcaccacactgttgctgagacatgatgtgctgcacatatgataagaaggccagacaggctgaagcatctggagaaagatctcttttgaaacaaaaaaaaaaaggaaggtaatattaatattattgttactttaatataccataataaatctagtcataagacaccataactaactcttagtccatagtcacttgcattatatgataatccagtgctgaaatataaagaaatttctgaattaagtacccagaagtgccttccttctgtactcctccctctctttcaaatggctatcattgatcatataacacccccacctccttgtcttaatatatttatctctgtaaaactagctcaaccacagaagggacatctagaaacagcaatattgatttggtttggcctgtttgtttttaaggactttccagttgctgaattctgaacatccaatccgagtccttggaattctgcagacttctctggggtggagtggcctcaccggaggcttggttctgttttctctgtggcaattggctatgattcacagatgtgtttccagaacagcccaactgtgggtctcagggaagtaaactgcctcttaggtcatcctgcctgtgctgtaaattcggggaaggatttctgagtacagcaggatttcacactaattaaaaggccttcgggatcatttcagccctcatcccccaggaggccagtttggggcttttccctacagtaaaaaaggactctttcctcaccagttctccttgttaaacatctccagggcacaatttccagggggacctggaaaggttccttttgaggtggaaatgaatcaactcattccgccttttcaaagctttctcaggcttataaagtgtcctactgagaaagttcctcttcctcaatgggctctaggagacctcctgcttcctctcctctgatttgatcaatgggttactttttttcttcagagatccctggaggcaggtaggtccagggattgcttgggttagaatttgttgatatttctatggaaaggacccgtgctatcctgcccttgctgagaaatgagccaagtccaggggctttccagcacttgggagcctcaccctttaccagcgaacactatagaagggggattgttgaaggtaagggcctgtggcaaatggattttctcaccgggcgttcactgggagaaggagttgatgagtgcatttttcttagtttcctctgcacaggtccccaagctcaggctgggtaagctttttaggagatgaaacttaaggagaatgacaaaagagtgaaatattagcttaaaaatttttccttttttttttcacctggcagttgagtcagattgtaggaaaattaacccagatgggtctacatttttcttcaagttcaaaccacatggtttcctagtcagaaagtctcatggactttcttcctaaggtgttctatgatcagaccacctcctaaatgtggcttttacccattacaggctacagttgaatcaggcaggagcagctgctggagagcacccagccgacagacctgcattccagaagcagcttggagaaactgggaagacatttttgacccattcttgggtttttactgtaaggttagcagttacatgatgccaccagtccaagacttagatcatgagagaaggcctttttaaaagtttaccagggaacatcgaggctcataaagaactcttttgtcttcacccatctctcctcctcccactcccatccactttctcatagctcaaaaaccactcattggtaagcacagtcaaacccaggcctgtaatcacctctgaaacaactactcctaagcaagcaaaccccatggctggtagaccccgtgggtattttggcatcaacactgctcccctcccctcccatcccagtcactgcagtttagaattgcatgccaatttccttttctggcagggcctggacggcatggaagccagggacagcatgggccaggtgcgcagcagcagcagcgcagcattcctggcactgcaacaaactgagaatgtgtctcaagtgactttccagtctggcccttagtgcccaataaccagagtgtcagaagtagtgagactgaagctgtgtttgccagacacccaagtccatagccagctcggtactcctccattcactctctctgtctcccctaatggggtaatagatctctttctaagaaggatgaagatggcgtttgtccttggccttgtaggtatggacggagaggagggtagaaaaggagttggtgttgcatgtttctaaagcatctgagaaggtattttgatattggcagaagaagctagtggcaatcccatatgtgggctctccaacactgactgaccccaaacatgctgagcccagatcaggctggccggccgaaaggtggactgtgtctatcatttctgctagattcctatgtgaggaggccagggatggtgctgaccttcatgaaagatagcaggctggagttcccatgataccagcaagatgaggcttgattataaaaagtgcgcctcaaggcagtgatacagaggagtctatgaagctggagtcttaggggagtggttgagtccttctgcagcggggatggggcaaaatggctgtgctcaggatcggctgaggcgtttggcgacatcagcgtaggccaactcgatctcactgtcagctgcacaggtgttggtgaactcatcacgggcataggcgttcttgaggtaccgccacaggcctgtcatctcagccgggatatcatagttgcggtatttcttggccacaatctaaaacagagatggcaggacagaggtggtgtgaaggcatgaaacaaatcattagaaagtgttagtggccgtcccagtgtgtgtgcactgcaggaaacctccgtgcatcaccacgggccatcagtgatatgtttgaaatgcaaggtggcagtgctgtcttctttttgttttgttttaatttaatttcttaagtaaacataatttgccctttgacctagtgtgtcaaattctaggaattttttctcaggaaataatcatggatggatataaagatttacctacacaattatgatcccagagctattttgaataacaaaaatggtgcacagcgccaaagtccaacaatatatgaatacatacattatcttacacaaataaaatgtcatagtggagggacattaaaaatgatgctgctaagaaaatctagtgatctggaaaactctccaagatagactattacatttaaagttcaagtataatgcatttggagaaacatgtatgatggctagatgtctatatacctatatattaccagtggttatgtctgattgatagaattaccaacaatttttcttttcttctttctcttattcactttgttttacacaggccagtttttcccttctttatttatagaagggaaaaaaaaccatgaaaagcaagttagatattggaatgtatatgtaggtttagactatgacataaaagtaagcaaatactgatttctgttctcgccctggtttgccacagtcaggggggatgtggactggagagttctggagaagtggtatttatgttgagagaaacaagagcaaagtgattaaaagcatgggctctggataccaactgactggatttgcaatcatggctccacttagcagctgtgtgacattgggcaggttacttaacctttctgagctccaatttctttatctctaaaatggatataataataaaacctactttggagtaataaattagttaatacacatcaaatgcttagaggagtgcctggcaaatagtaaatactcaataaacatcaagtattattataattcattgagacctagcttgtacccatttgcatgcattttcttaatggggacagcaggatggtttctttaatgaggtctctctagctgcggcagcttcatggacctgtgacctgtgcagtctcaccttgcactcagaagagccctgctgttgatttaatgctctggggtcaatgtgtggaaattcttaataatttttaaacagggcccccctgttttcactgtgcactagggcctgcacattagctggtcctcctctagcccttccaggctaggctagggtaggggtaacaggagagtagtatcacttctgactcccctccctccctcttttctgtccctttccttccctccctactcccttccttccttccttccttccatccttcctctctctttctctcactctctctctccttctcttccttccttccctcttttttttggggggatacaagggggtacatgtgcaggcttgttacctgggtataacgcatgatgctgaggtttggggtatgattggtcctgtcacctaaataatgagcatagtttttctacacttgccccctccatccctctgccaagtagtccccagtgtctattgttgccatctttatgtccgtgagtacctattgcttagctcctacttataagtgagaacatgtagtttcatgttttctgttcttgcattagtttgcttaggataatggcctccagctgcatccatgttgctaaaaaggacatgactttgtttctttacatggctatgtagtattccatgatgtatatgtaccatgttttgtttattcagtacactgttgatgggcacccaggttgatttcatgtctttgctattgtgaagagagctgtcataaatatatgaatgcatatgaaatttttttggtaaaacagtttattttcctttggatatataaccagtaatgggattgcttggtcaaatgatagttctgcttttagttctttgagaaatctccagagtgactgaactaatttacattcccattaacactgtataagtgttcccttttctccacagactaaccaacatctgttgctttttgactttttcacaatagccatcctgactggtgtgagggaggtgtctccttgtgcttttaatttgcgtttctctggtgactggtgatactgagctttttttttttttttttaatgtttgttggccacttattatgtctttttttgagaagtgtctgttcatgtcttttgcccactttttaatggtattatttgtttttttcttattcaattgtttaagttccttatagattctggatattagacctttgtcagatgcatagtttgcaaatacttcctcccattctgtgggctaactgttcactctgttgatagtttctatgtgcagaagctctttagtataattaagtcccacttgtcaatttttatttttgttgcaattgcttttgtaacttcatcataaattacttcccaaaactgatgtacagaatgtttcctggttttcttctaagattcttacaagttgaggtaaatctttaatccatattgagttactttttgtatatgatgaaaggtaggggtccaatttcattcttctgcatagggatagtcagctattccaaaaccatttattgaataggaagtcatttccccattgcttatttttgtcaattttgtggaagatcagatgaccgtaggtgtgtggctttatttctgggttctcttttctgttccattcatctatgtgtctgtttttgtacaagtaccatgttgttttggttactgtagccttatagtgcagtttgaagtcaggtaatgtgacacctccagctttgttctttttgcgtagggtggctttggctattccggctcatttttggttccacacgaatttttagaatagttttttctagttatgtgaaaaatgacattggtagattgataggaatggcattgaatctgcatattgctttggacagtatggccattttatcaatattatttcttccaatttatgagcatggaatgtttttccatttgtttgtgtcagctgcaatttccttaagtagtgttttatagctccccttgtagagattttaactccctggttagatgtagtcctagatattttattttattttatttttgcagctattataaattggagtatgttcttgatttggctctcaactttaatattgttagcatacagaaatgctactgatttttgtacattgactttttttttttttttgagatggagtttcgctcttgttgcccaggctggagtgcaatggtgcaatctctgctcactgcaacctctgcttcctggattcaagcgattctcctgcctcaacctcctgagtagctgggattacaggcatgcgccaccatgcccagctaattttgtgtttttagtagagacagagtttctccatgttggtcaggctggtctcgaactcccgacctcagtcgatccgcctgcctcagcctcccaaagtgctgggattacaggcatgagccactgtgcccggccacattgactttttatactgagactttactgaagttgtttatcagttccagaagccttctggtgaagtctttagggtttttgaggaatagaatcacatcaccagtaaagagagagaatgtgacttcttcttttcctatttgtatgccttttatttctttatcttgcctgattgctctggcaaggacttccactactacattgaataggagtggtgagagtgggcatccttgtcttgttgcagttttcaaggggaattatcccagtttttgcccattcagtaagatgttggctgcagatttgtcatagatagatggctcttattattttgaggggtgttcctttaatgcctaatttattgaaggtttttgtcatgaagggatgttgaattttatccaaaggttttctgtgtctattgagatgatcatttcatttttgtttttaattctgtttatgtggcgaataacatttattgatttgtgtatgttgaaccaaccatgcatcctaagaagaagcctatttgatcaatgtgaattaactatttgatgtgctgctggatttggtttgctagtattttgttgtgaattttttgtgtctatgttcatcagggatattggcttgaagttttcttttttcattgtgtctttgtcaggttttggtatcagggtggtgctagcttcatagaatgagttaggaaggagtccttccttgatattttggaatagtttaagtacgattggtactggttcttctttttatgtcaggtaaaattcagctgtgaatccacctagtctggggcttttactggttggtaggtttttttaaattactgattcaatttcataactcaattagtatgttcagggtttcaatttcttcccaattcaatcttggaatattgactttgtatactgaacctttactgaagttgttgatcagttccaggagccttttggtgaagtctgtagggttttcaagaaatagaatcataatcagtaaagagagaatttaacttcttcttttcctacttgtaggccttttatttctttctcttgcccaattgctctggacttccactatgatgttgaataggagcggtgagtgggcatccttgtcttgttacagttttcaaggcaattgaaaagtgtatttctaggaatttatccatttcctctagattttctagtttgtgtgcatagggatgttcataatagtctttaaggatcttctgtatttctgtgagctcaattgtaatgtcttctttgtcatttctgattgtgcttatttggattttcttttttgttgttgttgttgttaatctagctaatggtttatggatcttctttatcctttcaaaaaaccaacttttggtttcattgattctttgtatgaatttttgggtctcaatttcattcagttctgctctgattttagttatttcttttactatactagctttgaggttagtttgttcctgtttttctagttcctctaggtgtgatgttactttgtcaatttgagatctttctaactttttgaggtaggcatttcgtgctataaactttccttgtaatattgcttttgctacatcctagagattttggtatgttgtgtctttgttttcatttatttcaaagaatgtttttacttttgccgtaattttgttgtttacccaaaagtaattcaggagtgagttgtttaatttcatgtaattgtgtgattttgagacatcttcttggtgttgatttctatttttgttccactgtggtccaagagtatgattgatataatttctattttttttaatttattgagatttgctttatgactgagcatgtggttgatcttggagtatgttctgtgtgcagatgaaaggaatgtatattctatggtcaatgggtggagtattcagtagatgtctgttatgtccaattgtcaagtgttgaatttgagtccagaatatctttgttagttttctgcctcgaagatctgtctaacgttgttagtgagttgttgaagtcccccattattattgtgtgttgttgctaagtcttttcataggtctagaagtacttgttttgtgaacctgggtgctccagtgttgggtgtgtatatatttagaatggttaagtcttcttgttgtagtcacccctttactattatgtaatgcccttctttgttctttttttttttttcactattgttggtttgtggtatgttttacctgatatgagaatagtgacccctgctcttttttatgttccatttgtgtaatagatctttcttcagccctttactttgagcctatgggtgttgttacatatgagaggggtctcttgaagacagcagatgagtggctcttattttttatccaaattgccactctatgtctttcaagtggggcacttagatcatttacattcaaggttaatattgatatgtgaggttttgatcttttcgtgaagctgttagctggttactttgtagtttctattgtgtgcttgctttatagggtctgttggctatttacaagtgtgtttttgtggtagcaggtatcattcttttgtttccatgtttagagtcccttaaggatctcttgtaagtatggtctaatggtaataaattcccttagcacttgcttgtctggaaaagattttatttctcctttgtttacaaagcttagtttggtgggatatgaagctcttggttggaatttctttctttaagaatgctgaaaataggccctcaatctcttctggcttgcaatatttctgctgagaagtctgctgttagcctgatggggttccatttgtatgtgttctgacctttttctctagctgcctttaagacttttttctttggcattgaccttggacagtttggtgactatataccttggtgaagttcattttgtatggtatctcacaggtgttctctggatttcttgtatctgtatatccaccttctaccttgctttcattttcagagagggccctagaccattgaccctgggatcctcccattcagagaagccccagatcagtcactctgggcttttgtctccattttggtgctggtaatatgcagagtttcccagaaagttatgctgaagtgaaggatgatgatgacttgatggatgaaaaactcactgttgcagacatgttcacagacatctgggaacattttttcccctctatgctcctaggccagtgttgaacttctgttataacactgagctataatctattctgaatcatgattactgtttcagtaccctttttttttctaacttgtgggcagtgtaaggatagcaatcacaggttcttcacttctgtactccttgataatctcaataatgatgttgatcagaggaatgataataacaaacatttattcactgtgtgctctgttccagggactgctttaagtactttgcaaggtacttaaatctctaaataatcctataaggaagaatctattatattcccatttacagatgagaaaagcaagacaaagggagattaaataggttgggattcaaagtttacaatcttatctgtacatcagacaaggttctctagtgtcaagtgtaataaaataattttaaagactgaagatccctagcaatgagcaaactgaagctacaagagattatgtgacttaatgttacatgataaattaattaatttaaccaatatctattgagttaccattaatatttattacagtccttgctttataatccacagttctttctactttactactcagccctacatagctgataaagcaatgggtcggtctactcagaatccctcatgttccagccattaatttactgttgcttgtctccaaacctactcttctatttactattttttgtgatgctggggctaggactgagcagatcacatctcttctttgccagtgaatcctgttaggttctgccaagaggagttactggagagagccagcaaggttggaggaggagaagggagggagaagcccatgcttttcagcttcctctttctgtcagagtctccatttatttctgggagcagcagctgaatccagtttgctattttgtcaatactcacaggaccacttcatcatacccacgcagagaggccagcacatagcaggaactctgctttagaggctggatcccagccaacctgagcttggaccctggcaccagctgagcatcactttcaccgacattcagctctgcagggtccctcatctacagagcccctaagtttgtaagttttaataattccaacctcttccctttgttcctcctgccctaggagtagtagctgcctcttgaaggtagaacctcctagtatattttgcctttccagttctttactacatagtacttccttaaattctctctgttaaaataactggtttggtgtgggcaccaaagaagccacccccacactgttctgtctggcttaggtaactacaagcaagggtgatgaagtccgagtcctttgataaagctctcacaatgagagatgccaccacgatatctccccagtccctttctgttcactgaaagatgatgatcccttgggttgggccaagttcctttgagaagaggctgtcttggctaagagcaaattcatgcaggagtggtggcctgaccaagagaactggctggaatttatcagagtggatgaaaagggtctccaataagataaagggatccaaaagtatttttcacagtgacacactgattcatagagtagcctcaagtcatttcatactgaaattttattttcaggattttaaagggcagaatgttagtttcaatacagcagaaatgcaatttgtaaatatatacttctattgatgttggtgttccccttcttgtttgtctccagggctgaacatcgtcactatgctaggcaaggatcccagtgagcaaggaaaggcctgcagatgcctctcccaacgaagacctgtgcaccctgggccttggctgctgagctggtcatttcttcacacattggcttgactttgggagatgagaactaggagggggccagacaatgaatgttcaagccaaactctcatggagagcctgggccagagcaactctgcttccagggatggagataaacctgaaagcgagccacgcaagaggagagtgagcatgaaagcagcaagggggtaaggatgcacacggagatctgacgttcgcagggacttccatgctcatgttctgaatttgctctttcatatgaaaacagttagctcccacagcccagattaagttttggcatccgaagccaaactggaggcctgacttggcttccccttcgctctttgtgaactttagaggtttgccaggtttctgggatctgataagctggatcagcagaaatccaaagagataggggccaagggctggcctttgttctttcattggccatcttctttttgatctccagcttctctgggttaaccacccactgaattttctccaaggacagggcttcactgagtaatttaaggcaggtgggaattgaggaaatcacaggatgaagcccaaggcttgggagattcatttgtttgctttgttcaacaaatggtttttgagtggtagtgaatacatgtttgagcaagagaaaaggaaagaaggagggaaagaagaaaggaaaagaaggcaagaaggaatacaatccacttctgttcttctaggcatgagaaaaatgaattccaaaaagattaaatgatgtgcctcagctcatgctgctagttggcagcaaatacaggaccggaactcgggtctcctgatctttgcattgtatcactctgacacagtgtgactgagctggaattatatcatccctttcagtggtacttgttcctaaggagaagaagaataaaggatgatgggtggggcatgcagtagttaataacttcaaagagacatagattggctggacctacaagtgactattggcttggccccaaatccaaaatgttcttttctaaataggttgtatttgcccactccatttttatgcatgattccctctcagtcttcagctctaaggcatacggaaacaccagtgtacacacaactgagtgacttcagctcaagctggtacatgctctggttggagaggagatagcatttttgactcgggacttgagctgaaaaataataggcatatactcagctgacagatgattgaatctgagtcttctcagtgaagcatagaaataaactggatatcgtaaagacttacaccaggtgatcaaatgatcaatcaatgagtatttattgaatggccactgtgtgcccaccatcacactttaaaaagttcctttcctcacagagtttgctgtctggctgagacagtaagatataagcatgcgtaaaatagagcacagtatggctatctgatactaggctgacgagggtcaggaaagaatgggggaagaagtgctcattgacagagcttagggggatacaactactgtcttcaaatgaggtgaaggcaagcaaagctgttctctgttactctagagaaaaaatggatagcagggaggcatgcttgggctcattgtaaagaacaatgatttaataatcagagctatctaacatggtagggctggctcattaagcagagggctcctcgttctcagaggctgcagtcacagcttcacagaagcctgtcacagaaacagcagaaagtggtccaggttgaagtgggagattgttttggatgacctctaaatgtcctttccaactctcagattcccagggtttgttatataggagaggatgacactacatgctgcaaatggttagtaagtgcaatgatagcaagaaagtgacatcacttcttgcaacctccacctcttcatttgatagatgaggaaaataatgtgggctcaccttaggaagttgctggaggaagtgagaaggtgggtctgtgcacaaagaaaaaatgcatatgagggcacatttaatagagctgtaggggtgtagccagggaaatcctatgaggaagaggcctttggagtgatatgactgtatacaacaacgataattgcgactattacacatattaagcccccacaatatgccaagcactttcacgctgtatttactcttccaccaacacttgaagtaagcaatatatgcctattttataaatgaaaactgaagctcaaggaggccacacagccaacaagcagcagagggtgaccttgggtccttattacctgacttcagggtccaggttcttgaccaacaggtggtactgtccttgactcatccacacaggtgacctgggcctaagatggagctggatcttgcaggcccctgtgggtagagctctcttaccttgaccacatggagcttgggcaacagattgcagtcagccagggtcagctcatccccatccaggaacttgcgccgggaccccttgtcttccccacaagtgttggcgtcaatctcctctggtagaggggtgttcaggtagtcatccaatttctttagagccttggttaggcctctttcaagagctggcatgaaagagtaaaagggcctttattcaaacttcttgccagtggatacagtcatagggtcttcagagtggagtagctcatctagaatcctgtccccttcatcacactgccagctccccacacactgcagaatacctggaaaccattaacacaatgcagtagaagtgtactaaataggctgaaaaggcaaactctaaccaaacaataaacactagctaatcttttgctttgaaaaaaatacataaatatagaaacacagtctgggtgtggtggctcacacctgtaaccccagcactttgggaggccgaggcgggcagatcatgacgttaagagatcgaaaccaccctagccaatatggtgaaactccgtctctactaaaactacaaaaattagctgggcatggtggcacgcgcctgtagtcccagctactcgggaggctgaggcaagagaatcgcttgaacccaggaggcagaggttgcagtaagtgaaataatactagccaatttatttatttatttgtttgtttatttatttttgagacagagtctcactctgtcactaagctggagtgcagtggcgtgatctgggctcactgcaacctccgactccctggttcaaacgattttcctgcctcagcctctcgagtagctgggattacaggcacaagccaccacacccagctaatttttgtatttttagtagagacggagtttcaccatattggccaatatggtctcgatctcctgacctcatgatcggcccgccttggcctcccaaagtgctgggattacaggtgagagccaccatgcctggccaatactagccatttttttaaaaagttttggttatctataatttgctaatattccacatcaacctacatattacatttttaggaagaaaaggctattaaatgggtaaatataaactatatagaagttccaagacaaagatatgcatcagatattgtggaagtattaactatagctaacccaacccaagaagagttggggacaaggccttcagggggacttgacagggggaatagaacagccctttttgatgtcacccccagagaagtgatgggtaccagggaagaacacttgggttactctagggaagcttgttctaaaaatcactgctgtctcaaatggaagggctccaccacaaatgtgcaacccccagctgcacagaaagctgtcatgattatgactcaaggaatgaacacccaaaggaacataacatgggagaaggcttttacagtcttggtcaaataattatctgtcacataatttatttagacacaaaagcagacaaaatacccaaaagaacaactgtgggaagccatcatcactgaaaatcgttttgcccagaatctcgtagtcctttctaatcagagaacactaccatagaaactttctacttgagctcaaaggacaaacatggaggagatggctgaccagggcatcagtcactgcacctgtgtcatcagccccatccccagactctggtttagagcctgacactgagataatggaagtcgatcctgctgttcattccagtagatacaaggcggacactgccttctggaggcaaagccaagagggctgtactcttgttcagattttcccaagtgtgccttgttagccactcctctcataacccactttttgtcttttcatagaaggccttttgtttgagacaatggaaagacaccagcccaagataaatcaattgaacacttactggaatgtttgaaaactgcctggaggttgggcatagtttctcaatactttcttctccctggtgtggcatttgaactacttcatcatctgctttgtgtttccagtttgggagaacagagtaagcagggctgggaaaatgcagtatattccttaataattgtctagactgtgatgggattgcaaggctattcaaaggcaatggcagagggtgggtactaaacaatgcttattatgcttttctccctgaagcacttgtgatttatttgtttgcttgctcaatccctctacccctttcattcctggagattacagcaaaatcttgattataatgaagaaaggaagaatcaaatactgggcctgtcaaaatttgaccaactaatatcatctgagggaaagagtcatacgataggagatgagacattgcaggttctaatctcaaatggccctggagacctgagtgggctgttgcacaagtctgtgcccatgtcaccaggtctgggaaatatcatgaaatttggtgaaaagcctagagcagtgattgaagttccttgggaagatagttctttatatccctccggtaattcctcgagatggaaggcatcaagtctggtgacaggaatcattgttgattcatgttgcaactgtgacattccatggagctttccaagtcagcacattctggaaggcaccctctgtgtatcagtctcctcacttgggtttgtgtatttttgaccaggaatgtgagggctgcagttggtaacagccgtggtagaggaagaggagacaaggcaacagggaaaggactgcaaggcctgggactaaactgtgtttaaatctcaaggccgcccagggtgaattcactgggaagctgctgagccttaagcttcaaggtgtcttgctttcctgggtcccttccaagcgcttggatctgatttcaagaattctgtattggtacttattgtattgccttaaggcttcataaatcccacaaatgtcgttgatcctggcacttacatgtgaccttggacaagttcctctacttcactgagtttctgctttctcatctcaataacgggactaaggatccttcaccctgttaagaccactgctggggttaactcagataatgcagggaaagcacctaatacagtgcctggccaatacgaggacatcaattaatggtagttgttgctattgccttaccaaacgtggggtcctcctgttctctgttccttgccccatactcttggtcaatatattcctgaatatcccaaggtgcagtggagaatgggtgattttaagaagctccaaatttgtggccaactccctggagaggaaaatcaatagcctggagatttgcttcccttacttatttagtatacagccaaagccctgttccttatactcccttgggatgctccttggtgataagctgtgttgaaaggcacacccatagcaaaatagacacaacatgcctgtgtgctgaaacactaccatattatcggatagcaaatggcagtacccactatacgctctgccaattcttttcctcccacctgccaactcattcctctgaccctggctcaatctgccatccatagaatttaatgatctcttttgactgatggtacacaggtcatgaaactatttgaactttctgctctggtaggaacaagggggatgtgaaagaaactagagcaacaaaaagatgttaattctttgtgtttaattcctcgtaaatatttgatatcctcactccacataattactctgagtagttagatgggggtatccctccaactacagcaagtgagcctagggttggggcacccaagacgcaggatcactaacatcccagggacttgatagatacccagtgttttaactgctttcttcccctctccgcctctgctccccatacagatttattctgtaccacacacaaatgcactgggtaaaatatgtgatgaggaaacaaggggaatagttcataaatattctgagccatatgcaaacaatcttagatttatttttctcttttttaaggaggaaaaaaaatccacccattccatgatcacttccagattcattgaggttgatattacataagacccaatattgttttctcgtcgtagagaaataatgacttggaaacagcaatttgagctaagaaaataatatattcttaccagggcatggaggctgaatggggactggggagccaagactctaacccagcctccaacaagttcttgcaagaacagctcagccctggtttgctggcaaactcagtgcagcacaggtcctgatgagcataaggcaaagcagactcctggggctcaaaattcacatggagaggagcagatatcaaaggtggtctttgaaagaatgagaacagctctgtgggcccaggtggctgcacgctcaacttctcatatatggtttttctcttgtatgtgtgttgcagcaaaataaaaaccaggaacccacctgtgaccgttgtctgtagattggatgggtgtctgttcaactctccatggagaaggaggttgtggttattgggcactggcctgggccgagtaccctctgccctatcttgttccttttattgccctagtcccataccttagcaccagcaaggaaatacactcactgaattcccgcagtgagctagggatgtttatgcaactaccatttaaacacacaatgaggctattgagatggaaaatattattcatcgtcattcaacagatgaagaaactgagtcttagacttacccagggcacatacgcttatgcaagcacacacatagctggtccttaaaccattcaaactactcctgggacgtacaatggaaatgtgccttgctttgttttcaactgctatggtcttccttacaagctcctaacctctgggtggtggaaaaacaacaacaactttaatttcgtccattttggattataacctagtctgatgtaatcatctaaatagtccccctagagaattctgtctctttgcattgatatgctcagtttcccagagaacctgcccctccttgctctccttcctgagtcagtggcactgggaattggggactaggcccctgtgacctcacagcactggggagatggggtttctggaatctatgggtggaaggctttggaaagcgaatacaggttctgcatttcttctgtttgcttccttccagagtaaccatggggatgctgggtgggggttacaggtgggctgcttgcctccctccacaatctggaaggatacccaagcaaagcaccacacggagctcttaacatgctctagttccctgaccctcccccccaccacctctcctttcttcttcatccccaactcccctgtgctaggaagggtgggcttttcttttagttttcccaggtcaaatggcccaccaatcattgagcagaaagcctcgcggccttgctgcatagccagtacaactgtttctactctgtgagtcgaggcctccaggcagggtttttgatgggtaaaaattgagaaataaaagagtttagaacatcttagacaataggttgggtaaaagtctactgtcttgttgaaaatgctattttgaagatcaaaagctgaatattgaattcttttttctgtcttagagttccttttacagaaatcctaatctctctgaggtcaatgaatgcctagggcagattagaatcacgtactcagagtgacagagagaaaaaaatgttcaatcgattagctctattataatttaggtgcaaagcccaggatttaagcgcagggctattagattctaaaacataaactccttctactctgcaaggccacttctgggtgcaaggactgtcccatcactccttgggtattcacgtggcctgacaggtgctgcaaaatgttctcattcccctgacaaaagaggatggggttcccctcatgactcccccatgccttaccttccaactaatttggtaacatatttgtgttctgctaccagtgcttgatttcagatataattcttagtactttcagcgaccgtgatgaggtcaagaaggagttttctctgagtagaggggcaaccatgacccatcacatcacttttcaactctgcctgtactaggggccagtgctgtcacacgggctgtgtgacaatgaaacatctggtcaaaaagtgagaaatccatttggatttttcctaggaggaaagaaatatctagatattgagaaatacctggagcactgaatgaagtttttacttttcatcttctcatttgagatcatgttgatataaccaaagggtgcaaaaaaagtacagtggtggtttgagaaagaccatggcagacggagatgtctctggccatcacatatttttgaagagaaaatacaaagatggccacacttgttgacatttgatagtttaaaacgtgaatggtaacgtgatggaaacaaaaaataataataagaagaatatcaccacttactcatctgttggaagaagaagcctttctttccacaggcagctaggacaagaggaagagacactgagagagatcagatggactaggccaaagatccaggagcaagcgggatgtaggagccccagcagggcccaggaggattgggagggtgaggaaaagggcaggtgcaggccaagcaggcagaaatgtagatgctgctataacgagctcaattttgaggagaggcaaagatattctaaggggattttgaggatgttcagctctgtgatgggcagtgtaaccaatcccctcccccaccagaaaactttacataaagatctgcattcatctttcaggttttagaaatgagtcatgtagcttttttctcagttgccaaagtccttaaagaaagagaacagtagcccagttacagttaggttatatgagtatgaatgaccacacaaaggcaaaattataaagcaggtggaaactggggttttctcatccgcagtgacctttctaggactcatggcaggtaagggggggctgattttcaggtccctttgtcttttaaataatgtctacaccagattcttagaccacatgaagtcagaaatggcagcaaggttttagaagatgggaaggggactttctatcaggtctgatgggacgctctctgctgtgcctgggccctctggctatgtttgcatgtcactggtttcatcaaggaagaaacagagaatctgggtcgagtatgtcggggagccatggcttctgataacaaacacagtagcagagcagcacattcactctgccataagagatttgggtttgaatcctcagttatgcttgttcacaggttcacatcatctagtgtctggtgcagagtgagacttgattaaagttaactgctattattattattacagctatagaacttgggtttatgagaggatgaaggggaagaagacaccgagagaaagatgagagaagagatagctcaaggcagaaattcagtgtctgaagtgaagtttatctgaacatcctagcatgttccaggtccaaggagaatcctggagagcttgcaggatgaagcttgctcttgactttcctaacatgttagggatctaaagttgcctggaagcatctctttgggtttggctttgctctctccaggccacatgggtgtgtcacattttcttagtttgacagtttagagagttcatgtccacctttggcactgaaccaagaacactggacttggcctcatagccagagaggaggatgttgtcaaattggccctgggtgtgaacaacccaggggctcacatgggggaggcaattcccaggcctccgtttctaggcactgctaaaaacaggaaaggcagaaagacaaacagcggtttatgagaaagcaaaatgcaatggcaacttcaacagattccccactgttccctcgtgtggcgtcagctgggctacagagagtgtgcagcacgtggtgccatgggtattatttgtttgttctagaaagaatttcagcctcagaggggaggatgaattaaatgacaagctcctatagttctttccagtaagaagccagtaaatgattctttatttgaaagatagcgtttaagtcttacaattatggtgggttgggatataggacactgttggttgcccaccctcctctgtggtggggagaatggggtgttttctgatgtatttccaaggaattcagaaactttcttaaggaagacacagattctccacatagctgcttccccaagctctataggggattcttataaagaagcatctttttatttaatacagctccacaaatcacccttatatttggcgtatgttcagaagtattagtacaacaacaaaatgcatattttttttaaaggcaagagactttggccagtatttggctatgtttaaaacaccagcatggtaaacatttaggacaactttagcatgcctttagtataatattttcttaaagtatgaagggaggtagggactccagatccaaataattttctaaacctcttaaaagccacagtagatttgaagagaaagattatcacttaggtcttcgaattaagtttccttttgtgtactcatctgtagcatgtaagctgcctgaatgtttatttatcaacaggagaagggaggaagagagagagagagaaagagagagagatagagagagagagagagagagagactgactgaatgtgggaggaagctgcagagctagcgagctcaggagtgatcaggggagaagttctggttagggaacccggcccagactttagccatggggcagtggcgacaccttctggcttatccctgagcaaacaaacaaacaaacaaaaaactccccaaaaacctattgtgtattttccacagagaacatgtacgtgtgttttctattagactttccagaaactcataaatgattgtagaacccatcgtgctaatagaaagtacggcataaatgctgacggaagctattaatgctgattgtagtttatgtggccaaatgaatcaggctgaaatctgtgagtttttttatggttactttataacaggttatttttaagtatcaggccatagattaggtttaatgcggatgctcacacacttagaatgagctggttaagagagattctaactttatcagtcatccgttccagcgtttagacctagagatttttctcaattctccctcccccaaaacacttaggctgaagtacattcaccacattttgtcttgtttcatcctcaaatagccacatcttttacataagagccattcacaaacttaaaaactgcctctgtgccactgcaatgctagactgaaataattactggatttggtgattctgtgaatatcctacaaattctcttccagttgcccattcttttatttgttaaacaggcatctattcggtgcccactgtgggccaactttgtgcccctttccccacatggattgctgggtgaggaccctgatggggaaggtgggaagtgttgagtatatttaaggaaatacacatggtagtcattcattgagtattcatcggatcgtgaactgatttgatcaccatttcctaaatgacacactcttgtttaattcagcactacatacatattaaatagtggattatattaaatgttaatatacgcaagtcaagagcacagatcatgggaccagctgcctgggctggggtcctgaccctgacacatactagcttgggcaggttgcttaaccggtgcttgtttccttctctgcaaagtggagatcataacatggcataccttagagggttgctgggagcaataattgagtcatcacctgcagagggcttagtacagtgcccggcatgctgtaagcagttgttatgtacaatgtgtatgtgcaacgcatgatgatgctgatgtatgagaaacaaagcatacaaaaaaagcaacaaaaaattcttagagctgcaagaaaaaagtggctcttgcctctggctctgctcagtaaacatcgtgcttgactcatcctctgccctgaaatgctgacatgaacagggatattcagctgttcctttcattctgactctacagccagaaccacagtcccccagccgaaagccttcatcataacagatgtgaaatggggcaaccttaaaggttgggggtgactgatacttacacagaattccccagatatgctacaagtacacctggacctccctcccccttgctcagagcagttccctggataccctaatgtgccccagcaaaaattacagtttgtggggagaagctacccattggatgtttgagttgcacagcttttactacatgagtcttgcatctcctaaagtttgaagtgtgtagcaaattaaatgtgcaattttatacttctgtttcctgaaatctagtagggggtaaatgactcagatttttccagcaccaaaggagaatttaaaatagtgtgtcctttttggcaatggctaggacaggtattttcaccagagagagaaaaaatatcaccttaacttgaaagtgaatatataagaattgaatatacaagaattcagtctccttttatttgttactagtagaagacagagcccatatatatatatattttcagggtagcaatgtgccctatcaaaaatactcatcttcctagattcccagaatttcagctacagaaggccaaataaccaagttctggctaaagagatatcggtagaaattaatcaatgggcttctgggaaagataagatagatgcggctggcattgtctggaatgcggatgtgatgtttgggggtggagcaaccatcctgtgaaacaagaatgaaagtcacacacgaaagatggagaattaggagctctaagcagcagctcaattctcgacttctttcagcaactacatttgcctggaactctctactctctggacttcttgtcatgtgagaaaagcaaattcctcttaagaagtaaacatttatcaagagtgcttagaacagggcatggttcatagtaaaatgctatataggttttgctaataaaatacatgtttgctttagccactgtagtcaggcttctattacaaacagccaaacacaacatttgccaatatacataggtattgccaacatgccaacatgtcattattccgctttttttttttttttttgagatagagtctcgctctgtcacccaggctggaatgcaatggtgcgatctcagctcactgcaaactccatctccctggctcaagcaattcttctgcctcagcctcccaagtagctgggactacaggcgcgtgccaccacgcctggctaatttttgtatttttagtagagactgggtttcaccatattggccaggctggtcttgaactcctgacctcgtgatccgcctgccctggcctcccaaagtgctgagattacaggcatgagccgtcgcgctcagcctcattatttcacttttattctagcaccttgcacagcgtatggtactgaataagtatttgttgaaagaataagccgttcagtggggtttgaggaaagatgaaggaccctaaaatcatgtgactctatttatatacttatgtaataagctttaactctgtagaggaacaacagttccctttctttgtataatagtagcccttggtcttttgaggatagatgaagggattcaattagtttggcctgagataccctcccacagagtcccagccactttgttatcagagccaagagagaagcataggttagcatcaacctctctgccaaacgactcaggtaggactgaggcagtttcagacctgggcaaaatgttgagtaaaactcatcttagggtccccacaatggaaacagaacatggataactatcattgcaaacatcagtgggcatgagaccatcagagttagagctgagtgcaggaggtctgagaaatcacgtggctcaaccctcccctccccagaatgttctggaagggaagaggttctagacactagcacagagaaacatatatacacacacacacatacacacacacacacacatatatacatacatatacatatatatatatatattttattttttttattttttttgaaatggagtctcgctctgtcacccaggctggagtgcagtggtgtgatctcggctcactgcaagctccacctcctgggttcatggcattctcctgcctcagcctcccgagtagctgggactacaggcacccgccaccacacccggctaaattttttttttttttgtatttttagtagagatggggtttcaccatattggccaggctggtcttgaactcctgaccttgtgatccgcccccctcggcttcccaaagtgctgggattataggcatgagccaccgcgcccggccagagaaacgtattttatttaccttgatccagatcattaaatgctttgtccaccaggggtcttagaaaaataatttgacctctggctgctagctgaaaaaagtctagaatttagccttctgtgttttctcttttgactcttggtgaagtatcacttttaacaccaaatagaatttcccttgaatgtggttataaaaataatggtgaaaagaaaaatcccacttcagcgaagcccgccagcacactggccatcctagtgaggagagctgctcaggttcttgcattcttttattgattggttctaagtgagattattcaccatgaagcttgatatcatataacagaggctacaaaagcattgtatgttctcacgtcaaagacaatgctagtcacagaacatcataggatttaaatggggactgggaagttttaaataaatacagtcagagcataggggagtctgcaacatggggacagatttaaaaggtgaggttccacagcggggacaggaagtggctggaggacgtgcccgtggctctgatgaggccccgtcatcatctcccaagcaaaggcatagacaaggtagaggtgtgttgaagtgtttgtatacttttttttctctcatttaacaaatattgatggaccatctgccctgggtcagatgctgagctggggtctggggtgacaatgatgaaggaggcacacccagcatgcttcctcacagagacagctgctcagaaccctgtttctcacagcacagccctggaccaacagtgtccgaatcgcctgggagctctcaggccttgccccagatccactacctcaatatctgcttcgtaacaagaccctgtgggaaaccaggatatgccacccccaaaataggaaggattgttgagatgaagacaattcagaagaaacagaggcagtaaagctctctgccctccctctatttgtctaaaagcaggacgtagatttacaaagacaaaacgtatcttgcctccccccttctaccagggagaaccactgaaaacaacttaagacgcttatgctcctggagatggccctgcaggaatctacattgaacaagctttgctaactggcctttatctgccattcatttgctatcccccgaagttgctgcccctagagactcaaagtgttttttcccttgtcacatctctaaaagtttactgtcctttgatgaggatgctgtgaaactagaattcaaagccatctctttgagaactcctcattatagaaaatatacatgttaataaacttctgcttgtttttctcttgttaatctgtcttttgttacaggggtcccttccaactaagaacctatgggggttattcttcctctaaaacccccacgggattcaaatgtattcgcaaggtagaaaatggtctggctaacaagaggaatgaaaagaagtgctgctttatgcttaagccttaagtctgtgcctgtcttaactcatgaggctactccggctcagcctggaaacaagcttgagatggggtggagtgccttcctgcaagacggcgctggagcaggatttgaaagaaagcctggggttttaaagccaaagttccatgtagcaactttttcccaacaaattaccctctctaaactgctgataaagtcagaataccagactagatttaatccctggttttagttcttatgtctttgcaacactagttggtagcaaaagatgtttaaaagctgagaaatgctgaagcttttgctagaaggttcagtgcaccacctggatttcacatcttgtcattttcagccccagctctaccaaaaatgagggaatctgttctacaggttaacttatccagagatattctcccctaaaggtcagcagaaacttggaaaaagtttcctcaaagctacgtcctaaccacagacaaggggttatgaatgtagtaattgtataaaccaactgtgatactttcaacctacacacacacaatgaaatgtagacacacacacccatggacacactattgtacttctgtggtctgcatatcctgtgcttagtgggatattgtgtcccatcatgaatatattgtgtcccatcatgaatataattttgcatgtaagcactttcttttagattaattgaaatgagcctgtctaaggaggtatgtgatggcctttgccagtacataagaacatcagaacacacacgaagtgcataagtgtgtgtgtgtgtgtgtgtgtgtgtgtagagagagagagattgagaaacgtatttggttcctatgtgtagactgcacaaagacaagaggtgttggttgcataggatgaggtaacggtaggaagaggtgaaagaacatttaactcatgtgcaaatcagttatttaacgttcctttattccccaggtcttgatctgcatccaggccaggccaggagaactcattctggtcagacagcgggaaattccaccacatggaatggtgttggtggtctccgctctactccagtccaggagcccacacagcaaaattccactaatgaatgcgcccacccacgcagggcccagctctccccacccccttctccccatgcctgccccattcaacaggccacgccaccaccaaccgccttccttacaactgcccaaggattcgtttcaggagcaagatttgttaaattataaattggaagcatccacctcaataatgaaccaaatcaaagaccctctggaggaatccctcaggcagctcatgggagggaccagaggaagcatttgcccactcctctccctcctgccctcagccccaaggaccctccatgagggaggagacgaggacatgcaagtgcagagcccaccagacctccgaggtgggtcccaccgagcctaggttatttgtttttccttacaagaatgctagtcaaagcaaaactttaacccaacaaaccaacaaacaaaatacccctagttggctatttgcacacaggggttgccaaggaaggcagcctgaagggtccctttgtgaccagaggcgtttttgaaaggagacagcaatggctgctttatgaggaagtggtgagacggtcacatgttatccgcattgctgtggaggtcggcctgaccacccaggagccttcaccaagatggcctgataacagcccaccgtggggctcccaggcctctgcagcggtcttcctgggacccaactgtcctccaaaagaactgcttccaacagagtagacatggagccccacggccacctaagtgactctgtttctgagcatgctacagggtaattaggtttcacattcctgctgctttttacacacggccttagctttctcatcaggcctgtggcagagcacaaggcagaatgagaaggggggtgccgcatccatcccctggatggccaggccctccagacagggccactgtgacacgggggctgggggctgggagggaggaaggggagaaggcatgaagcgccttatgattgaagtggcttggaataataaatatacacactcttttttaaacgtggctcaccacatcctgggaatctggaaaaaatgccccacttcactgtccctcaccctcctccccacctaccccccagcagcagtggctttcatgacgcctgggggaaagcacagggcctttgataataaggggcttgttagttctaggctaacagccctcccaggccgctctgaatcctttcaagcacttttttattttaggtcaaggaagttcgtaaatgtaaagactcgagattgtagaaggagaagaggaaagggagaaagaagcatttgggggtagttgtcattgggaggggcagccagggacctcctatggtagatccgtcaggcctggtggacatgcccttcccttggtgtgggggacagataatggaaggtggctttgagccttgaagaagacctagccttgtttgaaccgtctaagctttggcttagataaaactgaatctttgtataggaagaccctttcgaatccacaggccttgaataaatcacatcagctggctctggcgacgattcctctgcctgccagaagagggcagcacatgcttcctcattacagggaaagctgggctgcccagtccaaagggtggacactaggtatggaggcggggggagcactgtgaaattaatagcagcagcagcaacagcagcagcaatagctatcacatattggtgcctactgtgtgccaggaactgtcctaagtgatttatatgcattaattcatctaattaacatgacaaatcttcaagagagggtgctattacaatctccatattaccgttgaggaggctgaggcatactgaaattaacagaacttgctattgtagccacggactgcctaagattgaggtcagcaaattacagtccaaggactaaatccagttcactgcctactttcatgctgccctcaagctaagtattgttttgtgttttacatttttgcatggttggaaaaaagtcaaaagaagaataatatttcatgaagtgagaatgatgtgaaattcaaatttcagtgtccacgaatgatgttttattggaacacagccctatttatttgtttacatattatctgtggctgctttatgattcctgcagcagaattgagcagagtctggtagaggctatgtagcttgcaaagcctaaactatttactatctgaccctatatagagaaagtttgccaagccctgacttatgaggaagagctacctgtttccaggcaagagggacagagaacagagttgctatttactggaaatggagctagtatcgctatcccagggcaatttagaagcaatgttgaacttgattcactttttttccaacagggcagctcaaggtcaagcaaaaggagggtctgacatgtcactgaatagcctcaaggaagtaataaaaggttagatctggaaaggactgtgaaagtccactattatgtctcaagtctaaggtgcacatttttttcactctttaacatctgtgaaatcaggcaatgtcttacaatcaaaatatgagaggttaagtgaaaacactttgtttaagtgatagcattttgttgttgtttcttagaggtttgtttgtttgtttgtttttgagatggaatcttgctctgtcacccaggctaaagtgcagtggcatgatcttggctcactgcgacctctgcctcccgggtttaagtggttctcctgcctcagcctcccaactagctggaattacaggtgtgcgccaccatgctcggctaatttttttgtagttttagtagagactgggttttgccatttggccaggctgatctcaaactcctgacctcaagtgatctgcccacctcggcctcccaaagtgctgggattataggtgtgtgccactgtgcccagccagtatttaaaataatagtgtcgtacaatcaatgacaccttagattaggcagttcctgcctccaaagatccagcctctttttggtcctttctgttgatgggatactcacttcttttgctggcagtccattctacagatttaattttaaagtttcttttcttttttctttttagacggagtctcattctgtcgccaggctggagtgcagtggcaccatctcggttcactgcaacctacaactccctggttcaagtaattctcctgcctcaacctctcaagtagatgggatataggcacatgcccccacgaccagctaatttttgtatttttagtagagacggggtttcaccatgttggccaggacggtctcaaactcgtgacctcgtgatcggcctgccttggcctcccaaagtgctgggattacaggcgtgagccaccatgcccggcctaattgtaaactttctaatgttgagctgaagtgtgtaagcctaaattttctatacatcaaatgaggatgatcttgcttaatacgtttactttaagagtcttaagatcttattaaaagggagcgaagggaaggaagcactgtgacccccggggtagggaggaccagagccggctgcaggaatcagtctgtcggtgtggtcacaccaggcagtctgcaagatgggaggacagggatgagttgttggggacacaaaccatgaaaacctggaaggaaaagaaagaccgccagtgatacagatgagttctttttctagcagcatcagccaggagcatgacccactgcaggtggcacctcttagaaggagaagacaggagcaatttgaagattcgggcctgaatggaacaagaagacaaggaaagagcgaggaatgcacctgtggctggcttgcccctgctgccttatatgagggctctaggagatgaggaagggaaatgagagaggcaggatgacagtcattgatattgtgttaataagaaccacaatgtcctccttcaatcacgttcccattcagtgggaatgatcatccaaattctgagataaactcactgaggttcctagaataacccgagagtcttcttccattctatgtggcagggacaatcaatttttccagaataagcccagggagcttccaggttccagaaagaggagcctctgatgtgagccttagggaggtggaaaccttggcctttatttggaaacagaaccaagactgctcagggacctgtgtggctaatggccacttttttgttccagcaacaaattgggaaccaggaggtggtgggaactagggtacactccctcgccctctggtaaccacgtttgagcttggattggagagaaaggagaagcagagggcttagccctaaccaggtgcttttcatctggggacatgtgtcctggatttcctgggacagtaccaatttcttataatttgattattttcaatgaaggcaatttgttaggcatctgattttcagtttggaaaacatggccactgcagttacaactgatgaagggcaatgcaatctgagcacatgcccagcacgtcacagataccaaggaaggtttttagggctttctttcggaagttagaagcaccttattaggacaagtattttaggaagagtatgttaggacatctcagagtcttccataaaaagagaactaggtgcagccttgcgagtgaaaggggtacatctttgcacatctagtgcaggagcccattcatcttgatgaaaatagataagcccagacaggctgttctgtgtcccatgtgctgggtggacagagaggggcagggaggttggcgacacacgcctgaggctgcagggaggtctcctgagtcttccagagaagatggagagaaaggaagaaagtgagtttcaggtgaagagagaacacagggattgtgagatcgggaggagcacagctcacaggtgggggaagatggagaggagtcagagcagcaggaagtcagcagggcctggagtctacagcagcctgaaagagaagtcacaggaggggagagccaaagaaaatggaaaccacagctcctccgtgcctgcggctcacagcaggaatatttgttattcttctgggaggctggtttgtttttatcttctaggaggaccgagctgcagctgaccaggggccctgttttgctttgtctgctcacaagtttagagccaaatttgtggtctaccttctgtgtggcgcacgaaggccccggggctgccctgactgttttagctcacccagggctccatttgatggttgtctccttgtttttctttctcacctcctcttggcctttgttggtttgccgtgctttatgcatccctgggagtagctataaagcctttctggaacaagtggagtataaattttaaaatagaaagaaggccccccaagacagaggaatacagaggtggaaataagagagaaaagtggacttgaagggggaagaaaagagggaattcaaaggaagccttgaaagactaaaaccatccagattgggcaaaacaccacttagtgcaggtcgcctgggaggcctgagagagcttaagccccaagactgcatgtgatacagatgagatactattgcccctggggcttttcagacctctcactaggggaaagggagtcctgtggaagtgggctgcgcaaaaggaggttggatggaaggtggtcagcgtgaatagagcaggagaaatactgaatttttgtcttaggctacaggcataggcatgcctacttcctctccagctaaaaagaaaaggggcaaaagcacatgagaatatgacactggcaccaaaaacaaggatggtaattcttggtaggacattaactgtatctgagggaaacatgatagacctggaagaaattttaaaaaggggtaggagacttttcaaattagttaatcaaaatagagcattcaagatgcacattagatccatttgttaattacctgccatatgcgatggggacagaacatgaaataaatcatgtgtattgctaggattgaagcataaggaaagagagattgtggaaaataaagtgaaatatagcactttctgcctagattatgataagtaactaaaatgaatttcttgaaaaccaagagatttgcagggatttttagagtctgttcaaatggcagattgagggtaagaaatgcaaaatgtaagacagatattcagagggagaagtccacatcctcttaggaatgacagagagtgggggacatgttaaagtaggtgtcaaagaaacccctttagggaagagacaaacccaaggagccaaaggggtgttccagtggcaggcggggaggggtgtttcacagcgacgcttgctagaggtggaggcactggcttgcagaaggtggaggcctgggcccttgctgaactccaccatgtgccaggcaggctgggtagagagcatgattaagggggaggacagacctaactgcttgctaattacagggatgctgcaggatgtgccaaaggggcatggatgacactgtgccctccctcaagccttctacttcagcactctatgaacctccaggtctaaacccagggcataacttctccctgcaagattgaaaaagtgaatgtggggctcagaggaggaacccctccagccaaatctaaatgcagtgctgctttctcccatctcaaagatgctctttcgcaggaccacgagcactcttcccatgtgggttcctgatccagttccctatcatcacccactggtcctcccctttctaagggagcagggtttgtgcttcctccatcagactgagctctctctggttgtgtagaatctgagtaatgggtggattccacatgagaaaagcagacagaaaaggatatccaagaacactttcagggagctgcacatagcaggcaaaagtctcccaggaccttctctgcagcattttataacacagatcactcttttaaaacaacaacaacaacaataaagcttgctttcccatctttatgccctccccactacccccgatttcctccatcctccctggctagtccttctttctcttcctccttgactcctctccctctgtcatcccatctatgtgattgatccttgggcatcgtcttaatcatctaaagatgtataacccctcaaactgcatttttataccagaactctctgctaaggtacaattgtctacccgagataactgctcagaacaacggctgactttttttttttttttttttttttttgagatggagtttcactcttgttgcccatgctggagtgcaatgacgtgatctcggctcactgcaacctccgcctcccgggttcaagtgattctcctgcctcggcctcctgagtagctgggattacaggtgcttgtcaccataccctgctaatttttgtatttttagtagagatggggttttgtcatgttggtcaggctggtctcgaactcccaacctccggtcatctgcctgccttggcctcccaaagtgctgggattacaggggtcagacaccatgcctggccccagcagctgactttgaacgtggtagtgggcattattccaagcacacttatgaggtatacacagttattacccccatttcacagatgaggaaactgaggcattacagagttgaagtaacctgtgccatgttacaaggacaagaggcaaagctggtgtctgaactctgaactctaaagtagttggctttagagtctgcaagttgagccatacacagtcacctgcctctctgcataggaaacacagcatgtttagaaacaccgtccttatccttctccccaaaaccaggcgtgtgggtgagagatcttagagcacaagaaaacgaagcaacttccccaagtagcacctgacttaatgtgggatcttgccaccgagtcatgagaaaatccagtctacatttaagtgaagtgaagagcaggttggaaagagtgagaggagggggcatggaggcagtatctggttactgcagaccaaggggacctggatctagaaattacagaggaggggtgagtacagtgataggcctaaacacggagcacagaatcgtccctcagggaacaaaaaaaaatgcaaggctgctgaggtatgagagttgggccaggccactgacgctccttgatgacactttggagaggaggaccatgcaccaacaaagtttaaaaagtagaaaatagactgaatgggtgggagatttggaagagctaactgagggggaagcaagagctgaagcagcagtttctgatgtcattattcatcttagtcccatttttgtgctaatagcaataatcagaataatcaaatttaacagttacgaggccagacactgcgctaagggttttacatgcgctgagttataaaatagatgaacctgcattacaaaccttggtgatattattaattaccttattgccagataaagaaactgaatgtaaagtccattttacagatgcagagccagaggctcagaaagaataagcctcttgggtaaagttgtgcagctagaagtgctgggattcaaacccaggccgggaattgcacatgtacttgttttacagctccctgtagattgttagttcatggagggcaatgactttgtctcgttgccttggcaactccagaacctagcacagtacctggcacataagcagtgccctttaaatattagctcggacttgtagtcactttatataacttgtggttttttgaatgaatcagtgaatgactgaatgtacaaactaatggatgattctctccattactccagtactgctgggatggctcccacggatggggtctcggttgtggtagctggggacttacaaggctttggggaacaacagggaaattttacttggtggttcctgtagccaccacaggagtggagtggagaggtgacccaccatggagaaccatgtaacagtgttggcttttctcatgctttcattttgagagggcagaaaaggatcatgacctgggccagtgtgtgtatgggggctggggcattagtgaccaggtagaggggagggagggctctgctcaagagaaagtaaatgaaaatacaagagaaaccctctaaagaaagaaagttggagaactaggtgcagagctgaagatccagagggaaaaaaatggcaaagtaatgtagggcggcatgtggaaggaggcctgggcctgaatgctgatgctcttggggagaggccacagccatggagctcacacagagcagaaaggggatggaccatctcccgggtcaggggctgtggggctctgggaccgtaacacaggagccatgctgctctctacaggagggcaagccttacaggagccttcacctctggcttgctaagcctaagaattttggacccagttgaccacaactcgggggtattgggtgggaggaaggacaagtaaagaggaagggaggggtgtgggcaagttatagttccagggaaggaatgtgtggtgtcttgttaaacagaaggtggaatagcacatctggggacaggctctttgggaaagcagcaatgttggagctttgaaatgtgcaaatgagttaggggaagcaggagtcacaagggcaagtctcattacagaagaaaacagggtgaaacagaagaaggggaaacaatgaaaattggagagtactgagtttataagaaatggatatgcggcatttggtggaaactggctttggacttgggaataggagaactgtaaatatggataatatgtaaacaccatttataattttaaaaatctggagggctcaaatgagataatctttctgagggcactttgacaagtatgaaagaagatatttgtggctaagaggaaaggatactgggtgtggagtctgaaaacgagggttcgagagccagctctgccttgggggtagacaagtcatgggtcttctcgtttggttctctgtcctcagccgggaaagcagcaatgactcttctttcccacaatggctctgaggggccatattcatttcctaggactgttacaacaaagtaccacaagctgggtggcttaacacaacagagacttttccccttacagttccaatatcaaggtattagtaggtgtccttccttgcctcttccagcttccggaaagctaagagttccctggcttgtgacagcatcaccccagtctctgactgtcttcacatggccttctctcctctacatgtctgtgtcctctcctctcctcttttttttttttttttttttttgagttggagtgtcgctctgttgcccaggcaacagtgtgatctcggctcattgcaaccttcgcctcctgggttcaagtcattctcctgcctcagcctcccaagaagctgggactacaggcatgtgccatcacatctggctaatttttgtatttttagtggagacgggggtctcagactcctgacctcaggtgatccacccaccttggcctcctacagtgctgggatgtagtcaagagccaccacacctggcccctctcctattcttataagaacaacagtcattggatttagggactacactaaatgcaagatgatctcatcgccaaatccttaactaattacagctgcaaagaccctatttccaaatgaggtcacgttctgagatcccaggtggacatacatttaaaaaaatttttttagagacaggaccttgctctttcacccaggttggagtacagtggcataatcatagctcactgcagcttcgacctcccaggttcaagcaatcctcttgtcatggcttcctgaatagctgggactacaggcatacatcaccttgctcagctaattaaaaacaagttttttttttttttgtaaagacagggtcttactatgttgcccaggctagacatgaattctggggggacactactcaacacactatagggttcaagcagcaatgaagcaagagcaccaagtagattgaaagtactttccacatgcttcttcttatttcccagaagccactctctttctagtttcttgacacacacctctaatggatgtcattgcccacaagataaaaacccaagccctccaagctggcactgtgggcttcagtcactttttccagtctctgtccctgactttttctcaacttccccgcatcttctgctcaatgatctcagccaactgcttccttcttaatctttatgacccagttgaaactcccagaaaaggagtctcatgcatttacccccatggtaaatgcttctggttctgaataccttcgacagaaattattttgttcttttacctgcagttaatcagctctccagaccctcttggatcaaactgacttgaagcctgtccttctgcatctgccaggcattgaagactgaggaagtgtttgtttcttctttggacctccagaaccaagttttgcacttgtcacaatctgggtcctgagtagcttcctgaattatttacttcccgatacaccaactctgttcctgccatgatttcgtctcttttaccatgcatagctgcatatgctggtcgccttgatccaaagagatgctattctccttggagcttctggggcatctagcatctattcccttgttttggtccattgtgcatcagtcacttgttcattcacaaagattcatggagcacttaagttgcttggctttgtgctggactccagtcatccagcctgtgaggctgtcctgtcatcccattctgagggcaagggaatggctgccattgcccataggataaaaatccaagccccccaggttggcactgcagtggctagcctgttcctcctgggcctaacaccgttcttcaagtgttatacctgcttaattggacggttccattcaaatggctttaggtaattcttaaagggcaatgccaaatgaaggactgaaagtgctgtgagcataactgggggggactcagctccctttcagaaggccccgcaagagaaccaagtcctgaattctgtagccaatgtcagaaatgaagggcctgatgtaggatgggccaggctttgaggagtggctttccagggcccactgtcctgcagaaggggagaacacagcccaggtctgccttccacatttgccacagtagtgactgtgctgcctctcccttggcctctggaaaaatccctggagaaaccttgtagggaccagaaggaagcgggaatatgttgctctaatgtgatcacaggcagggttgggaacttgggacaaatgggcagtgaggaccgttccgtgcagtgcactatgctgtgcaataaggcaggctcagatgacaaagagcatccctctctccagcttggcagtaaagccccaagcctttcctcctgcaccagctaggcagcagcatccaccacctcctcccctgtgtcaagggggacaagatggtggtggcggggggtgggggcaaataataagcagtattggttccagatgcttctctggcccaagtatttgacatgcctatgggcaaattgaagatgccttgggcagcagatagaccactgccaagggttcttggtggaagggagtcactcaccagcattgttctgctgcttggtatttttgatgtaggcagaaaacttggaaaagatgtcgatgcccgctgtgttggattcccggtgttttgcagccagtttggggtacctggaatggaggatgcagtgttctgtgaatcagtagacttggagctcctttaagggtgagcctatccctatcatgataagcaatacttccctttccagctgcatctacaaaatgttttgggggtctttatcctcatactatagggagggtgggcattctcagccctagggcatccatagaagaaaccagaggccagtgaggtgctgagatctgcctagggtgacacagtctgctaggcaaagaaccagaatgccattcaggggtctcaggatgtgtccttttcttgggaccaccaataaggatgtgccagtgggatggcgcaatcaaagttccctctgagcttgcctctctatctggtagggttctcaacacttcccttacccgctaaaataaccatctactgccagtcctgtgattataatcctagctacacagagctaattctgggagcaaggagaagccaggtatgttagcattaaaccatttctccaaaggaagaatacccacggtcctcttctgaaatgcccttacatgcttattatttgtgtgcagtaataacatgcagaaactaccaagctccaaaaaaggacatgtgttttcaattgttttattttattttatttggagatacatttgcaatgatccagcccccctctctctctctttcgtagagtctttcattttgaagccacaataatacaagaggcaggctggagttagaacgattggccttgagactgaaggaggtaaacttgctcatgtgggaacccagggcttggactcattagccccatcaaaatgaaaaaaatcaactcaaataaatattatttcataagcattttatgggtatggccaggtagtggtgggaagagatgggagacagtcgccaggctatcattattttcaatgaatgtgcacctctgtgatctctgggtgaatcgtttttgactgtgggctggtgggttgccttacgtttaaaaagcaaaatcctttttgtttgttttgatgtttttgatagttcgaaccaaacaagactttaaaaaatatttgttgttctttaatgcttttttgttactcaactggcccatgagctaggattccttttggggccccttttggggccatgttaggtggctgtgtaatttcagagatactgccattggaagagtccagctctctgctgtgaggcagataaggaaggcattattgtcctccttttacatggaagggaactggatacctgagaagataaatgttgatggctaataaatggtggagggacgatgagaacctggtttcctggccctacagcagtgtccttccccctccactgcttctctggaaacagtgaaaggtaatttgcattgagcacctactgtgcagcaggcaggcactgttctattccctttacacgtattcaccatttactcctcagaacaactctattggtactattattagcctaatttcctacatgaggaaacggtggcatagagaggttaagcaatttgcctgaggtcacatggctgcctggcagagccaggatcccaacccaggcagtttcactgtggaagactaggttttaaattccacattgtgtggcttctcataaactccgctgttgattctcaaagccccagaaccttaaaggctgagctgcccaccttggaggagctgtctccatccatcaggagggggtgctttgcaccgatgctccacacacatgtcttcctgggtatactgagaatcaccacattcatctgctgtggctgggggcacacagcagggcttcctgcaagatactaggtaatctaccaagacacaggaattcagtgtcatctctttctattttggccttctcacatagaatccagcatgctattagaatcgatagacttaaattgctattaacaaatgccaagtgttctttgtttctccttgataatgtaaagacagaaaggcctagaaaatgcacctcagtggacagcttgtttgggtttcttgctttgttttgctgtatctcatcaattggtcagactttcagtcatctgatcatttcttcacaatcaggttgggccaaacagggatgtgtggtaccaaatccaagatgatgacagaggatcgtgtattcagggggctgtggtggtgtcatcctgtttcccaagcactaggactcgttgtgattttactgtgtagtgcagtgttccatttgagctttgttcttgtgggaagtgcgtctctaagatgttaatctcgcaactttcagtaactacactgggggaggatactatataggataagtgcattcattttacctccatatttatggcgtgttttaaatatgcaaataagcgggctacaaagtacattctgtttctctaaaaggctaaggaagagtgtttcactcacagaaacagctttgaaataacattggatgtgatctgatgataatcaaagagatgataattttttctaactcaggagtcagcaaactgtgacccatgacccctatttgtctgaggttctcaagctaacaatggttttcacatttttaaatgcttgaaaaaaatcaaaaggaggatactgttttgtgatacgtgaaaataatatgaaattcaaatttcagtgttcataagtaaaatattattgaaacagcaatgcccattcatttacatactagtttatggcttctttcacagtgtcactgtggaattgtgacagacactgaagggcccacaaagccaaaaatacatgactatctgaccttttacagataaagctgctaactcctgatctaactgatgaaaatttctctccacccggtttttaggatatcttatttcaaatgcatgcacttaactttcattctgggaagtaaaacagttggcttctcaccaaaaaaaaaaaaaaaaaaaaaaaaatttttcaaaagtagaaaatagtagcaaaaaaagagaaaaccattgcagatggtaagtgccctatctggtttagagtcccagctgacttctcactgactagccacagccaaccaagacactgaacaaaaggatacccaccatgcaattaaaccaatgtgcatgaaacacctactgaggactaggccctgagattggttttggggatagataccctggagaaaaagaaagacggtcctgatggaatggccttgctgatggcagcttaagtgttttccctcctttttctcacgagctgaaaagtggaaagacttcctctctctctcccttctccattgttcccacttccttacttcatcaacccctcacacgtgaaggacgttaatgcatctgacttttctaatccttgactgtgtgcttgtttgactcatgtctgctgtgtaagcaaaagatctctggaggtggaagaggcctggcttattcattaaaagatatcccctaggatctggggatttaagacctaaggtcaccaattgtctgtacaattgcacctgggagacagacccaaaacaggcactggccactctttctaactccttgagcttccatttaatgagctcttacttcatatcaggctctaggctcattagtattattttttacaatagccctataagatcaacagtatggttcttgttttaaagatgtgagaattaaagattctagagaattcaggtcatttgcctgtagcggagaatatgcatactcactaaatagccatgtaattctgtttcccagcttctctctcacctaagttgggatcacgtgtggattctgaccaatggcataggaaggaaagtaatgtcaccatgacattttttttgcaggcctggccctgcaaaacactttgggagatctttcttctctctctccctgaaggagccttggagggcatgtattccaaaaactacaggatggaagagggccaccctaccctctcagaatttgctcaagtgagaaataaacctgtgttctgttaagcaactggaattttatggccgctttgttactgcaacatagcacaacctagtggtatggatttgaacccgagtcactctgactccaaacctcctgcccccagctaccatgccatcctgtgggaggtctggaggctgtttctctacctcccagagggtcagaactttcttgttttttactgtggtgagttatcgctatacattttgtaaaataatgaattcaagttgtcttccaattctgtcagtgttctgaaccctgttgatacttaaatcattcttgctagatgactgactaaatgacatgctgtgtaaatagactgtatcagtttaccctcctgaatttttattacagcatctatgtgctaggattatttgagacaataaccagctctggaagagtactttgagaaactcatggaattgtggaacatgcaacaaaagacatcttggagactatgtagtttcaccccctcattttagagatgagaaggcaaggagggtctgagcgggagagaggcttgtccaaggtcatatgacaaacactcatagagaggtggccagaggcagggctcctgactctcagtgctgaatcctagaaactttggccacttcaggagatgaaaggcaagggccagaatgtctcaacagtaatcccagcattaatcacaacacttccttgtcgagtgttcactagatcaatctaaggagagggatggatgttagtctcatttagaaacaacttgagacttcctggattcctcattttgacaccaaatgctccctgggatcaaatgtgatttgaaaaaaatggttggagtgtttgtatgtggttttctcctttaaaaaataaagctaagggaaaaagcctcccataatgtgttggcttttggcagcttttacaaatagtggtatgatgagaaacacatggccgaccagcgcttggtgaatggttatgagggttttgctgccccctagagaaccagaaggccaggctgtcctgctccagaggcctgacaacctcccagccactccatctcccagcctgagtcgctggggaagctggtgaggctggtggtttgttctgggcagaccagcaggtctctatggggctgaggcactggcttggtgacatttactgggaggtaattgtggcacctgcctcagtctgatgggtgcaaaggcatctaaggtataatcctgggatgctctggaatacttgatggcctcacccttggcgcccccaccttggtaggcttctggagatatgcattttaacagcatcaagcgttctgctacctgagagtagtggattgttaggtcactaacatggcaggaatgcacttcataaaacctcctatacacaactgcagtccagagaaggacctggaccagcgggagcagagctcaggacagggaaggtaggtggagaggagggagtggagggagggtccacatccagccctgcccagctctatttggatcatggaaacttagaatctgatgaaatgatgacgaagtcagatgatgactcgcctctggaagaatgttcaaggacgcatggggcatacaattccagtgatctctgtccaccttgtggtcccaccgtggttgcagattggagacccctgagttagagaagcagcccaggaaaggcacagttgcactgggggtggtgtggtagtggtgagggaacctggctaaagggcatgtgaagaatcagagagcaagaagggctctgggagatatcctgtcacagagaagggaactgagtcctagagcagagaagagactggttcaagaggtgaagggactggctcaagaggtcacagcacatcactagcagactaggattgtaccccagcccctcacccctccatccactgcctggcaacagaccaaatgggcccctctgctcctcactgcttccactttccacttcctaatgatcatgacggaagcccccactcctgagtgccagtgttacttctaagagggaaaatgttaactgcgtcatgaactttcctctatgggtctcccaggcaaagtctaaactctagttattgaaaacagcattttttttcatgtgggatttcaaatcagtgctagcaatgaggttgagtcccggggagggggatggagtctgggctccctcagggcaattccagtgaagtggctggctggtgtcctcttcagagatgtgtgtgtgtatgtggggctgtcctattgatttaattaatgcacttatttagagtctatactcagctgcttccaatgggcttgaggtggctttttcactctcagtgtgcaaataagctgactgaatatggatgacaaagaatatttttaaggaagaatatatgattgtttaaggcttatttggagcatgactggcagttttaattttttaacagcaattcactagatgtgcaaccttgggtaagtgacttactctctccctgtcctgactgtgaaatgaggataatgatagtacctaggatgctagaaggatgaaatgaatcatattagctaagtgttgtgaatggtgcctgacacaaaatgaaggctataaaagtgttgatgaataaataaaactttaaaataaatgcaggatggtggtttttagtagtcaaatctcactaactttacttactcagtatgtcctgaacccttcctactcctctcccccgattttcctgccctgtcttggcttagcccttcattcgtcctgcctggacagtcaccaatggctccccagaattaattcctctatctccagcttcatggtcctctaggataccgacttccctcaacctctaaagtaggtcttaaaacggactccccacctcctgtgcttaatccctttcagaatatcccacaggactcactacaggataataccctacaggataaagttcatgcctcactctatatgtaatattatttttctagttttttcaaaaattgtgattgttttaatccttgataatagtattctttaatgaacaagtctagcttgggtaaattttagaagccatctgtcttctttttactgctcttttccatcagtagcaatgtgtcacccaacaagaacttatagctctacggtctatactctccctgaacctgtttgcagaagaggagctgctgcttttagttgatttttttcatctgtttaattgtggactcagaccagatttggtcaggtttaagaccctggatgttgttttaagtcactgggttaccctttcctgacttattttcattctgtcaggctttcggctctggttctgaaatgaaggaaactttgtcctcacttcaacgtcttccaagcaaagtgagctggagagaaggaacatactggggcgagggaggcctggtatcctagggctcctaaaatcactctgtgtaggtaggagtgactggctcttgttcataggccatatctactcttgagtggattttgtggagtggttttgagattggcagccctttgggggtcctaggctctctctttgaagaaagggtcctgttctctggactggtgaggttcctttggaaatgcatctgcccgaagttaacaccaggactttatagatccagcatgaacccttcccattcaacagccccagaaagaaacagatccttacttttcaggggtcaaggtctcctccaggaactcctcgatcttattgacgtctgtcttcacgtccccgttgaaggtcaggaagggcgggtgcgtgccgggggctaggttgtgcaggtcagctggctttctgtagagagagcaagattcaggtgttggcttacagcagggtgcttcctgttctgggaaacctaagattgattgtaacttagatgccctgtgctatccaacatgcctgtcaggtgaaacagatttatggtatgcagtatagggcaggggaggttggagaaagttctgaaagaatgtggtgtgacccaggaagtgtgtccagtggagtcagtgagagaggaacaagtcaagatgaaggagttgaaaaaatgaaagaattgaaaaaatggagagaatccaggtgactatctaagtcagatccaagctttaattacccaggggagaggtggggttttgcttttaaaagctctttcaccaatctgcctaacaaaaatgcgctacacataattccatactttaaaaattaatgaattagatcatacttttctcctaataaatatctccagatacaaaaaattgggagtttgggccatttgttcaagttagatgcttctattgtgtgtaacttatattttaatatctaataactaatgtctaacattggtcagccttttgtcacactcaacagaatactctttttgagttataaacagcccctgatatggtctttgggtagccaggaaaataaacaaactattagattgaaaacaaaactattaaatgaagatgttttcaaaagtcttcttattgctaagattattgctccacaaacaccaggtaggctattaccaaggattctgaaccaagaacctcctactggtgagtaagaagatacctgagagaaagccttacgattcaagctccatgagggaaaggacccagaaccatgcctggcatataggaggccctcagtagatacatatttttaatggctacatgaataaagcatgcatttttgattcagctacagtggctcatgcctgtaatcccaccactttgggagggtgaggtgggaggatcacttgagcccaggagttcgagaccagcctgggcaacatagcaagacccccatctttacaaaaaaaaaaaacaaacaaaaatttgctgggcatggaggcatgtgcttgcagtcccagctacttggaagactgaagcaggaagattgcttgagcccaggagttcgaggcagttgtgagccgttgatggcaccactgccctccagtctgggggacagagtgagactcggtctcaaaacaacaacagcaataaaaactcatacattttaaatttaaaaatgagtgattttagctgcaaaagtagaaatcaaatgttggtctcaaattggtaaaaacttcaatccagttatgaaggctttcggctttcagttaaatgtggggagaaccagtaggcaactccactgctacagtattcatgctccaccatagtctacctttcacagtattttaacttaattcaagcatctactgttctcaaaataagacttattttgagaacatttactagatttactagaaagaagttatttttctttaaattttaaaaattctgttcaacatacataaatcaaaaatctcctaggagtcagaaattgtgcctatttttaaaaattatggggttacttaaatgttatcttaagttaaaaacaatttattttctaagtaaatgcaacttctgctttgtgatgggattcaaatagatcacttgatttatgaaagttatttcttcttatagcaaactttgctgggcccagtaggatcttttaggtaacacatacatatatatgtaataggcagcaaatttgctccctaagaagacagaaagctctttggtgtgcctgttagtttctgggtcagacacttaaagaaatccaagataaccaaagcaacagtgcatttctcccccctgggaaagaggagacccaagagtcctaaattatcctgaaagaaaggcctagatgatggagaagtgggtgaaattctggaacgcagtcccaattgaatgaatgaacaattaattaactgaacaattaattgaacttcctgcacttagcccacagcagtgctaagtggcatttctggcgtgcactggggagcacactgactacctgcaggaaggccaagtgcagtggaaaggaaagtggccttgtgtttgacacggctaggtcctgttaatatccaggagtgtgcttctgtgtctgcgccagctggtcagaatgcaagagcaagaatggagcaaaatgagggggaagaaggtttggcagattggggaaaatgggaaaggggagggttacactaaaaatgtttagggaagaggagggaaaatggtggcgacttccaagacggtgctgggattcaccccaaatgctctctctgagaatgccacatttcttgtgggagtcgggagtggaaaacattaaacgcagaaactgtaaaaaaagtaaacagtgggagtagaggagtctgtaatgaaacaaattcctggcgtaatcagtttgggaggggaagagaagaatttcaattactgtgctactcccatgtccctccccaaacacacacactctccagctgcattctgaggcacttggaactcagacaactgagacggaaagtatttttaaaatctaatttacttagtccctttatttactttgtgcatgtccctcattttagacaatgaaaggacattctttatttgctcctgttttttagagctgacacaaggcagcaacgtgtgtgctctcagtcacctctctgtggcttacagatacaggaatgtgtggtggtggtgatggtggtggtggtgggttttttcctgggattctggagaattgtggccactggagtcagacgcccttgggaagtactgcctatggccaccgacgcttagctagagttgcagccctctgtctttgttgaccctgcttcagtatttatagttgagactatatcattagcattggatgacgtattgccaggtatgatttatgaattatgtaatgaggatcggtcttcttttccttactggattgccagctccatgaacccagtgataattctaagaataaccaacatgcaacgagttcttgctatgagtcaggtacaggaccaattgcaaatgttttacatggcctgcctcgataaattctcacaataatcctattgattaagaagacactgtctccattgtacagatgaggaaactgaggctctgaaaagttcaagattattcagtcactaaagtgtagtgccaggaaaataaatcagttttcttagaaattaatgtgtgtgttcatgggtagagggggcagtaagaaagtttccttatctgtaaaaatggagtggtgctacatgcctggtctacgtcaaaggggtgttggctggaccaggtgtgatcatgtgaaggaggaaccaaaccatctgaagcacgcgggcaggggtggttccctctcccactctcttctccagcaaacatacaagtcctctctcacacatggtaatccaaacacctccaattctgcactgaaggaagctgctttttcataagtctgctgctctctttagttatcacagacattaattgcatagtggatgcaagttcatttatttgacagatagtatttgaggacctgtgaaaaactagtttctatggaggatacaaacaaacttaaaacacgattccagtctgtccttgagggattgaaggtctcatttgaaagatgaaacaaacttcataactgaggtattatgaagagcatagtatttgaaccaagcagatggcgtttagcccctctaatttctagttggcatcttgggcgagtctcatatatatctgtctcagttatttctcaaataacacggagaagtaagacctccttcacaggattatacattatgtgatttttttttaatgagaaagcatttaccagttgtaaagcattaggggtgcagacctcagaacttgatgaaacactaaatcacgacacaaggcaacatagacaacaggtgctgggtgagtctggagggaggttgggttgacaggtgtgcttgtatgagtgtggtgggatgggtatgagtaggccttacagaggggatgggctgaagctgagcctggggccagggacaagaaggaagagagggcctgttttagacagaggatgcagttctgccaagggatggaggctcaaaggaagaagaacagcagaaggcaggccagcctgacagagtagacaggtcacggtgagaagtgttgggaaagagtgttgggaagaatgaaggaaaagacaaatcggggcttcggatgcatcaagtccatggacaatgggaaacatcaaaggtttcctgtgcatgaaagtggcctgattaaagcattattttaggaataataaccttagaatcacataaaggatgggtcagagagagagaaaaagagaatgtgtgaacctggaaagatgaagaccagtttgaagaacaatgagactctcagggtggcagtggtgagacttgaaccagttgtaggctttgagaatgaaaaagagagtttggaggaagagagagtgcaataggagaatgctctagacttggctactgatcaacaatgaaggcagcaatagaaaggagcaggaagtgtttagtgcctagaaaatagaagaaaaagaccaggagcagtggctcacgtctgtaatcccagcactttgggaggtcgaggtgggtggatcacaaggtcaggagttcaagaccagcctggccaagatggtgaaaccccgtctctactaaaaatacaaaaattagcctgtcatggtggcatgtttctgtaatcccagctactcgggaggctgaggcagagaattgcttaaacccaggaggcagaggttgcagtgagctaagatcgtaccactgcactccagcctgagcaacagagtgagactctgtctcaaaaaaaaaaaaaaaaaaagaaagaaaagaaaatagaagaaaaaaggagttcaagaagagctcaactcagaggaaaaggatacaaattgatgtatgcaatgttagacatacatgataagagaacatccaagtgaaactatctagatgatagcagggctctgggtgtagaacaattcacataaagataacaaggagaatatgccaagctcaccagggatgaaggtagaggcagaagatgaacacttatggggtgagcctcgagctgttccacatttaaacaacaggtagaagacaggaaacagaatacattctgtaggagtgaaaagagtgtggctcctggtgtttgtaagtcattaaactgcactctaaaaacagaacagtagttgcttttcgtccaagcctgtaatctagaactgtcacactgaggacttctaaagctgggaacatagcatgggaaagggtctagatcacaactctctgaagactcagactctcacacctgaagtcctgctagggtcccacggatgatggccttagtactactgaaatgactaatcctatgtttttagatgtctgtgcccatatgtgcaccagaaacttagttgcaatgccattgtccattccttgcttcttctttgctaatcgtaacttgctaatcgggtcagtgaagtgctgggcaccaagtgaaatacttgcctttgcagactctcttgtagctaagactggatcctgagacacagttctggacaatgacgtgtgagcagggggctgctgggagccacggaaggcttttgccctccttcatggaaggttctctgttcatgcagctaaacatactcctcatttatgcaacgtacgttaccttttcagatccacagtggtgacattgaacacgactcctttcagccagaggatcatgaagaggcgctgagagaaaggacagttgccgatgctttctccatcgattccagcctggaaagaagagaaccagtgtcctgagtgggcaggtgcaattagcaaggggaacataagattgtaacacccaaatgcaggtctgaggagaccttactaaaaccatgtcccagcaacttcaaagggcggtagcctgatattattagtttttgccttaatgtccacgcagggcaatgcctggcagcatgtaagggctcaataaatacttgctgaattgaacttgatgattatgcagaatcataactttatgaaatcatagaacccttggggtaaaaatagacctgcaacatcacttagtctgacacaaatgatattggaatgccaacatctacacccccaagtaatcatctagtttctgcttgaatatctccactgaccagtcagttgtattaatatctctcaaagcagttcattctgaggattgctctaacaattagaaatgctttccttcggctacctagccaaaatatgttcctctgtagtttaccctcccccacccctcagtccttggatgtcatgaatataaatatctcagactttgatcccatctccctatatggaggctaatcaggaagctcaaggctttaatcaatacaccacttagttctggctagtacttggccttcactgtcaataatccattcatttgttacacttttactcaacaaatacatattgactatcagttatgtgcaagacactggagaaaattagccaggggattgaaaattgaattcctccaaggagcttatggccttctgtaggtgggcttggggataagacaggaacatatgtaaaaataacagaattattattgggtgttctgtgcttctgtcatttcatttcccttcctcaaaacagtaggcttttttaggtctgaaaagcaagtccatctttactgcacttctgagtgggctgcagatccctgaatttcataaagaattaatttcaagcaaacctatgaacaaacaaaaaaggttggggaattggtctctgtagaattcatttccatagggtggtttattggcccccaacataatacttagaggaagaaataacccatttgctccagactctgatgttggctgccctggaaaccatggcccccgcaggtggcctggcagggcattccactgacaggaagggcctgtgtgggccagggtactgaagactcgtacaaagctgtaaacaatccgaccaatatccaggaatgggggcttactgagttttttttttttttttttcaaaagaaagggagaaaacaaatgcgttctcgaagctcaacacactgttttctcccttgaggtttgttttgctatggcattcagatggggaggcagcgatgccttctttcatacattagaacctcattgtgtgcttttttctaccttgcaaattgctcccagcaggggctcaggtttataatggaaaactggaacttttgacagtgttggctgcatgtaattgctatgaaattacagttattttacctccctcttaactacaccaaaagccccactccctattcagttctcacttttcctcagtgctggaagcagacccacccctgagtcttgagaaagcacggactccgttatataaaatgggaaaggtaggagggtacagtgtgggcgctacaccttcccacggaggtaaagttaccaataaagcatgctcagacaggtggctatcaatttaataatagcttggtgctaacttgagtttatgatgtacgttccctaggaacttctcaagaagcacttgacaggtaccaggttctcggtcctttaagacatcccgacacaggaagaatttccccagggccagttatggtggaagtaacaagaggagaactgaagaaaaaagcaaaaacaaaaacagaagccagatccatatactgttatctgttttcctctggtggtggtggtgggaggataagggaattgaaggaggaactagcaaaatagtggacttctcaactacataaaaaattcatataataataatgttaataataacatatctatattgtcaggcattgttctaaaggatttacatatgttattaacttgtttatttctcctgagaagcctgtgaagtgggatattttcagcttttacaaatgtggaaatggaggcacagagagataaaataactggcctaaggttatcatcgtggtgaaaccaggacgaacgcaggtggtctggctagagatccagtgctctgagctgcatgcctggagccagcctgagggtccagccaggtaacaggtcctccccaggtgctggggagggctggtgttgaattgtatggacatcctctggtcagtgtgcaatcagctatgccaggagcatagggcatggtatccttcatggctccctacattttcattatgtcttattaatcttgtattaaactatgattctgggtttagtaaacaaaaattgtcaaagaccaatagaaatatgcgaggatgctaccatttactttcactgtctgggtgtccctctttcagcttcttctattccccttcaaatcccaacagccttgcggccctaagaaattgtttgttaaactcatgggttaaatatcgtgatctgtgacgaccatctgaaacatcaacagagaagaaccaggtggggctcagttgggccccacatcctgaaaagtgtgagggaaaacccaggtgtactttgttccagagagattttgagcactgggggccagggaccggcacaaaaacagtgtcctaggttgaatcatgttcccccaaattcatgtccccctggaatgtgtgcatgggaccttattgggaaacagggtccttgcaggtggaatcaacttgaagatgaggtcatattggattagaatgggctctaaacatgactgatgtccttacaagaagagggaaatttcggcacagacatgcagaggacaaagtcatgtgaagatgaaggcaatgattgaagtgatgtatctacaagccaacgaacgccaaggattggtggcagacaccaaaagctagaagagacaagtagagcctggctctgcccacaccttgattttgaacttctggcctccagaactgtgagagaatccgtttctgctgctatcagctatactatgtatagcaatttcttggaaactgatgcaatcagggaagtgtcaaaaagacaattatatatatatatatatatatatatatatatatatatatatatatatatatataaacagctaatggcaaacttcccaagctcatgattctgctttgaacatgattgccagctataatcctaaagtacttcctgttccctagatacagtgtatataacaacttattataaaatatcatgccacatataatattccatatggtgataccagtagtagtagcataatgtaattatataggctgtatgattgcacttcatctgttatatgctggatacttcatattatatgctattatatattgcctttcatgtgagctctctccatatatgatgagcttggctccctcaaaacatagttgaagttttatttactttgtcttcagcagcaacaagcacaggcacctgaaacttactttatattcagtgcctatttaaatggatgcatgctgaggggagggtgatgtccctccctttttgtggcttgaggatctcaaaattctctcactgacattctgaaaatcatcctaaaatacatgcatacatactacatacatacatacatactacatacatacatacatggttaccctgagttatgtagcacactagccggagactgtggttctagatccatctctgcctctacttcactatgtgaattaccttagataagttaccccctcttggcctcaaccactgcacctataacttcctgcaattttgtaaattcaagtggaaaatggagatttatttaagaccgcggttctcaaactttttagtcttagaactcttttatgcttttaaggattgttgaggatcccagaaaggttttgtttatgtggatgatagttattgatatttaccgtgttgtaagttaaagctgaaaaacatttaaatatttagaaaaatgctataataaatgtgtctattaacatacacaacatcttaacacaaaataactatattttctaaaaacaagaaatttagtaaaagtggcaatgttttatatttttacaaaatctttaacatctgacttagtagaagtcggcttccacatttaatctcttggtatttagttggggtatatggggcttttgttgttgttgttgttgttgtttttgaaacagagtcttgctctgtcatccaggctggagtgcagtggcgcgatctcagcttattgcaacttctgcctcccaggcagtaaatactgacaaatattaagtctgagtaagcatggtgtgtcagccagttgctctttcaggtaaaaactgctttgtgagggaggcagctggttcagctggcaactcaatcatacaagtgcttttccttccacaaccatcagactttggaatgcagccaaagagcttatgtgcatttcccatttcatcaaccagaatgtttagaagacatgtatgcaaaggttgagatttaatcacattatataatttttaatgcttcatcaaggacattcataattgaggctattttttttttctgcacatgcatgactggctagtcacacttataccactgcttggatttgtgctgaaacactagtaaacttacccacgaaataccaatcccagagagagaagcataccatattgatataactctaaaaatagttgtgacctcttaaaacccctgaaagcctcttagcgaccccagaagtccatgaacaacattggagaaccattgttttaagacattccatgaacacaccagatatgtaatacttggtttccagataatgaaggggaagctgataattggccaaaagtcactcgcgggtacccaagtccagaagtgggaggaatcattcagagaggatccaagaaggaattatagaaagtgaccagatgacattgaagcttgatagatgagtcagttatcaatttattgcctttcagctccaatgcacccttgaatatatgctctgtgagaacagggggaatttctttaaacatttctcctttaaagtgagcacaaagttaggctttctcaccagggagaactagaggggcactgcaggaggaagaggctttcttgctggctgtggtgtgggctgggggtgggcagtgtagctgtgagggcacgcagtggagccaccccagctataggctcagcatgcaacccccctggcacctcatagcctcagcctggcaataaccttcccagcactcttgacacagaaaccaaagtccccattaagcctatgtccagtcggcctatggccagtgtgtccacacagcttggtcaccccctttgcaagccccacgtgtcctgaaggccttcttctccactaacacctagatcctgctgcatgctgtaccgatgctgattgcctgctccctgcctgaactctggggagtgggctattgcttgctcagcgactccagaccagctctggcctgatcaaaccagtgagtttctgtgccaggttccaaaccacttctaagtttgtccttccctggctcctctccctcagccctagggtaccatagagagtttccttatatgtcatggttactcttttatcttagttaaaacttcatgttgaatttctcctgtttaagctaccatgtagtttctcactcctgattggacccagactacatcagatgcttaaatgtctgttatttcaaaatgtaagatttttgtgacctttgacttctttaaaaacctggcaaggttaagtcctggatgaagtattaggaaagaaacctcagttttctcaagaaagataattaagtcaccacttacgtcacatttccactttttgttgctgtcgcccatgaaacttgtccctgaggactcaagtgattaaataattttgttaagtgtacagataaaaattaagcaacagtagggctgtaactgacctcaggaatgctatactccagttctttctttttactggtagagaaatagacccagaaaggttaaatgaattgcccatggtagcacagctggttcccatagcagaatcaggtctctctaactcctgactctcagttctgagcagaccacactggctgctgtcctctagaaaagagtgacaaagtggcaaaggccacatgaaaaggactttctttaaacataatagctcatttaaactgtttagacaaagaagctttctttataataatatttccagctgcccattttttaattagttagtgtaagtcagacaacatttctagttgtgactattttttttttaataccaaacagtctatccttccaataatttggttggcaagacttcaattagcagggatgggacttggtggtacgtggtccacatgaggacagagaggtctacccttgaagaaatcaacatttcctttctcagaagccacaaaaggcctaattcactggggtcacccaggcatttttcattcaagaaacaggtaacaggtatacatttgaggctacagagatcctcaacatttatctaaagtttaatgtatgggcttaattagctctatgtagaccactacctgtgcaatgtgatatgaagaattctaggtatattggtcagagttctccagagacagaaccagcacaacatgtatgtgtgtgtgtgtgtgtatttatatatacatacacatatatgtacatacacacacacacacacacacacacacacacatcctgttatatctactatatatggagaaacgtatacacatcttatttttatataatacattataataacataatattatatatatgtgtgtgtatatatatatacacatatatataatacatatcagttggggtgtgaagagagagagatttattttaaggaactggctcacacagttgtggaggcttggtgtgttcagaatctgcagggtaggccagcaggctgaagccccggggaagagccgcagttcgagtccaaaggcagcctgctggcagaattcccatttcttcagaggagggggtcagtctttttttctatgaggcctacccacactataaagggcaatctgctttactcaaagttcaccaatttaaatgttaatgtcatccaaaaaaaaaaaaaaaaaagcaccttcacagaagcatccagagtaatgtctggtcaatatctgggcactatggcccagccaagttgatatataaagttaaccattacacctggcatatttaaatattttacttgattcaggtaacctattaattcagtagctgtcatctgcaccttagctcaccagatggttttgtaaacaattgaatatagttgtgtacatgtcccctcccaaaagaacttgtaggctccagacttagcgggctccttggtttacgcctctaagtgagcaggatccagtggtgcctttgatgcataactagcctggtctgatggtggctttgggcccaaggctgcctacaactttgtatgttgcacagtgccactgtgttcatggcccattggggtgtctgtcctttagcctgccttgagctttacgtccatctgccactgagtgtatgttcaccctcctgtgcttcacacactctctgagaaagaactgccctttccaactcatcaccactgtcccttctcccagccccttctttctactcctacatggcttcttttctattatttcatgtcccgctatttgaataaatgaatgggtttcttttaaacctcttgccagcctttcttctatttaacaacttctgaaattgttgtctttcaatctgtttccgggttaatcaattcttttttttttcctttgtgtcttcatcctacctgatattcgtcttatagctaaaacttttgattatcctttcttcttaaagctcagccatctgcagcctcccttgccacttggtgcctcttaggtgggaggagccagcttaacaggcaggcagtctgtgcagttgcatggggccccattaaacttggtttaatgctctgctgttgctatcctgaaattcttaataattttggagcatagggtccctcattttcatttggcagtaggcactgcacattatgcactggcctgcctgtggaccccttatttttcttgctgacatcctcctttttctggcatttgccctctcagctcaccactcttctcctccatgcttggtgctctttggagaacttaccttgagaacatgactgtccttcccaagtcagcaataactctggcttctaggcctataaacatgctacttaccctaagcttaaaaaaaaaaagtagaaaggaaagtcagagaaggaaagaaaacaagggaaaatgttgaaaggcttgcttggctcaagtctcccttgttggttccacctcctagcctatctcactgcaatgtcatatgttattctagaatttgcctcatttcaattaaatatcttgccagttactagatacttgaggttttcttataagtcagacaatatgccttgttattactatttttcaaaactaaatgatctgaccttccaataatctagttgctatgctccattagcatgaatgtgactcagtgatttgttttatttatctactctcagaaacctgtaagtactcaagaaatgtaagactgatggccttggtatgtcttccaagtgattccaccaatcttgggaaggaagaatggttctcatatgttaatattatcaaccttcaccatgccttgggagagcccaaagtccacactctctgcctccaagtttggctgtttctgctcactagcccaggtgtaatatttaacagctaaattccattgcagtagaggcagatttcagtcctcagcttcacagaatactgtggtacagtattaagggcattgtatagactcatgcaaacctgggttcaaattcctcccctgacaccaaccagcagaaaaaatgtctgcagcactatttccaatcccgtatgtccttcataacctttccacagccccagctagaggtggagtccacatttcccttcttcttaaaatagggcaggcttttgtgactgcctggatgaatggaatatggcagaagtgacacaatgtgtgacttctgagattaggtaatagggggtgatacagcttctgcctgtgtctctctctctgtctcttttgggatgcttgcccctggaacctagccaccatgttgtgaggaagcccagagcacatgaagaggttctctgtagtgttccagctaatagtctcagcaacgttttcagatgacagattgcctcaacaaccagacaagagaatgaatgagatttcagattattccagcccccagcttttgaattgtcccaaatgacatctagtgaagtaaaattagccattctaaccaagtcctggccaaatgcaggtttttgagcaaaataaatgttgttattgtttaaaaccactaagttttgggctggtttgttactcagcaggcaactcacatacacacttagcttcaggccccttatcttcaaattggtggcagagttgtataattggatgacaatatgtataaaacatatagtatttactttatacatttacagctactgtctttatggccgcagaaggcaaacatttaggaagagcttgttaaacaccctatttatgaaatattatgccttgatgaagagtcaatagacctctctttgatggcacaaaagttcaacagtacctagcgttcagggttttgtgtatgaagcaataaattcaacaaagaaagaaaatacatgaagaactacagctattgttcattggccagaggagagtgttcctaaactaggtcagtcatgcatttactatgaagggagagagggaaaagtgactcatgtttggttaactattggtacaatgatagatacatgcatgtctgttctctataagactattgaatttctgtgaaaagcaacaccctccaaccaaacacctttttcaagtagttcaagagtcaaagatgagaagggctggaacccaaggaatatagatggttgaagctaagggatcaggtccgggacagattcctggaagttttctattgaagtttattggaagcctttgtgttctctcaacatccggaaacattttcacagctctttaaggtactgtcatcctattctttagacctgattaaggctctcaatgcttggttcaggaaagttgaaatctggaattcttccacctcagaaatgtaccaaaacacaggaaaccaaagagcaatacaaatctatagcctcaaataaacagaactcctttccacattggtataatttgaagaagaggtctcctcacttaagcctcccttggagaatccccatcctaatacaggaaatatgttttccacttaatgaggccactgtcaaaagctttgctttcctctcttgacatttttcttatttgttatccaagatgctatggaaattaatggcagctcttgatcgtgaatccattccccctatatttaaggaataagcctgcaattcctataatcctcataccaaacaaggatatcttgatattgagctctgctactcctacaaaggttggtgtttgggatcctgacatagctgagattcctcaattattactcatctgcccttctgttctggttgtctgaatgttgagttttgaatatagcctcttaataggataagctgggctggaaagactttagagacatcccaaaatctgtcatcctagctctctgttggcttcaataatcactcatgaatcccaaactcaaatataacaaattgaaagcttatgacactaaaatgaaatctgagtcctgaggtttattaattagggtcatgtacatctgagaacttatgaaaaaagtttttgcaaaattactagtttatgatatgtcaacaaagtatgtttttagagctcgaaaattccacacaactaagcattttaaaaactggaatgcccaagccccactctcagatattctgatttaattagtctgggggtagggctcagacatcagaattcttttccctcaatgttctcgaggtgattctaatgttcagtcaggactgacaacttctgacctagtggtgcccacagtgggagatgtccaacagaatcaccaaaggagcttgttaaacaaacaaagaaacaaatgagctccctgacctcactgtagacttgcagcatcagagtctctgggctcaggagatgtgtgacgggctggaccaaccaccgacagtagcacttaggacgttgtttctccctcctctttttgtttcctttttccttacctaaactggaaactccttcacatcctggccccactcctacttcccaccccatttctacactgttcttcttcaccttccatccctgcacaggccctgaaagaagtgcaccattttgagttgttcagggcatggagagcccattttggatcaagatgtctgaagaacctcaagtcaatgcagccataaacaatgccaagaacttcacgtgccaactgatatttttatggttgcatctccacacagaactcttaagttctgccaggtgggtcttccctgagggtgacagagtgtgctgtgaccgggtacagaaaccctagtcactgggctcaagttctcatgtggtcaaccacaggccatatgtacccaaccacatttgttctctccagccaccttcctctagtcagccatggtgaaaaatgtggcttcttaaaaaatgcagggtcctcataaggtcctgttttgggctttcttggctgcgtggagtaccagcaagctgtatctccactctcaactatatgcaggcacttggccacttgggcagggtggatccacacagccagatgggcatctttaccaagggccagcttggttccagagactggggatgtagtgatgtggtgatgaaagagacatggtccctctcttgagaagctatcacacaacagaggcagcaaaaggtaaagacatgatggccaggtcatcactgaagtgcagtagtagtagagaatgggtggagtggggacaggaaggagcccacctaagggttcacggaaggatttggggcagcaacaatgcctaatgtgagcctcaaaggtaagagagtttattcatacaaagtggcaggtaaggccatccaggcagaagtgatggcataagcacatgcctggaggctggattgaacaatgcaggtgtattaggctgtttttgtgttctgtaaagaaatacctgagactgggtaatttatattgaaaagagatttagttggctgatggtcctgcaggctgtacaagtgccatgccagcatttgcttagcttctggttagggcctcaggaagcttatgatcatagtggaaagcaaaatgggagcaggcactttccatggcaaaagcaggggcaagagagagagagagagaggaaccaggatcctttaaaccacagctctcctgtgaactatcagagcgagaactcactcattaccatggggagggcacaaagtcaggagggaaccaaccccatgatccaaacacctcccaccaggccctgcctccaatattgggaatcacatttcaacatgagatttggcggggacacacattcaaaccatatcagtgggtgtgcagggaattccaagcagatcttcttcatgctctattaggaaaacccatgcagaatttctctagttccctttcttcctccattctgaggaccccagcctagtcacaggcaaagccataaggcagtcaaatgctcatcttctgggggtctctgtgtcttcccaatctgctatctccaccatcatgcatctctaaacccctcagccactcttggccagcatgcctctccccacttgtatctctcaatgccaactctgaaagcattcacatttaagtatgaattgttggtaactgctaagcacttattcctcctggggtacttttatttatcatggcccagatgtaagcaacgagatgaagcttcaatagtggggttgcaggtgtctgccagaaactgattaaagaactgggaaagaaggaagaagggcaacaatagcttcctgggggtcctgaaaccagacatgtaggtttttatctattatctcctatgtgagatcctgccaacttgttacttctgcagctctgaaaaactagctcacacaatggatgccccagaccaaagggcaggcactcttatcacaaaactgccttaatttccatttaaaattttctatttaaaattacttcaaggctggttggaagggcaagacttcaaaaacaacacattcctttttaattaattggaggcgggtgactataggaatgttttagctttgccgttaatatgagtgctatgaatttgtaatagtgacatcttcctatacttgtgcagtaagatgtttgttagcaagaatgtttggagaagcaagatgttccctggtgaactgaattccctgggtagccctttaagcaatttggggcaatgtaataaaaagcagaagattaagagttctgcgttccagacctagttttggcacaaagagttgtgtgacctagggcaagtaattttccctctctgggtcttaatcttgttatttttaaagtgaataaattagaaaagatgggcttgaaagacactctgttcctaaaatgtggctaggagaaggtgaaaataactaaatcttttatttgcacctaaaaattccaatggctgagtagagactccacaagctactacagtcctctctcccagcaccatgcatggctcacagcacgggctggataaatgtttgccgagaggatgaaagagcttgtggactagcattctattctgaaaacacaggcagctggatctgcaggggaggggccagcactgtagattgcaaggaaaatcaggccacaaaggaagaaccacctgtgaccacctttgctagctgcttctgggctctgccttctcacaacttctctgtagcatctttccatagtattctcagcaccttaccttaaaaagcagttgaagaagcaccctttttggaaggctgtccccaccccatgtccccgcccccaccccctcctgctctatccaactccttcagactagggcagttgagatccaaagacttcagatgacttttccaaggccacatagacgatcggtagggatggagtttgctattgaatggagatggctgaaatctcagtcaaaatcgtgaacgtatgtaatttagacataatcagggaagacaggaaaaacagaactgaatcctttggaaagtcatcttcgagagatgttcctgctaacccttgcttatctttcattttattcccttaaaagagtaaactgctgaagacagaggaagaaaaatcctgccttgttattgaatggtatggattcacattcacatcaaggtttttttttttttttttttttttaatcgtggaggatttactcagggtaaagacagaaagccacactcctacgacaggtcctgagctcccaggggaaggatagaagggaagctgtgtagctgtcttttctcactatgttccttcttctcccgcctagggtgattgggaggattaggggagataacacaagtaaaatgggggcgcagtgcctggcagaaagcactcagtgcatctgccatcttcaaggtcactctgccctctgggcccattcctccttcctccctctcctcacccccagccagcacattaaaggtcacaggtctggagaaagtccttctctgccactgtgcaacagggaaatgtttctcccagccaagtgcccctgtcatgtgggcccacccaactaatttcttctgagcccctatagaacttacagtgaagactgtggttagtcctggatgattatatcttctgctttagaagggagctttgaaaacagcctcacaattacagaaaaaaccaagccagtttttgtgtcaagaagacccaatttcgttttctcagccttgaaaaaaaatcaatttgaacttgctgctggctgagttatatgttcaagctcagaccgagctgtaattggaaaggagtctgtcttttgtaatccccaggccaaaaggggaaatgaaaatctttttcaaatggcagagtaaggcaggaaatgttctctttattgtactcccataaaaaaataaacctacccagtaattataccacacacacacaatagtccaggccctcacccaggaagccacaacctgagatgaaggagtcagtggttattttcaaaaagggaatttttccaagccctaccatattttctctcacaagttcctttgcatttacaagagacagattgcccaccctgcttttctgcctgactggtggaagtcagacaacctgcatactggtcccagttgttctgcaagatgaatgtgcccttgagcaagtcactgtctcgatctggcattctgcacccttacctatgaaatgaagggacaactagacaatgcctacatctgaattctctgattctctttatgctcacttgttcattgggcacaaaggagtcagaggtgatccctgcttatgaaaagctctaatgtaaattctccactttatgtctaggagaaaaaactgaaagtggccattataaaaatacaaaactgccccattggtggactccaaaataaatgaggtacagaaattgttctttttcctctactggatcctttctgtaagtcttagaatttgctatgatgctcttggggcattcaaattcacaagcacaaaaagaactacattttgggtaccacattctaatactactatccacagagtggattcctcaaatcagccatctggtatatagaatatgtgaaaatgcatttccagttctagcagagattgttccatccataggtctagagtagaagtatatgtaatcgttgacaatcaacaaagcatatcacttatatcttatttagtttgaaggtgccgaacagggttgttgtacatgtttttaaaaaaattttattatggtcatctcgtctccacccaaacccccaccaaactatttctaccctcttaagccagggtgagccaaagtcccaacctttcctttacgtacaagacccacctaaggaaggaagcctgctattgttggactatgtttagaacagatgatgctacgtgatgaacttcgagcattaatgacagatagtcttctagatcctatctaatgtttaggatcagccccttcaaattgttttttgatggagcctcaggaatggcaaagaaacattgcaacttgtgcttcatctgccaattattgaaggaggctgctggaaacataatatagaaaattctgaggtctcaactaggattcgtaggacagaatgtaagcattatttggtgatgacatgttttatttataaagtcaaccttagatgcaattctgctgactcttctacacagagaagaggcctgctgaagaattaaaagataagaacaaagctaaaatgagaagcataattttcccctatgtcctcctagttagctcttatggacctttctgtaacatgagtttcttctactaagttgtaaaacagatcctgttttacttttctcttctcagtcctatgatacagttcagggccagacacatttactctagttgttcaaaatgtagcctgcatgaaaagaccagtgtctcagagacataccaaagggcagaacagaaacaaggcttagaaacaaatttaacataagtagagtatgggtatcaaggacttttactgtatagcgcttgcaattatgtgattagctttcagcaagatgtgttttctctctatcttttcaaccagaaaataatttaaaaaacaaagataacttgaattggcctcaaagctgtctccatccctgtaattgggaataataacagctgcccacctacttcacgagttctctgtgaggatcaaaggtgctctgaaaggatgacatacaataatggaacctaccactgccatatcctgtcttctttgttagtggattgaaattccagctagaacacaatgtcctacagctccagggtcctcttgtaagtttatctctcaatcaagtctcattaagagctttttatctctcccctggaactcccagaaaaggccctaagagggatagttttcttgttaggaggaaattctgggttgtctgcagccttgctgctcaaagtaggtccacagaccagcaacatcagcatcctttaggagctcattagaaatgaagattctcaggccagccccatacttactgaatcagaacctgcattttcagtaagacctctaagtgatttatgcctcttagtgtttgagaaggctggtcttcagaacctttgcaagataaaggcctcatacagcaacaatcggaagacctttaaaaccgatgcattgggtcagtgatagccagcttttctttttcatttaaaaagtgcatctttgcacatccagatttcacataattcttggttaggaaaaacaaaaagaaaaacaaaaacaaaactccactcttgttcatagtaatctggccctactgggttctaaaaatgtcagtgaatctctgccaaatttccatacctcgtgcagaggaggagcctgcttgcaaataacaatggcagccaggtgctgaaagtggacactgaagctgaaactggagctgaggttaaattatttattgaaattccatgacttggcttgtctgttagaagccaaccaaacctagagtcactgagcatgttcatctcgaacaggccccatcctgcaccccctgaagttacctgcctctttgcctgtgggaccagtcagatgtcggaccctacctccaggggttaagttatggaaacatgacatggctgggttagtaaactgggctctctaaaggtgctgtcctgagagctcctgatgcccatggctgagcagttcagtggcttagcagtctgcctctgtgcaacctctagttcatagaaagcctgcctgttgcaggaaaaataactcgcttgcagctaactctttcttttcattttttaaaatgaacaccctttgtctcagggtttctatttgtatgacagagagaaatgtgtttttttgtgggtgtttttgtttgtttgtttgtttttgccaaccaacatcccaatatatataaaatgaattaaaccctgtagatatatattccttttacaatataatcactaatatttgatcctcaaaagcaaaatactatgaaaacatgttcatcaatagcagaataggtggccgggcacagtggcccatgcctgtaatcccagcactttgggaggccgaggcgggcggatcatgagatcaagagattgagaccatcctggacaacatggttaaaccccatctctactaaaaaattagctgggggtggtggcacatgcctgtagtctcagctacttgggaggctgaggcaggagaatcacttgaacccaggaggcagaggttgcagtgagccgagatggcgccactgcactccagcctggcaacagagcaagactccatctcaaaaaaaaaaaaagcagaatagttgattacaatgtgatataaccatatgatagaatagtatacagctatttaaaagcatgagtttgattcttatgtattattctagagggagtgtcacagtaggagaaaaaggcaaatgacaaagtaataagaacagtgtgatccctttttgtatttaaaaacaaaatcttgcatgtgttcgtattgtacgtgtgagagagaggagaaatatatatagttttatatataaaaccaccaggctgggaatcagaaatcctgggtttctgtccttatgctcccctgagaagtgggggctgctcatctctgggcctctgacaccttctctgcctatcagtcagagtgacagcaagagtcaaatgagaccatgtgcatataagggctctgaccagtggaagtgattatagcttccaggcacctatggaaagatgaaggttaatataacaattatatttatatatagggcagaatgaaataaatggtaaataggagactcaacaatatgtttttcatgtcttgggaagcagtgtttactactgtgtgtgtgtgtgtatatatatatatatatatatatatagagagagagagagagagagagagagagagagagagagagagaaagagagagagagagggcatgccatagagaggagttgagggcaggacctgatactgataacatcagtttcttcaggtgggtgcattcaaggggtgtgtgaaaggagagtcttcatattttctttatgtggtttcaagcaaagaaatatttgaaacccttgggaacagatgtgtttcaaaattcaaaatattttggaatgtagaaaggtaacatgtgtggatatatatgtaaccccatccccaccccctgcaggctctgggacaccacactgctgtaatcaagtctgttataatcacatctccacagcaccaagtggggcaaagatggactacaaatcatctctaaagttcaaggaagttttgcctcaaagtgaatttccacaaacttatgaaagaacttacagttttcagagctttttgaatttcaggattacagataaagaattgtagacctatatatttctttaaggtttgagttgtcacagtcatcttgtatttttaaaacaaataaagtaagctaaaagggaggtgacaaaaaaagaaagaatatatgaagaggaaaacccctctgatctgcccttgggtccctttacttgtgcctccaaaggctctgatttagaactggagagtgagcaggatgtagctttggtgaggcacactcaggggtcggcctgacctggggactggaaaccccagcaaattcaagcccactagcctgccatgtagcagatacaggagaatggcaaataaagatgaaagaaagacttttaatgaaatagaaagtaacttaggtgccaaggagtaaccagatcctaaagtgatgcccacgtggctcctgtcattcgatatgcaactgaaacaaaagtatttctgtcaaagttaaaatgtatattttaactttggccaacagtgactgtccaacacatgtatagatggcatcctcagtccagtgtgccaggaaccagtggtgccctcagattctcattggggcaggcaagtgcttgtttctgtctaggtctctatcaatatggacatttattttaaatatatatgtatatagttatgttgctaatcttaaaaaaaatcttgaaatgtgctttaaatccaagtatatcagattacaaagaacaagacaatatgttacctgtcaatctctaaggtgcaactgctgtacaacttgagccaagttagctggagccttcatttctcttactatgaaataggggtacagtaccattcatcaccctcacttgaaaggtatacaatataattaaaaagtgcttaaaagtctttggcttaatttatgttgtaaattataaatagcctatttctctatgttatataggtaaaggaccagggcctgaatgtcataaagagaatgtaaatgatcagtgatggaaaaaaaaccaccagactgggaatcagaaatcctgggttcctgtgctgatgctcccctaagaagtgggggctgctcatctctgggcctctgacaccttctctgcctatcacaaagagtgacagcaagggtcaaatgagaccatgtgcatagaagggctctgatcagtggaagtgattatagcttccagtcacctatggagagatgaaggttaatataataattatattacgtatacggcagaatggaataaatggtaaataggagactcaacaatatgtttttcatgtcttgggaagcagcgtttactactgggtgggacatcggaaaagtgtcctttcatttttattattttcttggtagatttgttttttgtctgcttgtttctttctttgttaaatgtgtagtgtgagtagacatcccagcttgcctaggactgggggaattccaggactttcaggatttaaaactgggaaggtccctggaaaactgggatgagttggtcactctatgtacatgcatttctactttcagaaaagaatttgaaggcatggttagacatagaagcttacatttaataaaggttggtgcaaacgtaattgctgtttttgccattacttttaatggcaaactcattcatacaatgcccatgcacagacagactttattcaattcaaagcagttaaaaatgtcaaataaccccttcttagtacttttggttcatcgtactacagttttgtccttcactggatcaaacgtagtgattctcagtattaataatcactccagactctgtctaaatattcaaatgggtaatggacattataatggcatagacctatgaggtttcctaacattaactagaatagacaaaaggcagcttgtcggaaaataacactaacaacaacaaaagggatattgctgatgctttttagggctggatgttacgtgtgtgctgtatgtatgcaatgtgcatattgtcttcccatgtttggttgacttttcattgctaaatgagcaatgtagttcatacagatctgcccacatatcaaaagaataaattatttcctttcagggctttgtcttttgcaagaaagtggtgtttaaactatatagttgatttataataaatatttgtaataaatatttattttaaataaacagattgggtgattatttttatttcacccttgaataacaaggattatagtaactttttcattctttatttttgactttgtggccttttggattttgcatgctttttcctatgactccacttcaggtgtttatagtgaaacataaacctctttttatcaaattccagtgcaagctttaatgacaagcatattgtaattattcttgctacattcaaattgtaatgaatcaaaatggtatgtggctttttttgaaagatgatcttttagttgctatttcaacaaaccccccagatctggagcccagctaccttccctccatcttttgtaaattaaaaataaaaaaatggatatgatacaatatcctaaattatttctttggcccttttgagcccatactcagaaccctccaatgactttgcactaataataggataaaattcaaactccttgagctgcctctcagggaccctttctttttccagggttataaattctcccctttcaagacctcttcccctgcctcccctcccctctaggcaaacagcttgcccacctcctctgactaggctcaggttggctatgtctgcacttttgttcatgtcatttctctcttttggacagcattatctgtctctactttcaaatactaactcagaccccatcttccctggaaatcctcttcagactacttctattagaattatgttgtgtatagttcatttcattcattcacttgacaaatactaaacatcaacaatgtgtggggtgctgttctaggtgcaagggatgcccagtgggtttccactcagcgtctttccctgtagcttgctgcagtggtggggtttttctctggaagcaacagagcaagaagacaaaagacaatagcagggaagctcctgggctttgggtctgactaggctttgccacttactagggttgtaatcttgggaaagtttcctggcttcagtttgctcctcagtaaagtagaaatatggtgtggtacttaaaaagttgtggtgtgaatttattgtccatgtaaagcatttagggatagtttgtggtgcaaaataactgctcaataaacagcattacattatgatcttatacctggtctgacccatctatggtgccttttttcccctcagtgctttccatatccgagaacttagtgttgggcttccttgtcattgtgtgataaaatactcttctctttgactggggatggctaacaatgagtgattcctgagcaggaatcgtaagctttccaataaaaatatatgtggggattcttaaatattttaaatatttcagtgaaggtctatggggattctaggaagtattcaacaatatttattaagaacttctagaacagtggttctccaatgttagcatgcatcagaaccatttgaaagccttgttaaaacacagtaggtccagggtggggcccaagaatttgcatgtctaacacttttacaagtgatgctgaggcttctagtgtagggtccacacttggagaacatctgtactagaagttgggattgaaaataattatgaggctgggcgcagtggctcatgcctgtaatcccagtactttgggaggctgaggcgagtggatcacctgaagtcaggagtccagctgacccacatagtgaaatcccatctctactaaaaatacaaacattagccgggcatggtggcacatgcctttaatcccagctacttgggaggctgaggtaggagaatggcttgaacccaggatgcggaggttgcagtgagccaagattgcaccattgcactccagcctgggcaacaagagcaaaactccattaaaaaaaaaaaaaacagaaaataattatgagagagctgtggatcagccttccaaaggagctcaacagccagagtttgaaaaaaaatgcacaacagggtgggatacacaacagccacggaccaggttagacaacactaagtggagccctggttccattattcactgggatataaccttggacaagtcatttacctcctctgagctttgttttccttattcaaaaatgttagaataagaatcttccctttatatctcacagtgccatgaagacccaggacacatgtattatatgtgctaactgaagaccaatcttcaaagttcaggggaaggggcatttcctcccctttctccagtccaaagtaactccttgaatagacaagagaccctctaagcatgtcacgttctttcctcattcactaaggcattgttcaatatcttaaagactgaactagctgaatagattccctggtaactcaaaaccttaaagcagctttgaattaagagcctgtctctgggaagtgacatttagggaaggtccactaaggctatgtgggctccacccactcttccagccttctgccttgtcctgaatcacattgggctgacaagattagatattcctactgcataagattagcacctgtgaaaaatcattctccttgaatcacattttaatgccctggcctcagtttttacagttactagatgaaataatcacccaaaatttctactgcattttctatttaaaaaacgttgatggcattgttcattatatttttgagtgatccccacacactacttataaaccattacatgagaaatggccttttagacctttgtgagatgcatcatagtatgcaaatattttctcccgttctgtaggttgtctgtttactctctctgttgatagtttcttttgctatgcagaggttcttttagtttaaccaggttccatttatcaattttttatttctgttgcaattgcttttggagacttagtcactttttttttttttttttttgccaaggttgatgtctagaatggcatttcctaggttttcttctaggaattttatagttttaggtctaacagttaagtctttaatccatcttgagttaatttttgtatgtggtgaaaggtaggggttgagtttcaatcttctgcatatggccagcctgttatcccagcactgtttattgaacagggagtcctttctccattgcttgttattgtcaaccttgctgaagatctggccttaggcatggggctttatttctgggttctttatcctgtttcactggtctatgtgtctgtttttatgccagtaccatgctgtttcaggtagcaaataaaggcaggaacataaaaccaaatactgcatgttcttacttataagtgggaactaaacattgaatacacatggccataaagatgggaataatagacactagggactactagagggggtagagtgggagtggggtgagcattggaaaactacctattgtgtactatgctcactacctgggtgacggtgatcatttatataccaaacctcagcgacatggaatttacccatgtaacaaaccagcacatgtacccccaaaacaaaaataaaagttgaaaaaggagagagatggctttagaatctatcaccacaaagaaaagaatacttaatgttaagggaaaatgctagtgataaaatgttgtgaatagagcatgctgcaaaatgtatcggttgtataattccaataattaaaaaaaaaaaacctagaaagaaaccaaaacattatcagaagttatctaattacttttataaatagaaaaaaatatttttcaaagtaattcaatgacagggaatttcatcttctccaagaaattgtcttcttccactctcaaaaagagaattctataactcattgtgtcttttttccctccttgccttcttagaagctcaaagatcattatttgaagcatgcattgacccttattacaggttcatttagtgcttattttcattttctgttttgttttgttttgagacaagatctctctctgtagcccaggctgaagtgcagtggtgtgatctcggctcactgcagcctcaacctccagggctcaagcgatcttcccacctcagcctcctgagtagctgaaactacaatatttaccaccaggtctggctaatttttgtatttcttgtagagatgtggtttttccatgtttcccaggctggtcttgaaacctgagctcaagcaatccacccacctcagcctcccaaagtgttggaattacaggcatgagccaccgcacctggcctcattttctgtcttattgctatttcattttacacgtgcttactagatgagtagtatctacttatataatttctgaaattttgaaacatcctgaactttttacaaactaaataaggagccagaagtaagtgatatgtaagttccaagaaaattaaacaactagcttctaaatatacctcaaaaagtaatgtggtttctcaaggcttgtgctttgcagtgggcaaatctgatttatatatttatcaaagaccataatggatattacattccttttctgtaagcagttgatactcaatgagatacaatgtggactcccttagttaccacctctgtgggggccaggcctaggtgggaggaaaaccttgcactttcatattgctgttcagttttggtgggcatctaccaagggaaccactctggaggaagactctctgtctgatgaaatacaggggacaggccaggtgcggtggctcatgccaataatcccagcattttgggaggccaaggagggtggatcacctgaggatcaagatcagcatggccaacatgatgaaaccccatctctacaaaaatacaaaaaattatccgggcatgatggcaggtgcctgtaatcccagttactcgggaggctgaggcaggagaatctcttgaacctgggaggcagaggttgcagtgagctgagattgcagcattgtactccagcctgggtgatagagggagactccatctcaaaaaaaaaaaagaaaaaaagaaagaaatataggggacagtcaaggatgacactgaggttttgatcttggaatgttggaagatggcaaagacaatatgagaaacgggaaatgtgagggagctcagctttaggggaaggtttctgtgtaagaagaggtagctgtagaacctgtagtttggaaaggtgaacaaaccttggacacctaaccatgcaggggctgtgattcttgtcctgactccatcttatcagtttgggtcacctggggcctgtccttgctgctcctgcttgggactcagtgtcctcatgaatcaagcttgttcatctctaaggcatttccagtcctttcagtggatgagttcatgatattataaatttttttatacagtcacgaattgcttaataatagggatgcattctgagaaagggatctttaggtgattttgtcactgagcaaacatcatacagtgtacttacagaaacctagatagttccagcctactacacacctaggttatatagtgtagtctattgttcctaggctataaacctgtccagcatgttgctatattgaacaccgtaggcaactgtaacacaagggtaagtgtttgtgtatcaaaatatagaaaaagcataataaaaatacagtattataattttatgggaccaccgtcttctacggggtccgtcgttggctgaaacgttattatgtggtatgtgactctgcaactcatgagacattttacacatggagataaagacttgggtcaactctgtttgtctcagattgcatggctgcatagatgagtggttttaataagggacatttaagaagtcaatgattcgcttttagtactgactgacacttttatctcttttctgggaatcagtctaaatggcatgaatttggagtttgtaagagctgaaaagaataatgagaaatctagaaatggaataagccttggtaaaaggtgagaaacgattcaagcataaggtgaattactaaggctggttgcctacttttatgagctgcacagggaaaaggccacaaggtctgggaaatggaagaaaatgaaatgccaataaaacaaaggaggtgggcttccttgtaacgtacattcagtgagagatcataatgctcaacaaatctgttaaatcctcagacctctgcccagggactttttcactgcctgacctcacctgatctaaagttcatgcagcagcacagggagggagggtgagaggaatgctggggaggacttggatagtattcttactaggaagccataaaaatgcatatattctgggacagggtgtgtgctgtcatgcacagagccaccaaagtgtcatcaaatgagtagtgtccctatactacctagtgggagttgggtttgggtaagtgatgtcaatatacagccctcaggacaggaagaggaatgcttggcacaagacacaccattgagaagagttttgtaacaatcggttggaagagcgattgtggcattccttatagctccgctctggctaccctgctcctgcatatcacggccttaggagttacagacgcttgggatctctgagaagacacatagaagattcaggtatggactggctggcatgtaggcaacaggtaggacaaggtaggttgggggaatgcctgtgtaaagagagaatatagacaacccttcattcattcattcatttaaatgtatgcacacatccattcaatcaccaaatatttcctcacctggtaagggctaagaacctgccttcgggcctgaaatataatgcctttctcagataagtcttttatacccttctcccatttaaattagtcctccagttatttccttaatagcactttttatcacctgaaattacttgacttatttctttatatcttctctgtctcatccactagaacacaagactccttaagtcaggaaccatatctcttttgttcactgctgtagtcccagcactaaaatcaatgtccagcacatagtagggcctcagaaaaaccattttttgaaagaaaacatcatcacagagatgaatagaacctaggcccttcaagaaaagagtcaaagagagtgtgggaaagcacttagtggaacatagtaaaggaaagagaaaactagtacaaaaattgaattggttttcccctagagatttaaaaaagtacttgggattaaaagacaaataaaacattagaggagccatcagtgcattggttccttgtgctcaagatgagagggatgtgtagaattaattctcgagtactttccaggcctcctggcctgggagtctgctgtcttcaggtccgcaatgccagtactgtcacctgtgctatccctggactcaccatgttggggtggaagggacatttgacaggtgctccggaacccagcttgacattgacttctacccggctgtgtggctttgagacgagacagttgactttgggagcttcagcttttctctaccagtaaaatgagaatgacacttgtactaagtgccccgcctccacagttttgttttgaggttctaggtaatgtagtacgtgtgcttcataaactttgaaacaacatacagatgtttgcaaatgacaggtcaccaggatgctctcccctggtcactgcagggcaaggctttcatggtcttcttgccttcgctggggctagttacccacaaaatggagttctgatggtggactttaaaggaaaaacataagccattcagcgagcagctttgtttacagccatccattcaaaatcactaatgaagaattcattgaggtttccatgatgttttctttctttttaaagatgagatgactgggtctcaagaaatccttctttccctccaaagacattcatcgagcagctctatgcctggaactgtcttaataccagggaaacaaggtcggtaactgccatccttgacgtcatagctgcctcacggggaagacacagaacatttggcacactcatactcttataaggcaatgggatctgagcagtgaaaaagtgcatgggagatgtgggaacacccaagagagacactgaaattagcttggtcatgctggagggagggcctggaaaggccttctagaagctaagccctggcaaagggggtaaggaacatccacatagagagggaaacctgtgggagagaagaaagagcctggcccctctgggagccctgagctgttgttcagtgtggttgtcacttgggcagtgaggtagggagtggtaagagatgggcccagagagataacagggagcagatcatgaagcaattcattctaccttcagggtttaatctcatatactctaattttcaggcgagaatctaaaagttgctgtgccatttagtacagcagagcaggaagtatgtgtatttgacctccttgttaatttcttcccataggtacctttctgtaaaaagcaggctcatccccaaaacactgtgtttcaataagctcgatgcagtgcaacagtgaagtgactcctttcttagcagctgggttggaaatgcttctgtgtccctccagacctgctctctagcctcaccactctgcttggggcctggaggctgacagtgggaatagcatcaaggggctccctgccctctggctgcattaggatcagaagtcctaatgcacgcgaagttgggtatttattgccttggccccatccctaccaggccactctgggttggctgcatcccttttccaaaggtcatcctccttccagtgactctttttgggtaaagggtcagatctaagtaaagggtccttgtagttgttctcccatgtataggcctcaattatctcttgttggtgcctgatgtggtttggctgtgtacccacccaaatctcatcttgaattgtagctctcataattcccacctgtcatggcagggacccagtgggaggtaattgaatcatgggggtaggtctttcccgtgctagtaaataagtcttaggatatctgatagttttatagaggggagttcccctacacaagctctgtcttgcctgccacaatctaagacatgaccatgctcctcattcaccttccaccatgattgtgaggcctccccagccatgtggaactgtgagtcaattaaacctctttcctttataaattactcagtcttgggtatgtctttattagcagcatgagaacagactaacacagtgcctttaaccctgatcatgccctgagatcctgacacaccatcattgatttccccagcatcactggattctttggtgtaacaggaatgcagggtggtcagaatccttggtaccattgaataaagctacccagatggtgaggagcactaggttaggagtcaggaaacccagcttctactcccagcttggccaatgattagctgtgtgacctcaggcaggtaaaaatcctgccatgcattcattctgatgaaaggacattgtagcctaagaaggtagtgatgtctgcaaatggaaagggtagaattgtctgctccagctttttgtgagggtgccttaagggccactttggggtcaagaaggacacagccaggataagccagagaaggccttctttaaacttttttttctatagtgaggctccacacatgatttagttgacataacaaagaattccttgccaccaggaaacatttgaaaacaactgggctcaatgaagttatgaagtcctgtttggttttcagagctgagatttcctctgtgctcattcactgggtggagaccctggtaaggatacaatctcccctgcattccacaagtacagcagctagtagctaaaccacttgtggggtcacttaattgctttgattataaagaggcagtaaatgtgaccttgcccaacttaaaggagtcttgtgcagggacagaagaccctggggtcatattatttgtacacaattccaggatagcattaacctgagtcattttccatgaactactcacatgtatcagtggcagtgtgtctcacttgaaagtcagtgtgcctcttgtgttgcccatggaactggagacctgatactctttcactggcagccactggaagatgctgagaatagcaacatgagtggcactgtggacttaacccaagcatttgaccccattaacttagttggtatgtgggaagctctgcaaaatgtttgcttcctagagacacttattaacatcacttctcactctacaaaacctttcctgataattgtcctgccagaagttatggcccctccctctgaactcaacattcagcatgcttttctgctgccctttaaagttagattccagttggtgtgcacacctaagctctatctcttctgctaaactgtggtctccattggagaaagaaacatgttgtacacatgtctatattctctacagtgccttatagacagatgaaatccagaaagtgtttattgttttgttagctgacagtcagggttgacctgtgagggaactataagatagatttttgtatcgttgttataatcacaacaccaaagtcttagcctgttcagcctgccataacaaaatcctgtagattgtgtggcttaaataacaacaaaagaattatttttcacagttctggaagctgggaaatccaagatcaagatgccggctaatttgattgctgtgggggccttcttcctggtgtgcagatggctgccttccggctctgtcctcacttggtagacagagggagaaggagagggagagagagagagaatatctctcttcctcttgttataaatcccccaatcctattggattagggctacactcttatgacttcatttaaccttaattatttcctaaaagcactatctccagatacagtcacattgaggattaggatttcaacatatgaattggtgagcacaatttagtcaactgcattctgtccctggccccccaaagttcatggccttctcacatgcaatatgcatttattccaccccaacagccctaaaagtcttaactcattccagtgtcaattctaaagtctaaagtccaaagtcccatctaaatatcatctatatcaggtaagggtgaggcctgaggtgtgactcaacctgaggcaaaattccttcgcagctgtgaacctgtgaaatcagacacattacatgcttccaaaatgtaatgttgggataggcataggataaacattacaaaaaggagaaattggaaagaagagaggggtgatgggtcccaagcaagtccaaaacctagcaaggcaaattttattagatcttaaggtctgagaatagtcctttttagtttgatatcccaccttcttagcctgctggggtggcagttctgcccccatgactctgccaagtcaggttttcaattgattaagtctcagccacgttagggagggcaatctattttttctcagtccactaattcaaatgttaagctcacagatacactcaggataatgtttgatcaactatctgggcctcctatggcccagtcaagttgacatgaattaaccatcacaaggggctttaggaatcatctgatccagccatctctccaaagcatgaatccctgtggctacttgccattaaaaaacctgaggagattcatgccacgcttaactattatccttgttttagcagggttctattaaattgccttcaaaggttaagtttagattaaaattagaaagagtatgaaatcacagcataagcattttgagaacaaaggctgctgctgacttctcaagttcctcccttgcgctttgtggtgctggcccagccaatagtgtgagcacaggagggcagatcctttccaggtcaagacaaatggggtttctgccagactccgacctctggcaggctcagtgcagctgcagccactggcagagggggaatgacctggggagaaagctaaaggccagtctcagtctatgaggcttgggttctgaatacagagggtcagtacctagggtccaaggctctccccttcccaggtagcagcatgactcttctgcccccatggctagaactgctctgtagcctggaagtgctgatgtgcaggattctgtctgcctttctaggctgcatttgacatccatttgaatcttgtttcactcttgtcaaaatgttgggaggaggaagagacacacaacaggattgactctgacattaagtactctccccacccccaccgatgctttccaggtggtgttttaggagaacattgtctcctttcctgattgtcatcactaagacctgagacacccttttccagcttctctgacaattagcctcagcatcctgtggaagctgtagagctctataaatattctcattcctgatattatctctgtaaaaaaggtgatatcattttggctaggaaaagtcagaattgctttgaaattttggtaaaaacattaagaaaaatccccaaattgaaatgtagatcaatggaagtagttttctagattcaccagttttctatggtgataatattactgtttgaccagtatctccagtgctgcccttacaacatcgtactcatgacgttaataagcacgtaagtcaggtaatatagtttaatttgaatggtcaagtgagaaaggcccaccttgctctttatagcaatctctgcagtggttctgttttgtaaatagggaatattaaaatttaccagaagttagctggggcaaggtaggcatcccattaaagataccaaaattccccaatgggcagagttgcagggaaaataatatctgccctttagaataggaggcaatagtgaaaaccccacccctgggctagcaatttgaggaacttcaccatcaggacattgatggctaaactctgggtctaactcctgggtgtttctgtgtatctatgatgggattcatctcacatccatgcactctctccagcgacgtctccatccatatatgcatctttgttcttgagagggaagtgtagaataggagcttggaagtgaatccctatgcacaagaccctgcttttcctctgaaccaggcaaccttggggaagacatggagtttctccctgaaactcttctcctcatctggaaagttgggtcatgtgaacagggttgttaggacaattaaattatataattattcaaatattctttttaggctactgtgtgttttacaaatgaaaggtattgttaagatcaaacaaaacaaggtagactttttgcactcatctgaatgcttcaccctctgattcactgtaggcagcaccaatgccctattactttttaaagtggtttccattcatgtttaagtcactagtttccattccagcaataggtcagtgagttaggggcagctaaaaatataactgcctgaacgaaacaaagaatcctccatcttgacttttactctttgtttcctttttgttttagaaaaccacttgagttggccaacaagcacccaagtgtgatagaaggatggtgggtttcacatctcactcccatcaaccataaatgtgtagcatcacacaagctctctgagcctgcctgcaggtgagttacctcacagcaaaaatttaaataataacattcacactgcagtttcttctgaaaacccctgttacatagtaagggtgttcatcctgccttacaaaatatactgatgccaagtccaagatcagaaatgtgctcttaatctaaatttaggaagattaaacaaagttggtgagcatccagaaaggtcaaaataaaacttgagtttgcaatataatgataaccttggagtatttcagactgtcagctcccttaagtggcacacaggttgttgtttgattggtgtgatgtcagacaaacctggattcaagaccgggttcttctcctaccagctctgtgatcttggaaaagggactggatctctgaaactcaggttcctttcatgtgaaatagacccatatcaagtctctcctcaagctgtccatgtgaggattagatgaagcatctggctactgttattattgtggaggaacattagctcaagccacctgcagcagacagaccctaaagtgacccccagatccccttgccttctggcattcatgccttatatataatcccttcgagtgtgaatgggatctatggcttgtttctagctaacagaacatagtaaaggaaagattttctgcagatgttatcaaggcctaaatcagttgcttttgaattaagcaaaagagatgctatcctgggtggccttactgggtgaaagctgctagaaaagagattcttgctagtcctaaaaaagcaagctactatcatgtgaatttcctgtgaagagggccagttggcactgtaccataggcagcctctaggggctgagggcctcaatcctaaaactgcaagaaactgaattctaccaacacccaccagagcttggaagaagactcagaactacagacaaggatgcagtcctagctgacaccttgactgtagcctgtgagatacagagcagaggacccagctaagccattgtcagattcctgacacgtagaaactgtgagataagaaaggtatttgttttaaactgctaaatttgtggtaagttgttacacagcaaagcaaactaatatacccctatttctggaaatcatttcctagagacaggcttgtattggaggaagatggggtttcctcacgtcccatctacagaactgatgaatgtagggatgagggaaggaaaagaaagcttcctcagatacatctgggagtgggtatgtgtgagcagagggttgctatagtagaaagagaggttaatgagacagaatgtgaggagctcaacactgatacttgacagccttgtcaaacacagctattggttgaaactgtgtgaatccataacaagatttttaaaaaattagactttaattgttatgttgtggatttgtgcataccatctacttcctaaaagactttaggggcactcgaaatcaaaacaacttatgatcatagcaaaaataattaacaagaggaaagatgggcatcagaataaggttgataaagggcagcgatggaagagaaagttgtatcaagagttccagaggctgtgaggcaagccccttccccactctcaggccattctaacctaccatcttcaatggtatcaggtgctcacacctataaagcccacctctaaatctgactctgccttggggaccttgtcctgcattcctgcacatcctgtgggatacactgtgatgccccacacgtaggagatgctcagcagatgtctagtgaaatgaattgttgacccagctcatttctaacaggcagcctttccagagaatgacagcgaatgtgtactctctgtgtttgaagactgtgtgatgttaattgaagtgcctgcaagtcaaaataagaatgacagtttattttaaaaaaatattttaatggggatcctgaaagtgaaaacaaatccttcacggagagattctttattgaagagaattttagaaagaccacagaattcagtcctgccccactgtgaattcaattccctgggtaaactacatagcgtgtgtttatgcctaacagatacatatgcatcatatgcatgggtggcctgtatgtgaatgcagaaatacctgtgtatttacactccagtatatctgctgtaagtctgtatcagtgtttctccaccctattttcattatcacctccctcaaggacgctttgtaaacatgttttccctaatcaccccttatatagacttaataccacagatacactgtatatctatttaagggctgtatgtatatatttatgccttatataaaaagagtgtaattttgtaccccatatgaaccaattttattacttttggggtgataattacccccctgccttgagaatacatggtctatatgtgcatctgtgtgtgtgtgcatatgtgtgcctgtgtgtgcacacacacacagacacacaaacacaagctaactgggcagaggtctgaaaagcattttgagatatttgaggagaggtttcccatcaataaccaagaaagcagttctggtccagtgattcttgtaggaaacagatgctagcaattagaaaactggaaaactccagttggtcctgaagcacactgggcatgacctgttttccaaatcttcagagatgggggagattttataaggccatatgagcagaaaacatctaattgttcataagaggaaaatttctgaaattctaatgtctacattgccattgcaaactatgaagttctcacatctattttaaagtaactgagcaaaatacattttggacaaaagggaaccattagcatgtttaatattttataaatatgatcactatggtaggcaagactttattcaacaatcaatcaagctctgaaactctcatttgcacctcgaaatgcttagctttacaaaaagagttgtaggaaatgtggaagtaaagatcaatgcatctgctttcaaatatcttcaatccaattttgttacaacataaaccagataaatatctgaggacctcaaatctgtgtgagttacatcaaccacaggacatgggagagaaaacccctctcttgctactctgagtaactgtagcactacaaaaacacagcatcattcaatcacatttctaaccctgacaaactttcacataacagaggtactgaccactttcacctttcctttttaaataaaactgtaaactaaggagaaggtaaaaacaagggccactagagtgggaacagatttgctaacaactgtgattggttagtgtacacttactatgtgcccagtactatgtgttgggcccaaatacacgaattctttctatagcaagccctgcggaaatcattcagcctctgttaaaatacatccgttcatgggaagctcaccacctttctcaagataccccattgctctgttggggaagttttattttaagaaagttctttgatgtgttaagctaaagttggcttctccacttaaaatcttaaaatcagccctcagcttttttcttgagattgacataaataagttgaattatttctccatgtggttcactaaaggcagggctcatggtcagcagatatccccaccaagaccacatcttcagtgaaggctgaccagatgggaattcaacaggctgagggtaaggataacagttaactgtcttacatgttgttgctcaggtagtgaatgacatgagtattaaattgggcatttatttacccgttgatgatagactggataaagaaaatgtggtacatatacaccatggaatactatgcagtcataaaaatgaatgagatcatgtcttttgcagggacatggatgaagctggaagccattgtcctcagcaaactaacacgggaacagaaaaccaaacaccgcatgttctcactcataagtgggagttaaacaacgaaaacacatggacacagggaggggaacaacgcacaccagggcatgttgcagggtgaggggtgaggggagggaattcagaggatgggtcaatagttgcagcaaaccaccatggcacatgtatacctatggaacaaacctgcacgttctgcacgtgtatcccgggacttaaagtaaaaaataaaaataaaaataaaaaattgggcatgtattacccaacaccatgtctcatgagtggtgaaagaagcagataaatctgggcaagtaaaggaagtccactgtgtacagtgcccacggacctacagagacagagggtgcccagtgcctacacctttgacctccctccaaccactgctgaagcttccttgacacttcctatccttgacagttggttacaattatgtctgctcttgccctcacccattcactctctcaccagaaaataattaaagggaactaatatatttataaataacagtccttttcctttttaaattttcatataaacttgggaaatgtacagtgaacaagtactattggtatattctcaatattcaagcctattatagtgtccaggaaaagggatgggaagaaagaattaaagaaagaaatgttttttttaaaaaaaacctcaaggtggccaggaacactgttccttcaccccagataccaggcaggcccctttggccactccttaggagagatgataggttaggaacatgtataagctgtgtggccttgaacaagccacttaaccattagtgcctcagtttcctcatctatacaatcctaataatagtatttaatacatagagttgtggggattaaataataaattcacataaagctattagagcacacatagtaagcatttagtcaatgttagctgtcattactattattcttttcccttgaaggaggctttcagaaatttttataacttgatttcactcagtgagaagccttcaatttggtaacagaagaggggatggagagggaggagaaagaactcacagtgtgatctgctttacgcaggcctcccaaggctggcccagcaactcaagataattctgtgttcatacaagccctacctacaatactgggttgacatttctgttttctctattaaaagcatcccaaataatgtactgaagttgtaaaataaatctttggtgctaaatatcctaatgagacatttagaagcactcaaattaggtgttacaattaatatcataggatctataagattcaaaagaaaattccatttattttttttctaaagagataataatctgagactggataaagaaatgtggtacacatacaccatggaatactatgcagccataaaaaggaatgagaccatgtcctttgcggggacatggaagctcaaagccattatcctcagcaagctaacacagaaacagaagaccaaatgccatatgttctcacgtataagtgggagctgaataatgagaacacatggacacaggaagtggaacaacacacacacactggggactgttgagggctggggtggggggagagagagcattaggaaaaatagctaatgcatgctgggcttcatacccaggtaatgggttgataggtgcagcaaaccaccatggcacatgtttacctatgtaacaaacctgcacatcctgcacatgtacctcagaactaaaaaaaaaaaaaaaatagaaatgaaagaaataatgatctgggctcttttttgcaaaccacggaactcactctagctaaattaagcaaaagagaagtggggttagaaagccagttcttgatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaaagtttaagtctttaatccatcttgaattgatttttgtataaggtgtagggaagggatccagtttcagctttctacatatggctagccagttttcccagcaccatttattaaatagggaatcctttccccattgcttgttttaatctacaatgaactcaaacaaatttacaggaaaaaaacaaacaaccccatcaaaaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattgtggaagtcagtgtggtgattcctcagggatctagaactagaaataccatttgacccagccatcccattactgggtatatacccaaaagactataaatcatgctgctataaagacacatgcacacatatgtttattgcagcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaactggaaatcatcattctcagtaaactctcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctacacaatgtgcacatgtaccctaaaacttaaagtataataataaaagaaaaaaaaaaaaaaagaaagccagttcttggcttctgccttgaagatgctgggcctaagaagcgtgttcaaatggcactgggtagcaatgaagtaggacgaatatctactacatacatcaataacaaaatcagttaaaaatactcccaaaatacaaacatatgaatagtgggcaaaagtgccctttattgttacttgttggcaaaagaaagaaccaatttcctgccagatcatggcatttgagactatggaaaaaggcctggaacatgaggaaattaggcatgcacacacacacaatgaaagtggctaatgtgaaagttaaccaaagtaagttaaccaaagccagagactataagtaggttccatgagtttatacaatctgaattaagcccaggacccagcaggcccaggaatgtggttccatctgtttcatggttgaaaaattccccagagaggccaagtgccttgatcaagggtgtaggggagtcaagagcagaaactgccctgagtgtttaccattaggaatgtgtgacctcataagacagtattctcctttctcaggtaatctgtccttgggagcggttgtctggggcttcacagaatggctttcctgcttgaatggcttggctaactcacctggtatgcaaaattggtttggaaatgagctaatcattatatttttcacacggtgacatcctggaaagacctgctgtgagttcccactagggaagtggaaacttcctagctaccttctcataggcaggtggctatgtcccagcacacagatgttaggacactgctcagaggagcagcatgtgtcagcagcacatggcttggcaggagccaggagtctaagcagtaaatatcaagggaatgatttgtcagaatagcaccccaagtgcaggggaagtgagaggaggcgtagtggtagaattagggaatgagttctgtctacatccagggcttccacctgaggactcgagtccgcaaccacaaaaacctttctatggacctggcaacaaagtcctaagcttcagcccctgtgaatatttcaacacatgcaggataggaatattaataacctggattcacatcagaatgttctccaagtaattcagaatgcttcattttacagctcaaccctgaggttgccagatctcagtgcttcatggaatggacagtgacaggtgaatatggccactctcactgaaggcagctcctccaacctcataaccatttacagcaaaggccaagcccacagctccaggcatcatgccacattcgttcaattccttcttggaagggtacctaggtcagcgatcagctcacacctgtttttgtagatgaggtgttactagaacacaggtatgtccatttgtttacatgttgtctacagctgcttttatactacaaaggcataactgggtagctgcaacagagactgtatagcctttaaggtctaagacattcaccctgtgactctttacagaggacatttgctgacctcaacctaggctatgagagctccaaggccattcaccaagtatattgtaaactccctgagagcagagtccttttggaacctcccatgggacctcacacagtgaggtacacaagagaatcaaagaatcaacttttagagctgaaagggacctcgggtatcattttatccaacccttttattttagagatgaagaaacccaagctgccagttgaaaataacagaatggcagaaagcagaaccaaaaatcaagtttcctaaactccactgtaatgctctattacttgacaattggtgaatataaaataaatgaaaagataggtatggatttacacaggaatatcatttgctgggtatatggtgtgtgccaaatactatgtggatgtgggtatttcagttttggacctcaaatctcaggagaaaagtgtatgtatacatattatatatacacataaaatttatatgtgtatcctgtatattatgtgtgtgtatacagttgacccttgcaaaacacaagtttgaactgcacagatccacttatacatggataagtataagtgggtcttccacctctgtcactcccgagagaataaggccaacccctcctcttcctcctcctcttcctcctcagcctactcaatgtgaagatgaggaggatgaagacttatgatgacccactcccacttaatgaatagtaaatctattttctcttccttgtggttttttttttttttttttttttttgagacggagtctcgctctgtcgcccaggcaggactgcggactgcagtggcgcaatctcggctcactgcaagctccgcttcccgggttcacgccattctcctgcctcagcctcccgagtagctgggactacaggcgcccgccaccgcgcccggctaatttttttttttgtatttttagtagagacggggtttcaccttgttagccaggatggtctcgatctcctgacctcatgatccacccgcctcggcctcccaaagtgctgggattacaggcgtgagccaccgcgcccggccttccttgtggttttttaaataacattttctgttatctccttactgtattgtaataataccatatataatgcatatagcctacaaaatgtgtgttgactgttatgttatcagtaaggcttcccatcagtagtaggctattagtagttaagattttaggaagtcaaaagttacacatggattttcaacttgtatggaggggtcagtgcccctaacctccacgttgtttggaggttaactgtatatatgtaaaacacacacatactgtgtatgtctgtgtaataataagatgatggtgcacatgctcctttgaaggagacacccaccgtgaggggagtatccatctgatttgtgacttcagggtcaccatttttagttgttaccacctgttcatctgaacccaggtgatggaagtcagcaccaaaccgaaggagcagagccatgcatggatggtctttgtctttcatccctggtgtattggtttgttttcatgctgctatgaagaaatacccaagactgggtaatttataaagaaaagaggtttaattgactcacggttccgcagggctggggagacctcaggaaacttacaatcatggtagaatgcacctcttcacagggcagcaggagagagaatgactgccagcaggggaaatgccagacacttatgaaaccatcagactcgtagactcactcactatcacgagaacagcatgggggaaacaacccccaagattcaattacctcccatcgggtctctcccttgacacatggggattattacaattcaaggtgagatttgggtggggatgcagagccaaaccatatcacagagcctctttttccagctcttcattgaccatcccccatgtcacaaacctcttgtcaactaggtgcatctgataaccactctttgaaatgaagtctgggtattccttcactctacagtgttcaccaacaaggcattccctttgagaggcatttttctcccactctggaatgaaagttgcctcgccctagttagagcaattcttggcatacagatggaaaatgctttctgaggagtgttaggcctagataagcctcttatcatcctttagggtgaccttaactgggagaggaaccagaagagatagtccatggtttttctccagcagtgtccttactctcctggggtaggtgggtaccaagagaaggtcctggggtcttgactgggtggagagcctggtgtccccctatcacctgctctggaatctgccctagcaacaggtctacgggggagagaggggaagaggtggatggctttctcccccttctctgcctgagcttagctgggcctctcccctcatgttgcacacttgaactgaaccccaacttcttccctggctgtgctgcaaaacactgcttagtgccttcctgataccaggtcccttggcttggagctcccatagcctcattcttgccttcaggccacagtccttccaaatgcccagtggctgccactctcccagacccccaggctgcaagttctgccaggtcccagctggcttcccccacaagacccagggcctggcacctggtaggcttcagtaaacagctgccacatggaaaagtgcatttcaagtaccttgacttcattttttattgtttttaattatgaacacacattaaagggttttggagttagtcagaaaccccaactctgccactttccatgggaccttgagcaaaacacctaacctttctgaagccagatttcgcatgtaaaacaatcacaatatatctaaaggagtagggatactggattaaacagagtgtcaccacaatatctggtgcataggagagagatgctctgcaaattatatttattataatgccttccctgatcctgctacccttgaccatggcaagtgtctcagaaagactcagaaagtcctagcagtgaggctggaccacccccaccccccacaccagggagtaaactcaatcagcagcagctttattctcacctctgctttcagtcttctatgtggcattataacagcctaacttgtctgggcctcaaggaggaatgaagctgctagaatcctgcgaggactcgatggaatccatcaaattccatggacgatattgtaaatttctttagatttattgttatatctcacatttatagtgcctagtgaatagtctgtaattttttttgttgttgttgttgttggactctgccatacatatctgtaaatgactctaggtcttagaatggaagaagagccgactggaatagatgtaagatttctctcaagtcagtggcttcatccttgcaaagatgattttcagagcttactctagaatcctgactgaggaacttgggccaatgccacatcttgggcaaactggccaggggacaaaatctgctcttggtggccacacccacaatgcacaacaggtacacttttttttcccagtggcatgcaatactcctggtctctcttacccacttccttctggtcctcttccctctgcctactgacctgataaagtaatcccagataatgtgtcagctggggctactgcatccataggtagcccattacaagtagcatatgtatatttttaaaaggacgtctaagaaacattccttaagccaaaggggttgatcaaagaatgggagttcatgtcactatggcagagaagtgggtaggagacttgagaacaggtgcgtctttaggctgctctaactcacccaatctggtaattgccctgctttcttgtctaagtgttgggatctgaccttgaccttggactattcattgccacctatggagaattaaggaaaggcaaaaccttggtcatctccctcttgctcgccattgggaaaatgccttctgatttagcgcagcaatttctcctcattaagctacaaggggctgggtaaaatgaggcaggagagagcacaaattctgatgtcaggggatgaagtttgaagccaggctctacaatgtcctagctttgtgcatttatccagatgggactcagtctgaccttcagtttcctcatctgtaaattgggaatagtaccaagacctactccatggaattcaaggaatcagcgaaactaaggtgttcagaatagcagttagccactgttgctattattcaatttccaaactgattctctgattttgaaaatgcaaagacaccactcatgggaccaaagaggactgaggtgtgaagactggtttttctgtatcataagccacttcagtgatcctctgtctcacctacccttttccctcttccatccccgctatctctttcccaacattttcctcttcaagaaccttatactttgaggatggggataaatacctttgcaaaaacaacaacaacaccaacaacaaaacaataaacaaggctgcaactgtttttataattccacgggccatggagcagatcctaagtctaaaggtcactatataaaatgactgagatgttatataccttggggtgacctgagagcagtagaagaccactcgcctaccaaatctctcctacatttgaatgtcacagggctttaaatttccactgttagactcacccctgtgggttttggatactcccatggggcctggttaggttaagggcagtgttcccttaaccagactgggcacaagaatcacctgcagcacttgttaaattacaggtatctgggacctccttccctgaagactctgattcacacatttgggctggagtttggaaaatgccccaggtggttctcatgcctgtgcaaggctgggaaaccctgttctggtggagagtggtcaggtctggagtccggatctccaggtttctaagtttgtatagagcaacccatcatgcagcccctgacaaatcacctggtatatgagaggattaactatcttccttcctcaaaggataagagacccaaaaatgcttcaaaaaactgtatgtacacacaaggaaccattttaacagaatatgggaaataacgctgggaaaaggaatgcaagaatagtttcagtatcaggtggaagcagttgaagttgatctagcagatggggaatcgatgtcatacaggagaaggttcttctttaggaagattaagtggacagtattaagcatggtcaacaggaggtgagagaggctgcaggtgggatgccagtttgtagtaggaaacaagaatacataacttagtttctacggtagagactagctccaaacctgcttcctctctgtccttgcagcacagttagatgacacttcccagcttcccttgcacagaggaacagccacaggattgagctctggactatggaaagtgggtggaagtgattcgaccatgcaaacctaccatgatgtcctccaacttcaatcttccctgtgctggctgactgtagagagcccagcaaaggagttggccgtcccgcagggtggcagaactacagggtggagggagtccaagtgggggagaccactcactaaacactgcattgagctactgtgtgaaaaagttggtaggttgttgtttcagcagttgacctataccgaccaaggcagtgcctgacatctgaacagtgaagactgtagtttgcaaaaggggttcatgtttcttatcttatttgacttcataataataatcctgccacacagatcagatccctgttatattcacaaagtacctgaatgaggaaaggccacataactttccctacacagctcccctctcccagagcctgtggggaagccctgcccagaaccttcaattccacaagtaaaacctgagtcatttgtgacaaagggccaaggacatatggctcctttggtttcaggggcaaattctaaagacactgctgtctctagattttatgctataactataaaatgccacagagagcaaatgtgtaaatgaataaaaggcaggtgagacggcccctcgtcttcatccttggtgttgacggggcccatgcacactggcagcattaggaagcagacgtggacattgacaggagaggagccttgggctggatcaagaaacctctatctgttgccatgacaatctcccaaattggatgtttaagagaataactgggacatggtgttacttcgtctctattctaggtaatgggttcccagttggactccattcactgcacatcctcccctccttccccttttgtgttatttctccagtcggacacttgtttcttttccctcttaccatagaataacgttaaacaaaagtggaaaagaaaccatcaccctgaagtccatagaggttgatataggatatggggtaactggcacaaaacttctacacaccaaagcctgtgggtaaccagagacgtgctgcaaaggcctcccacgccaaaacaccctgcctcagatgcagggccaaatgcaccatgtttagataattaagcacttccctcttttaaactacaattgctccacaggcaggtaggggcacagcagtcttccactttataaacaaaagtctggatcccccagcttgccatcagagatgcttcatgatctgatctgctagatctgaatgtttgtgtccccccagaattcctatgctaaaatttcatctctgaggtgttggcattagcaggtggaggctttgggaggtgattaggtcatgagggtggagccctcacaaatgggattagtgttctcatgaggggctgaagagaatagagttatcctcctccacaatgtgagaacccagtgagaaggtgacagctatgaaccacattgtggccctcaccagacaccaaatctattggtgcactgatagactccccagcctccagaactgtgagaaataaatttctgttgtttataagctacctagttcatggcattttgtcatagcagctcaaagagattaggacagagcctatgtgtgtatatatatatatatatatttatatatatatatatacacacatgtataaatatatatacatgtataaatatatatatacatgtataaatatatatatacacatgtataaatacatatatatatatatatatacacatgtataaatacatatatatatatatatatatatatatatatatatttagatggaatcttgccctatcgcccagcctggagtgcaatggcgcaatcttggcccactgcagcctccgcctccttggttcaagcaattctcctgcctcaacttcctgagtagctgggattacaggcatgcgccaccatgtccagctaattttttgtatctttagtagagacggggtttcaccatattggccaggctggtctcgaactcttgacctcatgatctgcccacctcagcctcccaaagtgctgggattacagatgtgagccactgcgcctggcccctaacttacatttttatctgccttcccaatatccattcacaccctcttcagcacagccaagcagagctctgagttttctgggacacatccgggcttgtcttgcttctgagccattgttcacatgatttcctttgcctaggacattgcatttatttcctacctcttattccttgatcaccttggctaactcctcacgtgcctcattcctccctctcaaatgatatttcttttttttcctttttttttttttttgagacagtcttgctctgtcaccaggctggagtacagtggtgcaaactcagccctctgcaacatccacctcccgggttcaagcgattcccctgcctcagtctcctaagtagctggggctataggtgggtgccaccacacccggctaatttttttgtattttgctagagacggcgtttcaccatgttggccaggatggtctcgatcccctgacatgatccccctgcctcggcctcccaaagtgctgagattacagtcatgagccaccatgcccagccccaaaagacattttttaaagcaagtccttatttctgtacttcttctccatgctccctcctctggggaacctcctccgtcacctgtagctctgagcagaagttcagataaaatccctagccctgagcccctgtgatcctcagctctgatccttcagcattctaaggaacatctgcacaggactggcctgccagcacttcagattacaccattccaaatcaaacgattttaatgaacagcaactcccttcctcacaggatacataggctttcttcagagttaaaaggaaacttaaagctcaattagtttgtctgtactcttcaatttacaatatcttagacagtaatggtcaagcccatcaaagatatcaccattctagatgtggacactaacctttccaggggtgaatgtaccaggaaactgctgagtcttcggtgttggtgcccctaatatacactatttgcacaggcttcttccaaggcatgcacctaattttgtattcacttctgtattccacaacacactctgtcttttggcccttgtttggactcacttggcctcctgatgggaccactgggatagcctcctcactgacttctgcctcagggctctccttattccaacatggtcacagtgaatgcagccgtaatagcaatggcaaaaacagcagcagctcacattttatctcactactcttccttaaacccacatagcgtatatcccaaagtgttagattgggaacttatctcatcagagaaggtcagactggatgacttctggaagcttttccaaataataaattctatggttttatgaatgttgatcacattttatagaaaaaaaaaacttacccttaaagcaagtcacgcaaccagtgcgtggcagacctggaatccagatcttctttcttttgtttgtttgttttttcctgttttttttctttttctttttttttttttcccgattttcatttgcacaaatttatggggtacatgagcaattttgttacatgcatagattgtgcagtgatcaagtcaggacttttagggtatccatcatactttgagttcattgattttcccactaaagcacgaagtccagctatcaatctttctaaacataacccaagtcaatctcctattgtgtgtagacacttccagttactccccactacttacaagggagcagataccacttacctcccattcaaggccccctcctgccactgttgttggcttttttgctgtcctatttccaattgctcctttcatataccacttgcttcagacaaccccgtgtactcataagccctgagcatccccatctccacacctttgctggacctgacatggttgctcacttttggccacctctgaatcctgatcattcttcaagactcaactcaggtcccaccctacccaaagctgggcctgaagacaccatttgggccacactggtcccatcatatgcatgactcattgcattcctgtcactcatgtgccactgatgcttgtttgcattgcactcctcagtggcactctcacaagctactggagcctgtcttcttctctgatctcccccagcccccttcagctttcacagagcctggcacagagtaggtgctctgtaagcattttcatatattgattgattgattatattttatccccaactccctacattctttatcttactatctccttcatgcattgccatttaaaattatgtgtcactcctatataataaaaaatatacaaaggaagaaaagaaaaattacaaaagaaaggtcaaaagcatttctttcctcccttttctggtttatttgaggtcaatctggagtgattcatgtgaaccagcatattgccttggctacctccatcctgtgaaatgcttgtttgaagtagcgactggaccatattttgtccttttgatgctccactgagtagttcagccctatttacccatggtttgcaccagtggttctcagtctttgatgggcttcagaatcaccagtgggtagcttcttaagcatacagatgcctgggcctcaccccaccctcctaaatctgaaactctatagacaggacctgggcaggtacaagtgaagaaggcaagtgcagtgactctttcatgccccaaaggctgagaaccaccagcctacccatggtttacctccagtgctgctggcatgggaagagtctttgaatcccccttaaagactcttcccatgccagcagagctaaaagaacttctagaagttaacaactccatttctttttacagggaagaattcgtttcagttcagacagtaggctatttatcttatttgtccttaaagaatttcacatctcagaacttagatacttctttcttgaaagaaaagacacgtttccaaagcaggttgtcatttagcgaactggaagagaaatgtccctgactgtgggagctgacccctcagaacacaagcagtgttagatttaagacaccctgggtagagagagtcctttacagaactacatcttaggaaactcatgcttaaccactttgcatctttactatctctagttcctccagtcttgacaacagatacaactcaggatgtgttctgggtaatagttttttaatagataccagagagtgagagcctacgacattttccccataatcctggtagataatacgtgtgcatgtgtgagtatatttgatgagagcacctatggctatgcatagctggaagattgttgaggaaggggtagtaaaatctgcaaagagaaccagggatcctcttgaaaataaagaggatcctttaccctggcctggctaccaggagccttggggaagcagttatgtaggagctttcttggatgagggagcaactgacaggaggaatcaacttcccctgagtttgaagaacccagtgggtcagggatctgcagttaccctgtagtcagtccaaccacattactccagacatgggctctagtgggctccagcttatggagcagcagtccagtcagaggcagtcagatccagtggtggttgcactgtacttcagttgccattggtctgcagcaatgagactcactgcttgtgttctcaggggtcagctccaacaatcgggaacatttctcttccagttccctgaatgacgacctgctttggaaacttacattttctttcaagaagtatcttggttctgagatgtgagattcagctggtaggactgagcctctgacttcttgtacacatcaagggagggaagcccaagggctttacttttacttattgggctacatggagcctacagagaaagacttactaataggccagatccatactcagcttgaaatgctgacaccaactccatgaaagatgtgctgctgctattagcactgcactggttaaaacaaaaaaaaaatctgtggtccagagaggtcaagcagcccatcctggccaacacactggtgaacccgagcctgacaccaaagtttcactcttccaccacatctcttgccaccactaacatggggccagcagctgacaactcaaagggaaccaagaatgagaagtttttgacctaactgactgtctaaattgacagacgctttgtcttgcatggagggggccaataaatgcccaaagagacaacacaagtcatcagggatgcaggagctctcaacactggcagtggacgtcagcttctgcagacccagtcctcattcccaccaccctgccatggcacttcaaatatgcatcatacaactcttgacgctagctctccagggatgtgttaccaggagaagaagcactcactgccatagcagggcaggcaaatttgtgtattgcgttattgactacagatcaaaacctgaagatagtgggaaagaaaaacacagtagcttaatatgatgaagggaactttaaaaacctagtgagctcatgcttaggcaagcggcccaaggtgaccaggcagtcacagtagctcagggacatagaggcgacaccacaagatctgatcctatctgttctggaagtcagatgaccacaccacgagtcaccacaacttgtattgcaccctgcaccactcagaaacttttgggccactcaataaatgaaagactagtcgtttccatcagacaattagcagaactctgttttacttcccccatgctgaattgatgattctttgactagaccaaccctatacacgattgttctggagtcctgtggatagggcttaatagttcgtcagcatctgttaactgggcagtgattggatgcaagctttctatcaacaacacttctgaccgtgatgccctgaggctgttagaagttctggacatttaatcagcattagcaaggccacctatgtcagcggtggcagaagctgcctgctattggacctgcctctgattatgactcagtggctctccaccagggctgcacgctggagccacctgagagtggatatgaaaatattgtttcagggtcccacccacagacacactgatgtaatcggcttggggagcaaactgccatcagaagttttaaaatctctctcaatggattgaataggtagtgaaggctgagaaccactggtttctgttgaaacctcagttcctggctgaagagacacttgcggcgagcttgtctgtatcattagtcacttctggggtccaggggtgagactgggagtggaggaagcaatgcaaatgggtggaatgccttgatctaacctacacagcacatcctgtgtttgtcttttcaaattgctttctgttttgcttttacttccttgctctatttctttcaataaaccacactcactgccattacctctagcctgttgtcctcctcttaggatcaaagtccaagctacatattatctcatttactctcaaaatatccctgcaagtgaggaaggagccaggcctttgttccccaaggcaaatcagggacgtgcaggtccagaaaggttcagtctgccatgggactcataatattcaagtcagtgtgtttacagcaattttcaatttacaaagtgttttcacctatgttctcccatggaatcctcacagcaaatctacaatgacagtattttcataaccagaatgaccacacatccttatttgctcccaaactatcctgggttatacctgtggttccagcctaattattgatatcattccctttcactctcaaaagtgtctagatttggacaataaattatatggtctccttatttataaccatgctcttgttttaagagggccagtgaggctcctgaaagttaaataatttgttcaggatcatttagctaattagaggcagaggcaagacttgaactcaggtactgcatctccaaatccctgcgccatccacaggtattatgggacattagaatcagagttgacatgatctaacatttcttattgtagaaactaaaaatgtggggaaataatctcttaaaagtcactgtcagaatgttccccgaaagggaaagactcggagtacatagcagaaatgggttagtctccttggaagcattctatgaacacattagaatggattaataacataaataaatgtcaccatgatggcacttgaaagcctaacttggcaaaataaggtatcaggcctgacatataggtatttggaaaagagcaagaaattcaaagtctaaactgctagatttgaggactggatctgaatgctatctgccatctacctttgggcattttacctactttctgtgagcacatgtattgttcaacagaacaggaggaattatcattcttagttccctgggctgttacaagaagagcaaactgcagctcatcaagtgctctgacagcgagtctcataaggtacctgtgaatccagtttatttgttttctttatctttcacataagtgaatcaagccttataaagttgctgatgatcaaatgagataaggtatttgaacatacttattatgtcctaatatgctgcaatctttccttcttcttatcattatcattatcagcagtagtagtaacagataatgactatcaattgacgtgggagacaattacaattacatgtcattgtgaaactcattaggtgactgtgatttagagtggtacacccagtggaaacaagaggttgggaggtccttccaagggggtgttgaaaatgaccaagtcatgactataactgggtgggacccatccttcttggaagtcttcatagaaaccaacccaccctgccctgcagaaagagcttcagttacctgacaccatcaacaagaaggcctttctttttatggggaatcatgtacctcagagaaactccaaactttggaaaagtgtgattctgtcaacaaggatattgcttccctcaaatgacacagttcaagtaaggcctgggcagcatctttatttcacaatatttctagcctttacttgtcccatttacttgtaaatgagaactgctaacctgaagctcaaaaagatggggttgagggaggagtcaaaacaactttcatacctgatgttttgatctccccatcaatctggtttttgagctagccatgaaggcctgcctggctctcattgatttcctttagggaaaaaacaaatgacaacacagtcattttagaattatttggggaacgctgcaaattgtgcagtaaggtttttatataaatggagagactctccaacactgccaacaagaaaattccaaaggtgcaggtagaatcggtctccacacctaggagtggggcaaagggctcctttggttctaaagaacctatttgtgtttcaaatatctttcagaaacttgacaccttgaaactaccactctcaaggaatctgagtaagtcctagaatcgctttcttcaaggagagcagcaagactcatcgctttgttaaagctctccctattcacccctagggcccaggcctggatgctggggttcagaacacccccttgctgccctaaggtccaacactacccagcatcagacgagaaatgacctcctttattacctgggtctgccaaaggacctggaaatccagcctggggtgggggtggggggagtcccagaaaccaaaggagcacacaggggccacagtgggaagagaacaggctgaagaaagcaagtgtcactaaatgtcaggtgtaagcttgaaaaataaacacaaagaatgtaaaacccagcagaagaaatttaacaaacctttgtggtaggctgggacaacggagacagatcacgtaccaagtgtaaagtaagtcacattttaagagtcagaaagtaccaaagaccacagattgttatcaaggtttatgtagatctcatactttttgcaaacatctatttaattagcttgtagagaaggatcttttgggcaaaataacattttcccaattccagggaatatttatgccttttaaattctgccaggaggcccctgacaggcaccagtgactcttcccttctcagcgatctgcatatttctagggaaactttgcactgagagagttttccccctttgtgaaaggtcttggcgcccaggcagtccccgacttcccctcccccaagtcctggcgactgtttctgctcagccctggaggctactctcccgcagcctcaggtttccctacttctgcagcgtcggcaccaagggctgatcaaatgtttctttctccttacaccggcggaccgggaaacgccgccgcagcctcgcctccatccttcctcctacaggttgcaaataaagtacagcagctctgacattaggcagtttctgtccaaggagcaaggtgacttcatttaatttgcactgtgctccttcatccctgtctgcatcaggttgaacgggaggctctccctactaccaaacgcctaacatttccttgatactgccttgaaaaatcatgattatgacaaaaataataacgtcggagaatggagtgcttgttttctgctttgcaagtcaccaagcaagaaaacacttttgtctccttggcttttattttaggatctctgagcgaaagagagaaagagaattttaagaaatgtcattttcgctttgccaaagatcattgtgtcaataacgtttctctcccattcctccccctcctcccgttttaaaggaaaggttcacgggtccagccaggtttctgccgcatcccgacacctggagacgtctttcaggaccagcctgaatcgcgtccgggctgggctctggactcggactcgcagcggtgacagcggaggcggggacgggggtggacaaactgcggatcaactctccgagaagacggccacctgccggaacctgccttcctccattccgcccaggagcctcgcagcggggcgctggcctgcggaaaggccacgggggagcacagggctccgcgccgccctcctgggagggtccggagtccagcgcaccccgagccctggtgggtgagcccggcgggaggcgcggcaggtgcggcgggagactggaccccgacctaccttcacaaagagctcgatctcggggtccctgtcgtccccgttagctgtcgccgagtctgtcatgccgttggcgcccggggctaccgtcccgggccggggaggcgccacctctgcagcacctgggccagcactctgcgctcctgccgctgcccagcggggctcctcttcagggcggtgtttaatttttcacaaaaccatctattctccagcccgagcagcggggtctgagagatcagtgtcccagatgctcacatgaaaaggagcgaagccgggaggaggcggggggccacggggaaagccgggttaagggaatgacaacaggtcgtgggagcaacaagtgccgggctgcccggaggtgtcacaggatccgcgactgtcagcgatcccgccgccgccaacgcgcccaaaatagccggcggctgcagggcggggtcagccgggcggggacgcggcggggacaccccggcagctcgggcctgggccgggccacggccccccgccccaagaccccgcagggcaggaggcggagacagagctggtcctggcaaagccaccaaggccaagaggatgtcctgggggcggataatgaggcgaaggcagaaagagtcgaggagaaggggaaggggaagaggaaggggaaaggggaaggggaagaggaaggggaaaggggaaggggaagaggaaggggaaaggggaaggggaagaggaaggggaaaggggaaggggaagaggaaggggaaaggggaaggggaaggaagagaggagatggctctcaagtcttctgtttctttaataaagcgtcagctcctccgagttactccactaccagccttacccacttggaaagcccttcctgtcttagtgatgctcagaacccccaccaaaaggggcatttgccatccttgggctaagcaaaaggagagtagggtgctggggacgggcagggcagggcaggggtggctcctggggcagaggggtgagtcaacccggtcaggtgcggcttccatgcctttcagccttctgggtttgtttatttttcttctcccttctttcattttctttctatttcttcctttattttctgatcttacttcattcccgttctcttctggttgttttagtgaagtaggatgcaaacacagaaaagatgcacatatcttaggtgtatgcctcaatgaattttcacaatccaacccacccatgtaacgagcgccagatgaagaataaaatgttagccacagccctagaagctcctcctgctctctcctctccacatcttttctcccgtctccactgtcccagggtaaccattattctggcttgtagcagcataggatctttttgcctggaatgttggtgtctggcttctttcgctcattactatgtttgtgagattcatccattgtgctatgtgtagttgtgtatcatccattttcaccgacacacttacttattcattcttctgtcaatggacatttgtgcaggtgactatcatgactactctgtcacgaacattctctctatcaaacatcttttggttggattcacagacacttttctcttggatgtatacttaggagtggacttgctgagttgtagtgtataagaatgctctccttgtgtaaacactgccataggttttctaaagtggttgcaccaacagacattcccacccttcagttctttaaaaaataattattgaatgttttgcaccagaatctggtggaattctctttgtcttctttgccttctctttaattaatcctgtttgtgctatgtccttccttactaaaaacatgtatttgtttaatagctttattaaaaaatttatcgcttaataaaaaaataagtaataatacttattatgtgctaggcaaaaatgttgagcactttacatgtgtgaacttgtataatatttacaaatagtataatgatcccaattttacaagtggggaaactgagacatgaagtatttaagtaacttatccctagtcattcagctaggaaatggtgaagtcaggatttaaacccagacagacttgagcctgtcctctcaactgctctacaaactgcttttcttagtgcacactatggaagtgcacactttgaggaaacaaaggcatggttttaacggtcttaacagagatcaaaatccctttcagaataatagttacatgaaatgaaaactaaggctgccacatgaattgggaagatgaaggagctatacaagctgtcacgtaaagatactatttaccatggttggggtgaggagaggaaaaggcttcatggagcaaaaggcactttagctgaaccttcctgaaaggtcaggcatctgataggcaaagaaaagggaaagatgtcctcactaccctttatggcaggctgtgtccccacagactctcagtgcaaattcctccttcctgaagaaagcagtcaccaagcccaacgtgcaactctcttggtacattataacttaatcaaggtgatgtttaattgctttcctcctgcttggcttcaggcttacatcaccaaagcctttagagaaacagtcaccttcacagctgtacattctgcaccaatgactacatactttagggaaggaccaaggttacagagggagactggtgccttcgctgcatgatgcacagactcagaacatccctgcactgaagtgtaggcaatattcttaatggcaatgtggcagtagcaaataaaattatatgcataaaatgtcttcgagggttttggttttttgttttttgttttaatgaaaaatgtgttacacgtattttcgatcatttccttggctatgatctaaacaatgtgtggtatgacttctctttccttaatcccaaacctatcagagttaactttcattttatcttctccaaatatctactgctattgtaaatttggacagatctctttcaataacattttataggaaatatctcccatttggacatccctgcagataacttatagttttgatattataaagcttcatgctgcaaaaaaaataattcttctttggtcataaactatttctgtgcatattttccattttcaatttcatattatgccttagctcaagataaaaggactttactttgtaccctttaatgttaaagaataattggttagagtcaattctagctttgtctggagaaaaacactatatgtctaattccagcccatagtttcacaaatgtggtgcaagttttgaataaatttttaccaggaaagtactttaaaaacacatttagtgctcactttggcagcacatattctaaaatggaaaccatacagagaagattggcatggctccaatgaaagggtgacatgcaaatctgtgtgacattcatatttttgtatgactgttgaaagtgaaaactataacatatctgatagcatttttaatatatttagattcaataatatgaccactgcagcataaagggtaaagggcaaggaatttatacagttgtaaggtttatatactttacttgatatagtaaactctaagtagcctgagaaaaactaggtatgtgtattgtaatccctaaagaaacagctatttgagttataaaacaaaagtatagtaaaaaaaaaaaagccaacagataagctaaaatggaatgacaagaaatattcaaataatctaaaaggcagaaaagaggaagagaatagaaaactgataataaaatggtacacctaaatataaccatattaatacttaagctaaatataaatggtctaagcacataaattaaaagctgaagattgttggattgcataaaaaagcaacaagaagacccaactatatgctgttacagaattcacttcaaacacaatgttattgataaattaaaagtaagaggatggaaaagcccctgccatgcaaacactaatcaaaagaaagctgggccgggcgcggtggctcacgcctgtaatcccagcactttgggaggccgaggcggatggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaagaaagctaacctctaaattaatataattattaataatatataaacatatattaatgtaagtctattagacaaaatagacttcagaaaaaggaaattatcaggaatagagacattacataataataataataataacagagccagctcaccaagaagatagaacaaccttaaatgcatatatacttaataacagagcttcaatattgatgaaacaatagctgatggaactgaaaggagaaagagaaatacagaattatagttagagacttcagttctcctcttttggtaatttatagcacaagtagacaaaaaatccataagaatatagaatatagaagacctaaacaacactatcaataaccttgaccttatgaacatttgtggaatatcccacccaaacaacaacataatatacactattgtcagatatatatggaacatttaccaaaagagatcacattctgggtcacagaacaaacttcattacgttaaaataatgaaattatacaaagtatgttctctgaccataatggaatcaattaaattaatatccagaaagatatccaaaacacttccagttatttggaaattaagcaacacactttaagaaattcattgatcaacaaggaagcctcaaggattattaaaaaatattttgaactgaattcaaatgaacatacaacatatcaaaatttgtgagatgcagctaaagcaacgcttagtagaaatttatacataaaacacttattttggaaaataataaagttctgaaatttataatctaggcttccattttatggaactagaaaaaagaacagccagctaaaaccaaagcaagcaaaaataataaaataataaatataaaaacagaaattaatgaaatcgaagaaaaaataaaacaatagagaaaatcaataatactagaggctggtttttatcaaagatcaataaagttgataaatttctcactagatttaccaaaaaactagagagagaagatatattatcaatgttagatacaaaagatgggatatcaactatgaacttcacagatacaaaaagataagggagtactacaaacaactctctgaacataaattagaccatttagataaaatggataaaagacacagactaacaaaattcactcaatgagaagtagataacctgaatagtcctatatttattaaacatattaaattcatagttgaaagccctccaagaaaagaaaactacagccccatataccttcattaatgaattctactaaacattttagaaagaataacaccaattccatgcaatctcttccagtaatgagaagaggaggaagtgaaggacttgtatccaggatttgtaaagaatttttacaactcaaaaaaaaaaaaaaaaaaaaacccagctaaaaaaataggcaaaatatctgagcagacactttaacctagaagacttaccaatggcaaacacatgaaaatatgctcaacgttcttcagtagagcaatgcaaataaagagataccacaatatacctattagaatggttacaatgtgcattcatgataatcccatgtgtgagcaagaatacagagcaactggaactctcatacattgatggtaggaatgcaaaattgtacagtcattctggacagcagtttggcattttcatataaagtcaaatgtacacttactatatggcccacttaccatcttctgggtattatccaagagaaatgaaaacttatgtttacataaaaccttggtacataaatttttttttacaaaagtattattcataattgccccaaactggaaacatccccaaatgttcctcaatgggtaaatgaattaaaaaaagtgataacatttatgcaacggtatatcacttagcgataaaaagaatgagctattaattggtgcacaacacaggtaaatctcaaatgccccatattaagtgaaaaagaaaagcagtctcaaaaggttacttactgtatggtttcatttacatgacattctggaaaataaaaaaattatagggatggagagaagatcagtggctgccagggactgggatagatgagggcttgattacaaaggggcagctttcagctgatagaactactttgcatcctgtttgtgtcattggttacacacatttctgtatgtgttaaaatatacagaactacacaccaaaaaggtgaattttctgtatgcaaatttaaaaaatgatcaaaatgcttaaataatttccaaaaaggtaaagccatcaggttctattgccatacccactttccacacagtctttgcttcaaatctgtaacatcagacctcatcttaccattaatttcagaaatgtaaaagagatttctattttatgagatgcagtgcttctaattaggctgatcaacaaaataaaacaaactttcattgaaataacaaaacaaaataaacatatttagacagtgtgtttgtgtgtgtgtgttatgaaatgac

SEQ ID NO: 75 - DNA, 7758 bp, Homo sapiens
gcatttagacctgctttatggggaaagaatcaggactgtggcttccgtggccagtgtgcggcagttgccaaacaggtcatgtggtcctggttccccaggattcccaaaggctcaattctctaaccagctggtgctttccaggcagccagtgccccttgggccatcaggaccctacagcctgcgaggaatagttttagaaagcagattaatttcctattgtgtgtgagtgattttaaatgagtttttcgtttcccctttcttcccttctgtgctctggttgctcccacagggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaaggattgacgttgctttattcagtctctgccatcccatgagaggagagctggggcccgtaaagccaggttccaacgtcactgctgctctgacatgggacacgcagctgtggaatgggacagagatcaggtggcctccggagatgtcttatgtgcggagcaggcgtcctcatgctgtttcttggcactggcttctgggcttggctgtgatttccaggagcagtttgagaatggcctgggccccatgtgaaaatctgaaaggaaggaccaggatgttgagggcggaagttcacaaagtcccagagtaactgggatggatccgggacctggtcctgcagctgtgctgccattcatgacagatgttgtcattctgggattagaagtcgcttcgaaccggcacttctcctcatccctcaggttaatgctagcaagtgagagaaggtgtcagatacttgatagcaagacacattgaagaacgcgtaaactgggggtctgtgtgaatgcatcagattctgagcactgtttgcttagaacaacagaaacattttatagttttaaaactgtaagtaactgaaaacgatgtgaatcaaaaccctaagagacttcgggaggccgaggtgggcggatcacaaggtcaggagttcgagaccagcctgaccaacatggtgaaaccctgtctctactaaaaatacaaaaattggccaggcatggtggcgggtgcctgtagtcccagctacttgggaggctgaggcaggagaatcgcttgaacctgggaggtggaggttgcagtgaactgagatcatgtcactgcactccagcctgggtgacagagctagactctgtctcaagaaaacccacaaaaaccctgagtgaataagaactattaagtaggatccattgtcaaacatttctctattaatctatagacaggaatatctgctgttagttcctggagattttgtcctgagctgagtctccagggacactcgcggtgggtgtgtgctgtgcttggctgagctgcagtgcttgagaggacaatcctaagccccttgttgatgtgcagcaacttcatcttctttcccagccctcattggaaggattggattagatgagaggtttcagcatttagccgacctctttatgtaggaaccccaactaaaacacagcaagcagggctttcactctggttaaagcacagttgatgtttggagccctgaatcttcatccctggctccccaaatgatttctcacttcctttgcatctgaacaccctgggctcctcttatccagactgttctgccaattgctggtcactcagttgatagctggaggaagggccctggctacaggggcccacgtgtcatccactgcatgtcaccactgctgtgggtccagaagagcctgggctaggtccctggaggggtagcagcgtgctgttgggcttatttctgatccctttgggaagagactttcactttaaaattaaaaaaatttttgtcctagccagtctaatttagcagtggggggttatataccaactttagtgacttttttttttttttttgagatggagtctcgctctgtcgcccaggctggagtgcagtggcgtgatcttggctcactgtaacctccacctcccgggttccagcgattctcctgactcagcctcctaagcagctggcgcccgccgccatgcctggctaattttttttttttttttttgtatttttagtagaggcagggtttcaccatgttgttcaggctggtcttgaactcttgacctcaggtaatccacccgcctcggcctcccaaagttctgggattacaggtgtgggccaccgtggctggccttagtgacgttttttttgtggctctagcagctcttggcaaatgatcccccgtgaagaaagcagccaactccctggctcatctcccgctttctgtttggactgtggggtgtaagatgctactttggacatggtcagagagagcatctgccacctggcatgaatgccgctacgtaccgtttgcctgtctagctgaagagtgcctctgggtagagtgcctctgtgtgggttttcttcctggagctgccgggtacctggttttgcatggctctccatgaaacctcgggaatgagccttccttgagccgcatctgtgtgccgttcctccctgctggtggggctgatctcccgggtggtggacagcttcttgcctccaggtgttttcatttcagccgctcagtcctatcccttgctcccaaatattgtcttacaagagagtagtagccagcgctccacttccttcagcccagagtggccagaaatgatccctgaccaacgcagctgagacccaggagccaaagctgggaccttgagtcacagtgaggcctgcaagaactatacagaggtgacctgaggacaggacacagtgctctgacctcaggtggcagaaaggacaatgggcccgggtttgagttgactgagcttgcacggctaattcatggtgaagccaggcttgggcacgagcccagtctttttctgctgtgcctttccagacttgaggcctcactggccttgactcccacgctctgtcctgtgccttgggagaggagcaggttttgaaggcttggaaatgacgagcggcggggccggcacagcctttgtagcaggaggaatcggttcacgtagccttcctcctgtgcccgctgcgcatgctgactccgcctttcttggcagctgccccggagatgccactagtgcgcatctcctgagagccaaggtggaagctggcacttctgggagaggggaggcatcctgggtggagccacggctttagggagcacccggtagccagctctgccccctccccgactgtaacagtgttgtgccttgtctcgtgtgttggtgatacagcattcctgaaaagcagattccagtgaggctccacaatttccttctaagctgctgatgctcattctgcaagttttttgttgttgttgtttttttgagacagattttcgctcttgttgcccaggctggagtgcaatggcgtgatcttggctcactgcaagctctgcctccgaggttcaagcgattctcctgcctcagcctcccaagtagctgggattacaggcatgtgccgccatgcccggctaattttgtatttcccattctgtaaattttgatgctgtgctttatcgatctttccaggagtcgggcaatgacaccatcacagctgcgcctactgacagtgattgtgagatacaggagatgtggcccacgtgaagctgggggtgccttggcacctgtgcagtatggcacatacttgggagaggcagcgctctgcatggggatctgtgagacccagtttgtcggttatgtcacgttacctctcgaataaggctttgtgacatccagtcagccggaatggagcctgttactgggctgcttagtctcagtaggggttgaagtccggggccacactttctgcccagcttacaggctctgtagctatagtgaatgcctttgaaaagcagtagcatgatggacttacaccctttcaatagcttcatataagattcccaacaagaatgaggtacttcacaatctgcttgattcccaaatggcaggtgcctacagaaggaagtggacttctctgtctggtcctgacagctgacttaggacggcattttggcaaaaactcaacatctgggaaagctcttggtgcagatgttgtccccgaaaggtggaaagggagaggtcctttcttgcattcctcccagagactgggaagcctgtgtgggtggggcctcgcaaggggagacctgcctggaactcaagggagaggagtcctcaccacttcctaacgattccaacctggagcctgttctggcttttttctttttttgggagtgaaggaagagcaggaaggtgtggtttgacaacagtgagctctcttctccagtcttgatgtggacatgtctgtccctcagcagcaccggcctctggggagaagggccctgggtcggtcatacccagagccatagaaagggctggctagaacagcttggccttacggctcacagttcatcttagctgaggtttcctgggacaggaaaaattggtgacacaaagatgtgacaaatctatagcctgatgccatcaggaattggaagtgtcccctcaagccagcaggctagaaataggtgttagctgggcatggtggctcacacctgtaatcccagcactttgggagggaggccaaggcgggacgaatcacgtgaggccgggagttcaaaaccaacctgtccaacatggtgaaaccccgtttctacaaaaaaagaaaatacaaaaattagccaggcctggtggcgggcgcctgtaatcccagctactcggggggctgaagcagagaatggcttgaacccggaggtggagggtgaagtgagctgagagcatgccactgcgctccagcctgggagacagagcgcgactctgtctcgggaaaaaaaacaagttgttatccttccaaagcagtttaaaaatagtccactggaatggctgcattaaagaaaataaataaaaacaacaacaaaaactggcatctatgatgtggcaagggcagagcgcttatggccctaaacgaagccccggcactgcctcatgtcgtctagacccaggctcaacgaaagagcaagcctttcccaagtcttgcctgagttcctcctcaccgggaaccacactgctgctgggtagaagctgaccagcttgatcttctgatacactcaaagcccagctgccataaactgtcttccttgtgctctgaatgcccaacgaaggttgtataaactacctttccttaggtctggagtgtcgggtcagtcaagaagggacccttttagttattaaatagtatctttgcagaatcagggcctggaattggttcacacagattgtttctcctggcacgctgagtagttgggaaactgtgacgtgaacaccagttagatcagccagtagggaagaattctttttttttttgagacggagtcgcccttctctgtcacccaggctggagtgcagtggtgtgatctcggctcactgcagcctccacctcccaggttcaagtgattttcatgcctcagccccccaagtagctgggactacaggtgtgcaccaccacacctggctaatttttgtatttttagtagagacggtgtttcaccatgttggccaggctggattcgaacttctgacctcaaatgatccacctgctttggcctcccaaagtgccgggattacaggcgtgagcaccatgcccagcccagagttcttactttttgagaaaaacaagcctctgaattctgtacactcttggataagatactggatgtgggggtgggagccctgctgaagcaccatacctgtgactcacctttcctctcctatggtagtggcacaggaggaagagggcacttcggcccatttcacacgtttctactgctgccaagaagcctagtcatagaccccttacccccagaaccagtctaaccggagaatattatggaacaagaaatcggcattctctgtttgattctgtgctgccctagtatttctctcatcctagttggcccgcactagagaggctgcccttggcctcatcactgaatcctccaaaagcatcttcaatgcgtgtctgcctgaaaatgcagcctgaaatgtcctggacccctgaaaatgtcctaacccagcagtgagcttcattggctggtgaccagagccctcctaaatcactcccttgacaggtgggccagctcctgcctttgggtggtctttcccttcctagtgcgtgtgcatcctgtgaggcactggcaggaacaagagttggagccaggactggcctgagaattattctgtcgtctgacctgggagacagcgccctcagcaaaaagggcctggcgccatcatttgaagttggtgtgtagcacccaccctccagtcagatcacagatgggaaatcgagaacagaaggtgagaaaacagattccacgttcacatgattattcttgtttattgaggtctctttattctccacgggtgcttttttcttcaagtaaacagagcaggcgcaaatatctataatgaataaatttattgtcttacaaaaatcattgtctagaaatatgggaatacaagaaaagatatttgcggtcaggtgtctggtggtcaacagccagt

SEQ ID NO: 76 - DNA, 8527 bp, Homo sapiens
tccaaagagaggaactacgcactaggcaaactcctttttttttttttttttttcctgaggactgatctgaggactgatttaatgatgattgtcgaagctgagctcccagatgaggctcacaacatcttctgggaatccaaatgaaaggttaacatactatattctcttcccaaagatgtaggtagaaaaaaaaaacaaaactcgatctctctatcaaaattaacgtcatgcttttcagtaaaatgctttggacagagtggtaaatttataatagtttatttaatctattaagcttcagtgatttaatttaagttcaacaaagcatttgggaaagatgttatatattttgccaactccaagtgaggcattttgttgttgggttggtttaattcattcagtaaacatttgtcaaacatttactgagaacgcattagcctctgggaattcaatgatgaataataagacattgtaccctcaagggttcatagacactccagccacaagtgtgaatgtgtacacatttcttttggaatttttctcagagcagagaggtctgtctcaggctagtctttttgtttgtttttttttgtgttttgttgtttgttttaaaagctcctgcttacagtggaggtttaaaatcctagttcttttaattgatgttattttcttaaacattggcatttctcattaaggcttcacttgttattccttactaaaaatagcaaaaacaaaatggtcttatataaaggcaattgagtacagtggaaaggtcagagactgtgcaagtagaatgacctacgtttgaatctgagctctgctacactagtaatttggagagtcctttaagcagctgtttcctcatctgcaagatggtgataatgataccttaagagaggtattaatatttattaggttaaggctgttataaggattaagtgacagaatacatgtaaatataactaggctggcacctgataggtgttaattcctaacatttattgagtacttactaggagtcaagcactgtctaatacgttttgtgctggctgattttatcttcctcacactcctatgaggcaggcactgttactatccccttttaaaggtgaggaaaccaaaatcataggttaaataacttgctgagggcatggaggtgccagggttagtacccaataccatcctgtcaattaatggatgaggtctgtaatagatgtcaactatctttcccttttagatatgattgttttataccaataagtggaactaactagtgccctgcttatggctgcatgcagattaatactggtggtgggggatggttgactccttgaatatgttcttaaatggttaatgggtctaccacctttgggggtttgtgggatgcttgtaggaaaggctctaatgaacatgtcttttcttttcccagcccctcacaagtccacctgtgaggtggtcctctctgacattgtccgttgctccttacccccaatgactccaattaggaagtcagtcgacttatttgtgaacaaaaaattggagaatcatggctgcctattagaatttgacctatgctttgtgaggtctatgtagggatggacatagatgcaatattttcttggtctccaaaaaaatagcaaggtaagaaatgtgccccagagcactgttacagtaagaagaaaagtctaccattgatcctggatatttcatatttcctatttccattggcattttctcaactcccagattctggagaaccttgagctaaaacttaaataaaaataagttccaaatggtacgttgaaaacgctgctgatttaatgaagacgaagtcaccttgaccaattcattaaaataatgtatagatgcccaggggaaaatgtaattaaataaatatggatcctagtatctgttcctatatgagccttttcacttagtttctcccccaaagtcctgagtgtcgtggaagatactctggattattggtcctgacatcaaagcctctccattgcagtgtggagttaactaggcagccagaatctcaggaccatttcctcagccactcaagtggtgccacgttggtctatttccagacccatcgaagaagcccctcagcatgcagagacctttggagacactggactgaaaccagatggtgcagaaagaagcccctaagcaaagtgttgcttgcagccctgtatttgaaagagtgccactgtgtaccaattatgtccatccaaatgagccgtattattttggggcaaaatgactgggaaatgaaattattaggactctgctctctgatggggaaaaaataaatctggaagaagaacctacaaggatcttagctgtctgcttgtctctgacactctcgaggccttgtgccaggctgctttgctgtgcaaaagctccacttcagtcttttagtctgactcacaatagacgcacatggttgaagttaggagaattgcaggactgtcacttgaagtccctctcagcctcttcaccatcgcccccagcctctttccctctaacattaagccctttgtgtcggttcccatggttacctcctcactactggcagctggaatgtgatagtgagaggaggctgcctcccctactgagccaggtctggctggggcggaggccattgatccgcagctggatttgtgaaatggggtcacagtccagtaccttctctttgtcgtgggttctatacctttcccaggcttgacatatcagggttgcagtgggaggggacatggtgggtgatggactgctcacaggacatgtcctgtcataggctggcctggcctggcgtccctgacctgccaaactcctccctgaggtcacccttccatgtgtgaatgcccattgagggggaaggggctgctctgcttggtcaaataaaaatgatgactcacttctctacctgctttctgctcagattctgttcccaataccatctgttcttaagttagtcaacattaacaagggtgggctccagtctggaaagaatttgcatcaaaggcatgttttcacatccagcttggaagaccaggcaggctctgggaactgggggatagcatagggattcaaggttcaagatgaaaacaaaactagccgagaggtttttgttgttgtttttataagagacagggtcttgttctgttgcccaagtggggtgcagtggtgcaatcatatctcactgcaacctcgaactcctgggctcaaacaatcctcccatctcagcttcctgagtaactaggaccacaggcacatgccaccgcacccagctaattaatttttttttttttttttttggtaagagatgaggtctcactgtgttgcccaggctggtctcaaattcctggcctcaagtgatcctcccaccttgacctcccaaaacactgggattaaggtgtcagccactgtactctgccccgagagtttgtcttgaagctatttcctgacatactatttggaggcttcttaaattccttctcatttagagtctggtgggccccagagttgaggcaggacttggaattacaggtggaaattaagcagccctggtggtgagggtgaggggaggtagtttctagtagaaagcaccaaaaatcaacactcctgaggaattcaatactggaagaattgttatgctcttcttggaacaaggcaaatctgttttcagagatctttcagccctgtaggtatctaactaagcacttaagtgatgcgattgtgggagaaggcagttaagggcacactctggagccttataataggttgggtccaagctttaccacttcctttgtgatcttgagcaggttatttaagttacgtttgcttcagtttctttttctgtgaaatgaggacagcatttcagagggttgctgtaaagattaaatttgttatgtaaaaatactttgcatgttgtacagccagcacaggtgccaattgtaatgtttttaaatgttttgagaatgtcatgctaaactgaggacatagattttatcagttctactttgtggtatgtatgtcagtgggtccagaattcccctggagagcacaggaaagtgctggggtgagcaggaacatacaggatgaggaaaaaaagaattcaagcatttatgacactaccctatagtaactaagagaaaggaaaaatgaaggggataagtagaaaatcagcccatggaactatagtcacaaacacttagaaaaggtctactgtaagctgtaaaccattacttttccacaaatgggctgcagtttggtaccttgatgtccatgtaaattgtgctcccaaagaatataaagtaaccactgggaaaagctgagtccccctttgggtgatagcaaaggttggaaacatttaggtttgatatttggaggcatttaaatagcatggaatgtctattatataccctaaaaagcagaacgaatcttggatattatggacacaaatgcatttggcatgagcttaaaaaaagtgcatgtgagcttctttctaagacccaataatcctcttgggcaaagtaaggattaggcctccctcacaaacaaggcagggagttcatttttgctaagattcctcagctgatgccaaatttagcaagggacccattttttcccaatgaatgacaatctccatttacatttttaatgtccactcctttaggcaggtctagggctggagcaacttatttgcatatagataggagacaggaccctggctcctacagactacattgggaccctcagagaccttcctgagccagagtccctttacctcactcgcttacaaaaggggaggggtctcctaccccagagcctgaagtaggaaggactcaggggctgaaaaaagctggggccaaactcattctgttttaaagacagccttgaagatgcattcaccaacagccatccctgcctagtgcctgcgactcctgccagtgagaggtggcctctaggcagctcctctaggttaattctgtcatccttgaccttgaggagccctttctttcacaccactcactgggtcctctatatctattcccaaggagctcaggtaatgccctatattttctgttcttatctgcaaaaaaacccctccactttggatttaaatatttatattcctccccaaatgttttgggcaatttgtagttgccctttttaaggaattaacccatcaagacaccaccatcctgtcaccctccccatggtgactttccacatccatctcccttatgcaggccatgttgattgaacaatgatagcacctgtcttgcagtggttattaagccacagggtagataatactttgtcccctttttacagatgaggtcctgaggttcagagagaatagtggccaggaactggcagagatcagattagaacccaggttgatccagctacaaatcctttgtgtgcctccccaacaagactggaggtcagaagctgtcttttattctacaccaattccaactcggagcctgcatgtagaacatgctcatcccttgttgatgtaggtacgcagatcatgttttctcacttgggatttgccatgtaggccctccccctgctttttacctttggttcatcaactgtcaaaggtaaagggacccccaggctcatctgtactaacctcctcattttacacatgagaaaatagtagcccagaacatgaaaatgacttgctcatagcaattacagagacggccttgtgcaggtgtcctggctgcaggtccagtaatgtttcctgctataatagggtatgtatatatggccttttagagggtctacttaaccatccgtgctcccttccctgatgttttgtgggaacagggaagaaggattaccaaatcgactttcctgctttacttccaccgtgcttgttgcatgttctctttcttgctcctttccacaagtagctcctttccaaagtgcttttctggagatgattaatggtactacaccatgcagcatagtctaggagaggcatgtcagaggtatttggactgggatgtgttctatgtgaccccagctttaccctttgatgagactcccctgatgcaggatgttagccctttgtggcttcagctgagggtctgagcgttggctgagttatattcacattgatgtagtccaagcagaatatcagcaacagagctgtactctgggaagacagtaattcccattcgaatgagacaggatagataactgcagggaacccatcaggaagctggcctcgtgtccactcggcatatttttattaaccaaatacttattgggcatcatccaaggaagagaaccatatggggccaaggaagaaaggagaatctcaaataagattaagactatgacatcatagttaagagcatagactttgtcatcagccagatctggagtcaaattcttttttcaccagcatttggacaaacttcctgcacttctttgagtctgtttcctcatgaataaagtagggactaatagcagaaagtcacctgccttcaaggttggctgtaaggatggtaagaagctgtgcagaaacagtttggcccccagcctggctcagagcactccataaggtaatggcaactttgaggactgatgcttggatacctgccctccctggggcatgcgactgggggaagcaagtgtctacaccgactgtgtaaaagtgaatgacaaggagagggaggcatgctgagtgtgggctgctctcatggtctcttttcccaggacttatggcgtgtatgtatatatttattcagttaattttggctttcttcccattaatttataattccacaaagggaaggatcgtgtctgttttgccacgagtccagtgcctaatccaatgtgtggcctgtggttagcccttagcaatagttgattgaatgaatggatgattgggctaggtatagatgtgactaggctctgggtttcagcatgaaatatcttttttttttctttctttctttcttttatttatttatttatttttgagacagagtctcactctgtcacccaggctggagtgcagtggcatgatctcagctcattgcaaccttcctccacctcctgggttcaagtggttctcatgcctcagcctcctgagtagctgggattacaggtgtgagccaccacaaccagctagtttttgtatttttaatagagatagtgtttcaccatgttgaccaggttggtctcaaactcctgacctcaagtgatctgcctgctttggcctcccaaagtgctgggattagaggcgtgagccactgcacctggccttgaaatatctatcttaatatatcctgcatcatttcagcagtgtgaccggcgctagaaagttcttgtaggggcaggaatgctgtctgggtgtcaggggtagggacttcatcatttctctagatctagggacagttggacttgagagaggggtctcatctgaatttcagtcagtctactttcttcttctgaagcttcccctttaaagaggcttttggtattaaatgtttgctactgtatcaatggacttttaggatcacagaatccaaaggcagtatggaacaagagagcttaaaaattagagtatgagaccctgctgtgccagtcgtgtggcttagaagtcctgaccttgagcgaataactgtccctctatgaggctgtctctgcatctgttaaatggggataaataatacttgctttacttgccttttaggattattgagggccaaatgaaataatgtttgggaagtgctttataagctataatctggtattaaagtaatgaataatggttcgctgtagagatttgtattgttctctgggaacactagtctgttactgtaggctaatgatagaggatagggaaagaaaggcctagactgaattttttcaggaggtatttgtctctctctactgatactagtttcacagaaaccctgcttcttcctccactggctattttcagcagttattggagctctcaaagtaatccccttcaccaactagtgtggagtctttctgctgcccacatatgctctcaggataggcacttccatttcctagagaagatgttcctttaaaaatgtagaaaatttagacccttagactcattctattaagaaaaaataaggctaattttactattatctgataattaaaataataaacattaattgtaaacaatttgcaagacatagaaaagagagaagaaaaatagtacccataatcctgtcacccagtagtaacattttggaatacttgctggtgttttgtttttatgcatatgttttatctcatatgaataacaaaagagtgatgtggaaaaattaaaggcatacatggtttgatatgtggttgatacctaccaaagtatacaaagcccagtaatcctaaaaggaatctaatggggtaggtagtggagagggtgaggcctttagccatagctctttctactttttaatttaatttttcttttcttctttacaataaggatgattattgcctcaaatga

(The sequence listing continues in the following parts.)

What is claimed is:

1. A method of hybridizing a nucleic acid probe comprising:
   (a) hybridizing the nucleic acid probe to a polynucleic acid from a human subject by nucleic acid hybridization or microarray analysis, wherein the human subject has Autism Spectrum Disorder; and
   (b) detecting a genetic variation in the polynucleic acid by the nucleic acid hybridization or microarray analysis, wherein the genetic variation is a CNV selected from the group consisting of: loss of SEQ ID NO 1 or 3-7, or the complements thereof, in the GPHN gene; or gain of SEQ ID NO 2, or the complement thereof, in the GPHN gene.

2. A method of synthesizing a nucleic acid product comprising:
   (a) synthesizing the nucleic acid product from a polynucleic acid from a human subject by PCR or sequencing, wherein the human subject has Autism Spectrum Disorder; and
   (b) detecting a genetic variation in the polynucleic acid by the nucleic acid hybridization or microarray analysis, wherein the genetic variation is a CNV selected from the group consisting of: loss of SEQ ID NO 1 or 3-7, or the complements thereof, in the GPHN gene; or gain of SEQ ID NO 2, or the complement thereof, in the GPHN gene.

3. The method of claim 1 or 2, wherein the CNV is loss of SEQ ID NO: 1 or the complement thereof.

4. The method of claim 1 or 2, wherein the CNV is loss of SEQ ID NO: 3-7 or the complement thereof, or gain of SEQ ID NO: 2 or the complement thereof.

5. The method of claim 2, wherein the nucleic acid product is cDNA.

6. The method of claim 1 or 2, wherein the polynucleic acid comprises a nucleic acid from blood, saliva, urine, serum, tears, skin, tissue, or hair from the subject.

7. The method of claim 1 or 2 further comprising purifying the polynucleic acid.

8. The method of claim 1, wherein the microarray analysis is selected from the group consisting of a Comparative Genomic Hybridization (CGH) array analysis and an SNP array analysis.

9. The method of claim 2, wherein the sequencing is high-throughput sequencing.

10. The method of claim 1 or 2, wherein a whole genome or a whole exome of the human subject is analyzed.

11. The method of claim 1 or 2, where the CNV is loss of SEQ ID NO: 3.

12. The method of claim 1 or 2, wherein the CNV is gain of SEQ ID NO: 2, or the complement thereof.

13. The method of claim 1 or 2, wherein the CNV is loss of SEQ ID NO: 4, or the complement thereof.

14. The method of claim 1 or 2, wherein the CNV is loss of SEQ ID NO: 5, or the complement thereof.

15. The method of claim 1 or 2, wherein the CNV is loss of SEQ ID NO: 6, or the complement thereof.

16. The method of claim 1 or 2, wherein the CNV is loss of SEQ ID NO: 7, or the complement thereof.

* * * * *